United States Patent 8,343,764 (GENES ENCODING GLUTAMINE SYNTHETASE AND USES FOR PLANT IMPROVEMENT) - sequence listing, part 4

SEQ ID NO: 14502 - protein, 321 aa, Fusobacterium nucleatum subsp. nucleatum ATCC 25586
MEKNKLKILFLDRNAVGPYELKGIFSKYGEYTELNLTNNDDIASYLKDYDVVILNRIRLGKKEFEKTPHLKLVLLTGTGYNHIDLVAAKEYGVTIANVANYSTNSVSQLTMTLLLNELTRAEKLSQEVKQNKWEEISNKMDRYYHVDTEGKVLGILGHGNIGKKVESYAKSFGMEVMIAKIPGREYTDNLENRFELDEVLEKCDIFSIHAPLTDLTRDLINLDRMKKMKKSAIILNLGRGPIINEEDLYYVLKNKIISSAATDVMTTEPPQNDCKLLELDNFTVTPHLAWKSLKSVERLFAAIENNLNLFLENKLIGLESK

SEQ ID NO: 14503 - protein, 504 aa, Fusobacterium nucleatum subsp. nucleatum ATCC 25586
MRKRALISVYDKTGILDFAKFLVSKGIEIISTGGTYKYLKENNIEVIEVSKITNFEEMLDGRVKTLHPNIHGGILALRDNEEHMRTLKERNIDTIDYVIVNLYPFFEKVKEDLSFEEKIEFIDIGGPTMLRSAAKSFKNVVVISDVKDYESIKEEINKSDDVSYEARKKLAGKVFNLTSAYDAAISQFLLDEDFSEYLNISYKKFMEMRYGENSHQKAAYYTDNMTDGAMKDFKQLNGKELSYNNIRDMDLAWKVVSEFDEICCCAVKHSTPCGVALGDNVEGAYKKAYETDPVSIFGGIVAFNREVDEATAKLLNEIFLEIIIAPSFSKAALEILTKKKNIRLIECKNKPSDKKELIKVDGGILIQDTNNKLYEDLEVVTKAKPTSQEEKDLIFALKVVKFVKSNAIVVAKNLQTLGIGGGEVSRIWAAEKALERAKERFNATDVVLSSDAFFPFKDVIELAAKNGVKAIIQPSGSVNDKDSIEECDRNNISMIFSKLRHFKH

SEQ ID NO: 14504 - protein, 452 aa, Fusobacterium nucleatum subsp. nucleatum ATCC 25586
MRGVCIMINNLSELQKKDLKYVFHPCAQMKDFEENPPLVIKKGDGLYLIDENGNKYMDCISSWWVNLFGHCNKRINRIITEQVNNLEHVIFANFTHEPAAELCEELTKVLPKGINKFLFSDNGSSCIEMALKLSFQYHLQTGNPQKTKFISLENAYHGETIGALGVGDVDIFTETYRPLIKEGRKVKVPYIDSKLSNDEFVKLEDECIKELEDLIIKNHNEIACMIVEPMVQGAAGIKIYSAKFLKAARDLTKKYNIHLIDDEIAMGFGRTGKMFACEHAGIEPDMMCIAKGLSSGYYPIAMLCITTDIFNAFYADYKEGKSFLHSHTYSGNPLGCRIALEVLRIFKEENILKTINEKGTYLRNKMKEIFEDKSYIKDIRNIGLIGAIELKDNLLPNVRIGKEIYNFALKKGAFLRPIGNSVYFMPPYVITYEEIDKMLHVCKESIEELLKI

SEQ ID NO: 14505 - protein, 435 aa, Fusobacterium nucleatum subsp. nucleatum ATCC 25586
MQEGKMSFLDGYFRITERDSTVSREVMGGITTFLAMAYIIIVNPSILSLSGMDKGALITVTCLASFIGTIIAGVWANSPIALAPGMGLNAFFTYTLTLEKQIPWQTALGIVFLSGCFFLILAIGGIREKIANSIPVPLRLAVGGGIGLFIAFIGLKSMGIVVENQATYVGLGEFTKTTCVSIIGLFIIAIMEIKRMKGGILLGIIVTTILGIIIGDVSLPEKIISLPPSPASIMFKLDILSAMKLSLIGPIFSFMFVDLFDSLGTLMSCSKEMGLVNEKGEIKNLGRMLYTDAASTIMGASIGTSTVTAYVESAAGIVAGARTGLATTVTALGFLLSLFFTPLISIVPGYATAPALIIVGIFMFRQVAALDFSDFKILFPAFITIFTMPLTYSISTGLALGFLSYLIVHILVGDFKKINITLLFIGAICLLHLLV

SEQ ID NO: 14506 - protein, 336 aa, Fusobacterium nucleatum subsp. nucleatum ATCC 25586
MEQKKMKYLENLVGKTPMLELIFDYKGEERRIFVKNESYNLTGSIKDRMAFYTLKKAYEKNEIKKGAPIVEATSGNTGIAFSAMGAILGHPVIIYMPDWMSEERKSLIRSFGAKIILVSRKEGGFLGSIEKTKEFAKNNPDTYLPSQFSNLYNSEAHYYGIGLEIVNEMKSLNLNIDGFVAGVGTGGTVMGIGKRIKENFSNAKICPLEPLNSPTLSTGYKVAKHRIEGISDEFIPDLVKLDKLDNVVSVDDGDAIVMAQKLAKCGLGVGISSGANFIGALMLQNKLGKDSVIVTVFPDDNKKYLSTDLMREEKVKEDFLSKDITLKEIKNVLRVI

SEQ ID NO: 14507 - protein, 435 aa, Fusobacterium nucleatum subsp. nucleatum ATCC 25586
MSAASKAKRIDKSLDITVYEMTDAISWGACGLPYYVGDFYPNASLMVAKTYEEFQKEGINVKIKHKVENIDFKNKRIFVRNLNENKVFEDNYDKLVIATGASSTSPKDIKNLDAEGVYHLKTFNEGLEVKKEMMKKENENIIIIGAGYIGIEIAEAALKLGKNVRIFQHSARILNKTFDKEITDLLENHIREHEKISLHLNESPVEVRTFEDKVIGLKTDKKEYVANLIIVATGVKPNTEFLKDTGIELFKNGAIIINRFGETNIPNVYAAGDCATVYHSVLEKNVYIALATTANKLGRLIGENLTGTNKVFIGTLGSAGIKVLEFEAARTGITEQEAKDNNINYKTIFVDGEDHSAYYPGGEDVYIKLIYNADTKILLGAQLAGKRGAALRTDSLAVAIQNKMTVQELANMDFLYAPPFATTWDIMNVAGNVAK

SEQ ID NO: 14508 - protein, 448 aa, Fusobacterium nucleatum subsp. nucleatum ATCC 25586
MNIKEFLFEDKKLIKRIFKIAIPSLFDLLAQTLISTSDMIMVSSIGASAISSVGVGSAAFNAIIPALIAVAIGTTAILSRTYGAKNREEGQKALMQSYFIAIPIGIILMLSFFFFAKPIIEIVGNAKDLNLEDAIIYQKTTAIGFVFLSIGITTFYAFRALGKNKIPMIGNTMVLIVNIIFNYLFIYILKWGVFGAALATSIARGSVVIMCIYLIFVNKRQWISLNIKKMKFDYFIAKRIIKVGIPAAIEQLALRFGMLIFEIMVISLGNLNYAAHKIALTAESFSFNLGFAVSLAATALVGQELGKNSPKNALKNGYICTIIGLIIMSTMGLLFFIAPNLLISLFTDDPQVVSLSTMALRLVSICQPFLAISMILSGALRGAGATRSVLFITFFGIFLVRIPITYVFLYIFNMGLAGAWIVMTIDLIFRSSLCFYTFKKGKWKYLKV

SEQ ID NO: 14509 - protein, 316 aa, Fusobacterium nucleatum subsp. nucleatum ATCC 25586
MRIKFDRRIFMLANSVIDLIGNTPLVKINNIDTFGNEIYVKLEGSNPGRSTKDRIALKMIEEAEKEGLIDKDTVIIEATSGNTGIGLAMICAVKNYKLKIVMPDTMSIERIQLMRAYGTEVILTDGSLGMKACLEKLEELKKNEKKYFVPNQFTNVNNPKAHYETTAEEILKDLNNKVDVFICGTGTGGSFSGTAKKLKEKLPNIKTFPVEPASSPLLSKGYIGPHKIQGMGMSIGGIPAVYDGSLADDILVCEDDDAFEMMRELSFKEGILGGISTGATFKAALDYSKENADKGLKIVVLSTDSGEKYLSNICDL

SEQ ID NO: 14510 - protein, 487 aa, Fusobacterium nucleatum subsp. nucleatum ATCC 25586
MNGKIVKEGITFDDVLLIPAKSDVLPNEVSLKTRLTKKITLNLPILSAAMDTVTESDLAIALARQGGMGFIHKNMSIEEQAAEVDRVKRSESGMITNPITLNKDSRVYQAEELMSRYKISGLPVIEDDGKLIGIITNRDIKYRKDLDQPVGDIMTSKGLITAPVGTTLEQAKEILLANRIEKLPITDQNGYLKGLITIKDIDNIIQYPNACKDELGKLRCGAAVGVAPDTIERVSALVKAGVDIITVDSAHGHSQGVINMIKEIKKNFPDLDIVGGNIVTAEAAKELIEAGVAAVKVGIGPGSICTTRVVAGVGVPQLTAVNDVYEYCKDKNIGVIADGGIKLSGDIVKALAAGGDCVMLGGLLAGTKEAPGEEIILEGRRFKIYVGMGSIAAMKRGSKDRYFQAGEVDNSKLVPEGIEGRIAYKGSVKDVVFQLAGGIKAGMGYCGTKTIKDLQINGRFVKITGAGLIESHPHDITITKEAPNYSK

SEQ ID NO: 14511 - protein, 448 aa, Fusobacterium nucleatum subsp. nucleatum ATCC 25586
MQEALRKFFNFEEYETNFKKEIIAGTTNFLTMAYILGVNTIILSSAGMDFNSVFLATAISSAIACFVMGLVANAPLGLAPGMGSNSFFTFIVVKLYGYSYQEALAMVFVSGTLFLLLSATGIRDKIINSIPENLKQSIGAGTGFFIALIGLVKAGIAVSHPATLITLGNFKNPTVLLAVFGLLLTIVLMSRKIDAAVFFGLLITAIVGIVLGKFGIEGMPKFSNEIIKVNTSLNHFGDFFYGIKSLIAKPKSIFLIFTFFFVDFFDTAGTLVAITNKISSKTGKNYKMKKMLFSDAVGTVVGAVLGTSTVTTLTESTSGVAAGGRTGLTAITTGIWFLIASIFTPLVAIASPIEIGGMFFEPVIAPSLICVGILMATQLSSIDWHDFTAASAGFVTIMIMIVGYSIPDGIAAGFIVYVFSKLFTKNVKDISPSVWAMFVLFVLHFALK

SEQ ID NO: 14512 - protein, 211 aa, Fusobacterium nucleatum subsp. nucleatum ATCC 25586
MINLNLVLFGAPGAGKGTQAKFIVDKYGIPQISTGDILRVAVANKTKLGLEAKKFMDAGQLVPDEIVNGLVAERLAEKDCEKGFIMDGFPRNVAQAKVLDEILTKLGKQIEKVIALNVPDKDIIERITGRRTSKVTGKIYHIKFNPPVDEKPEDLVQRADDTEEVVVKRLETYHNQTAPVLDYYKVQNKVTEIDGTKKLEDITQDIFKILG

SEQ ID NO: 14513 - protein, 224 aa, Fusobacterium nucleatum subsp. nucleatum ATCC 25586
MDNREVLLEVKNVSKIYGDLHALKEVNFQVRKGEWVAIMGSSGSGKSTIMNIIGCMDKPSIGEVILDGQDITKESQNSLTKIRREKIGLIFQQFHLIPYLTALENVMVAQYYHSIPDEEEALQALERVGLKDRAKHLPSQLSGGEQQRVCIARALINSPEIILADEPTGNLDEVNEKIVIEILKQLHKEGSTIVVVTHDLEVGDVAERKIILEYGKIIDIIDQK

SEQ ID NO: 14514 - protein, 251 aa, Fusobacterium nucleatum subsp. nucleatum ATCC 25586
MRRLVIAGNWKMYKNNKEAVETLTQLKDLTRDVKNVDIVIGAPFTCLSDAVKIVEGSNVKIAAENVYPKIEGAYTGEVSPKMLKDIGVTYVILGHSERREYFKESDEFINQKVKAVLEIGMKPILCIGEKLEDREGGKTLEVLAKQIKEGLVDLSKEDAEKTIVAYEPVWAIGTGKTATPEMAQETHKEIRNVLAEMFGKDVADKMIIQYGGSMKPENAKDLLSQEDIDGGLVGGASLKADSFFEIIKAGN

SEQ ID NO: 14515 - protein, 304 aa, Fusobacterium nucleatum subsp. nucleatum ATCC 25586
MKELLKELVEKNRKFTADGNVANYIPELDKADKNALGIYVTTLDGQEFFAGDYNTKFTIQSISKIISLMLAILDNGEEYVFSKVGMEPSGDPFNSIRKLETSSRKKPYNPMINAGAIAVASMIKGKDDREKFSRLLNFAKLITEDDSLDLNYKIYIGESDTGFRNYSMAYFLKGEGIIEGNVNEALTVYFKQCSIEGTAKTISTLGKFLANDGVLSNGERILTTRMAKIIKTLMVTCGMYDSSGEFAVRVGIPSKSGVGGGICSVVPGKMGIGVYGPSLDKKGNSLAGGHLLEDLSAELSLNIF

SEQ ID NO: 14516 - protein, 395 aa, Fusobacterium nucleatum subsp. nucleatum ATCC 25586
MEMKKSGLGTTAIHAGTLKNLYGTLAMPIYQTSTFIFDSAEQGGRRFALEEAGYIYTRLGNPTTTVLENKIAALEEGEAGIAMSSGMGAISSTLWTVLKAGDHVVTDKTLYGCTFALMNHGLTRFGVEVTFVDTSNLEEVKNAMKKNTRVVYLETPANPNLKIVDLEALSKIAHTNPNTLVIVDNTFATPYMQKPLKLGVDIVVHSATKYLNGHGDVIAGLVVTRQELADQIRFVGLKDMTGAVLGPQEAYYIIRGLKTFEIRMERHCKNARTIVDFLNKHPKVEKVYYPGLETHPGYEIAKKQMKDFGAMISFELKGGFEAGKTLLNNLKLCSLAVSLGDTETLIQHPASMTHSPYTKEEREVAGITDGLVRLSVGLENVEDIIADLEQGLEKI

SEQ ID NO: 14517 - protein, 311 aa, Bacillus coagulans
MDMLSAYSAVNQGHRHPKIIEALKNQADKVTLTSRAFHNELLGPWTKRMAKLTKKDKVLPMNTGVEAVETAIKAARRWAYQVKGVTENQAEIIAADGNFHGRTLNAISLSNDPDATKNYGPFVPGINKVSYGDINAIEKAITENTAAIILEPIQGEAGIIIPPEGYLKKVRELCSERNILFIADEVQTGFARTGKMFACEWENVEPDIYVMGKALGGGVFPISAIAANNEIMDVFTPGSHGSTFGGNPLACAVSMAAIDVIEEENLVNKSLESGKYFADKLRAINFEGIKEVRARGLFIGMEFHQPVRAIC

SEQ ID NO: 14518 - protein, 433 aa, Delftia acidovorans
MNWTERIFKLREHNTNVRTELVAGLTTFLSMAYIMFVNPSILGDAGMPKGSVFVATCLIAALGSTIMALYANYPIALAPGMGLNAYFAYVVVLKMGYTWEAALGAVFVSGCLFLICTMLGLRELIIKGIPQSIRVSITVGLGLILALIALKTAGVVAADQNTYVTLGDLHKPEVIMALLGFLLIVVLDRLKVPGALLIGILAVTVASFFFGGNTFHGIFSAPPSIEPTFMKLDIKTALTTGFLNVVLVFFLVELFDATGTLMGVARRAGLLVPERMGRFNRSLLADSGAIFVGSILGTSSTTAYVESAAGVQAGGRTGLTALTVAMLFLACLFIAPLAGVVPGYATAPALLFVACLMLRDLTEVQWDETTEAIPAVVTALMMPFTYSIANGLAFGFITYAVLKLFTGKVKEVHWIMWVIAALFLFKFIYVGGH

SEQ ID NO: 14519 - protein, 463 aa, Streptococcus pyogenes MGAS8232
MTIFRKKKKYSNKTEMQRHFKVIDLIFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPILAIIICLSFMSQYKAFTWIAFAIATIIGTLIYLAYGYTHSIENK

SEQ ID NO: 14520 - protein, 338 aa, Streptococcus pyogenes MGAS8232
MKAVVVNQASTGVEVVEHDLPNVGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGVAPGQWIVIFGAGGLGNLAVQYAKKVFNAHVVAVDINNDKLELAKEVGADILVNGKEIEDVPGYIQEKIGGAHGVVVTAVSKVAFNQAIDSVRAGGTVVAVGLPSEYMELSIVKTVLDGIKVVGSLVGTRKDLEEAFAFGAEGLVAPVVEKVPVDTAPEVFDEMERGLIQGRKVLDFIS

SEQ ID NO: 14521 - protein, 212 aa, Streptococcus pyogenes MGAS8232
MNLLIIGLPGAGKGTQAAKIVEEFGVAHISTGDMFRAAMANQTEMGRLAKSYIDKGELVPDEVTNGIVKERLAEDDIAEKGFLLDGYPRTIEQAHALDATLEELGLRLDGVINIKVDPSCLVERLSGRIINRKTGETFHKVFNPPVDYKEEDYYQREDDKPETVKRRLDVNMAQGEPILEHYRKLGLVTDIEGNQEITDVFADVEKALLELK

SEQ ID NO: 14522 - protein, 219 aa, Streptococcus pyogenes MGAS8232
MKENKRIAIAEAISHIKDGDTIMVGGFMANGTPEALIDALVDKGTKDLTLICNDAGFVDRGVGKMVANHQFKTIYATHIGLNKEAGRQMTAGETTIELIPQGTFAEKIRIGAYGIGGFYTPTGVGTLVAEGKETKTIKGKTYLLEYPFEADVALIFANKADEMGNLQYSGSENNFNQLMAACAKTTIVQAREIVPVGTIQPEYVHTPHIFVDYIVKEGV

SEQ ID NO: 14523 - protein, 449 aa, Streptococcus pyogenes MGAS8232
MSHITFDYSKVLESFAGQHEIDFLQGQVTEADKLLREGTGPGSDFLGWLDLPENYDKEEFARILTAAEKIKSDSEVLVVIGIGGSYLGAKAAIDFLNHHFANLQTAKERKAPQILYAGNSISSTYLADLVEYVQDKEFSVNVISKSGTTTEPAIAFRVFKELLVKKYGQEEANKRIYATTDKVKGAVKVEADANNWETFVVPDNVGGRFSVLTAVGLLPIAASGADITALMEGANAARKDLSSDKISENIAYQYAAVRNVLYRKGYITEILANYEPSLQYFGEWWKQLAGESEGKDQKGIYPTSANFSTDLHSLGQFIQEGYRNLFETVIRVDNPRKNVIIPELAEDLDGLGYLQGKDVDFVNKKATDGVLLAHTDGGVPNMFVTLPVQDEFTLGYTIYFFELAIAVSGYMNAVNPFDQPGVEAYKRNMFALLGKPGFEALSAELNARL

SEQ ID NO: 14524 - protein, 246 aa, Streptococcus pyogenes MGAS8232
MSNSIIEIKNLKKSYGSNEVLKDISLSVNKGEVISIIGSSGSGKSTLLRSINLLEEPSAGQILFHGEDVLAEHYNLTHYREKLGMVFQSFNLFENLNVLENAIVAQTTVLKRDRAQAEQIAKENLNAVGMTEQYWQAKPKQLSGGQKQRVAIARALSVNPEAMLFDEPTSALDPEMVGEVLKTMQDLAKSGLTMIIVTHEMEFARDVSDRIIFMDKGLIAEEGSPQQIFENPTQDRTKEFLQRFLK

SEQ ID NO: 14525 - protein, 236 aa, Streptococcus pyogenes MGAS8232
MNFIGELLGTFILVLLGDGVVSACILNKTKAQNSGWIAIVLGWGIAVTVAVYISGFMSGAHLNPAVTLAMAAIGSLPWSQVVTYLVAQFLGAMLGALVLYLHYYPHWNETKDAGTILACFSTGPAIRHTWSNLFGEALGTAVLVITVMAIGPNKVAAGFGPIIVGFVVMAVGFSLGATTGYAINPARDLGPRIMHALLPIPNKGDSDWSYAWIPVLGPILGGVAGALIYQAILNMM

SEQ ID NO: 14526 - protein, 474 aa, Streptococcus pyogenes MGAS8232
MGIFPKDFLWGGAVAANQVEGAFEADAKGLSVQDVLPNGGLGEWTDSPTSDNLTLEAIDFYHRYKEDIALFAEMGFKVFRTSIAWSRIFPNGDDDQPNEAGLQFYDDLFDELLNYGIEPLVTLSHYETPLHLAKAYNGWTDRRLIGFFERFAQTVMERYKGKVKYWLTFNEVNSILHMPFTSGGIMTEKEKLSLQDLYQAIHHELVASASVTKLAHEINPDVKVGCMILAMPAYPMTSDPRDILAAHAFENLNLLFSDIHVRGKYPSYIKSYFKENGIEIVFEDGDKELLAEHTVDFLSFSYYMSVTQAHNPEAYTSGQGNILGGLSNPYLESSEWGWQIDPIGLRLVLNQYYDRYQIPLFIVENGLGAKDQLVQTADGSMTVHDDYRIDYMSQHLVQVAKAIEDGVEVMGYTAWGCIDCVSMSTAQLSKRYGFIYVERNDDGTGQLTRYKKKSFDWYRQVIQTNGRYLEDNFS

SEQ ID NO: 14527 - protein, 167 aa, Streptococcus pyogenes MGAS8232
MPNLYDFTVKAQNGNDLSLAAYKEKVVLIVNTATKCGLTPQYQALQALYDTYHDKGFEVLDFPCNQFLNQAPGDAEEINHFCSLTYHTTFPRFAKIKVNGKDADPLFTWLKEEKSGPLGKRIEWNFTKFLIDQNGQVIKRYSSKTDPKLIEEDLKALLDKIQCYHHL

SEQ ID NO: 14528 - protein, 252 aa, Streptococcus pyogenes MGAS8232
MSRKPIIAGNWKMNKNPQEAKAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIICCGESLETYEAGKAAEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEADSFLALLDFLN

SEQ ID NO: 14529 - protein, 450 aa, Streptococcus pyogenes MGAS8232
MVIPYDYIVIGGGSAGIASANRAAMHGAKVLLAEGKEIGGTCVNLGCVPKKVMWYGAQVADILGTYAKDYGFDFKEKAFDFKQLKANRQAYIDRIHASYERSFEQNGVDRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKAIVDVLVEEMTVGGPCLHPHSEVAKVVKNTDESLTLYLKDGQEVEVDQLIWAIGRKPNLEGFGLDKTGVTLNDKGYIETDAYENTSVKGIYAVGDVNGKLALTPVAVAAGRRLSERLFNNKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGATKADFDNTVAIHPTGSEEFVTMR

SEQ ID NO: 14530 - protein, 384 aa, Streptococcus pyogenes MGAS8232
MTKPIITFNNVSKTFEDSGTQVLKNINFDLEEGKFYTLLGASGSGKSTILNIMAGLLDASSGDIYLDGERINDLPINKRDIHTVFQNYALFPHMTVFENVAFALKLKKVDKKEIAKRVKETLKMVQLEGFENRSIQKLSGGQRQRVAIARAIINQPRVVLLDEPLSALDLKLRTEMQYELRELQQRLGITFVFVTHDQEEALAMSDWIFVMNEGEIVQSGTPVDIYDEPINHFVANFIGESNIINGTMIEDYLVSFNGKEFESVDGGMRPNEPVEVVIRPEDLQITLPEEGKLQVKVDTQLFRGVHYEIIAYDELGNEWMIHSTRKAIEGEVIGLDFTPEDLHIMRLNETEEEFDARIEEYVEMDEPEDGLINAIEEERNEENL

SEQ ID NO: 14531 - protein, 242 aa, Streptococcus pyogenes MGAS8232
MIRFNNVSKTFGQTKVLQEQTFQINDREFFVLVGPSGSGKTTLLKMINCLIEPSSGDILLNNVPQKELDLREMRLSIGYVLQQIALFPNLTVAENIAIIPEMKQWSAEEIRQKTEELLDKVGLPAKDYLDRYPSDLSGGEQQRIGIVRAIISHPKILLMDEPFSALDPISRKQLQELMLSLHKEFDMTIVFVTHDIDEAIKLGDRVAILNEGEIVQLDRPEMIKTHPANAFVVNLFGGDEHA

SEQ ID NO: 14532 - protein, 327 aa, Streptococcus pyogenes MGAS8232
MFNEIPVFDYEDIQLIPNKCIITSRSQADTSVTLGKYQFKLPVIPANMQTIIDETIAEQLAKEGYFYIMHRFDEDSRKPFIKRMHEQGLIASISVGVKAYEYEFVTSLKEDTPEFITIDIAHGHANSVIDMIKHIKTELPETFVIAGNVGTPEAVRELENAGADATKVGIGPGKVCITKVKTGFGTGGWQLAALRWCAKAARKPIIADGGIRTHGDIAKSIRFGASMVMIGSLFAGHIESPGKTVEVNGETFKEYYGSASAYQKGEHKNVEGKKILLPTKGHLSDTLTEMQQDLQSSISYAGGKDLDSLRHVDYVIVKNSIWNGDSI

SEQ ID NO: 14533 - protein, 456 aa, Streptococcus pyogenes MGAS8232
MSKIVVVGANHAGTACIKTMLTNYGDANEIVVFDQNSNISFLGCGMALWIGEQIAGPEGLFYSDKEELESLGAKVYMESPVQSIDYDAKTVTALVDGKNHVETYDKLIFATGSQPILPPIKGAEIKEGSLEFEATLENLQFVKLYQNSADVIAKLENKDIKRVAVVGAGYIGVELAEAFQRKGKEVVLIDVVDTCLAGYYDRDLTDLMAKNMEEHGIQLAFGETVKEVAGNGKVEKIITDKNEYDVDMVILAVGFRPNTTLGNGKIELFRNGAFLVNKRQETSIPGVYAIGDCATIYDNATRDTNYIALASNAVRTGIVAAHNACGTDLEGIGVQGSNGISIYGLHMVSTGLTLEKAKRLGFDAAVTEYTDNQKPEFIEHGNFPVTIKIVYDKDSRRILGAQMAAREDMSMGIHMFSLAIQEGVTIEKLALTDIFFLPHFNKPYNYITMAALGAKD

SEQ ID NO: 14534 - protein, 399 aa, Streptococcus pyogenes MGAS8232
MKERFSPLFEPLTLPNGSQLDNRFVLSPMVTNSSTKDGYVTQDDVSYALRRAASAPLQITGAAYVDPYGQLFEYGFSVTKDADISGLKELAQAMKAKGAKAVLQLTHAGRFASYALTKYGFVYGPSYMQLRSPQPHEVKPLTGQQIEELIAAYAQATRRAIQAGFDGVEVSSAQRLLIQTFFSTFSNKRTDSYGCQTLFNRSKLTLAVLQAVQQVIKQEAPDGFIFGFRATPEETRGNDIGYSIDEFLQLMDWVLNIAKLDYLAIASWGRHVFRNTVRSPGPYYGRRVNQVVRDYLRNKLPVMATGGMNTPDKAIEALAHADFIGVSTPFVVDPEFAHKIKEGCEESIHLRIRPADLKSLAIPQASFKDIVPLMDYGESLPKESRTLFRSLTHNYKEIK

SEQ ID NO: 14535 - protein, 500 aa, Streptococcus pyogenes MGAS8232
MNKRVKIVATLGPAVEIRGGKKYGEDGYWAGQLDVEESAKKIAELIEAGANVFRFNFSHGDHKEQGDRMATVRLAEEIARQKVGFLLDTKGPEMRTELFADDAKEFSYVTGEKIRVATTQGIQSTRDVIALNVAGSLDIYDEVEVGHTILIDDGKLGLKVIDKDIATRQFIVEVENDGIIAKQKGVNIPNTKIPFPALAERDNADIRFGLEQGLNFIAISFVRTAKDVEEVREICRETGNDHVQLFAKIENQQGIDNLDEIIEAADGIMIARGDMGIEVPFEMVPVFQKMIITKVNAAGKAVITATNMLETMTEKPRATRSEVSDVFNAVIDGTDATMLSGESANGKYPVESVRTMATIDRNAQTLLNEYGRLDSSAFPRTNKTDVIASAVKDATHSMDIKLVVTITETGNTARAISKFRPDADILAVTFDEKVQRALMINWGVIPVLAEKPASTDDMFEVAERVAVEAGLVQSGDNIVIVAGVPVGTGGTNTMRVRTVK

SEQ ID NO: 14536 - protein, 466 aa, Streptococcus pyogenes MGAS8232
MKQRKHRYQFPDGFLWGSSTSGPQSEGTVPGDGKGPSNWDYWFSIESAKFHHQIGPEKTSTFYENYKGDIALLKETGHTIFRTSIQWSRLIPEGVGEVNPKAVTFYREVFQDIIAQGIKLIVNFYHFDLPYALQEKGGWENKATVWAYETYAKTCFELFGDLVNTWITFNEPIVPVECGYLGYYHYPCKVDAKAAVQVAYNTQLASSLAVKACHELHSDHKISIVLNMTPAYPRSDAPEDVKAARIAELFQTKSFLDPSVLGVYPAELVSILEEADLLPQYSADELEIIKNNTVDFLGVNYYQPLRVQAPSKSQQEGDPLILDIYFEPYDMPGKKVNPHRGWEIYEPGLYDIALNLKEHYGNIEWLVTENGMGVEGEEAFLADGQIQDDYRITFIEDHLIQLHKALGEGANCKGYLLWTFIDCWSWLNAYKNRYGLVALDLESQKRTIKKSGYWFKALSESNGFDK

SEQ ID NO: 14537 - protein, 406 aa, Streptococcus pyogenes MGAS8232
MSTLSLDTTNKRALVAAIAASGTNDLNVMFLAFSMSSIMTDLGLSGTQGGWIATITNLGMLVGGLLFGLLADRHHKFKVFKWTILLFSVATGLIYFTQSLPYLYLMRFIAGIGVGGEYGVAIAIMAGIVPPERMGRMSSLNGIAGQLGSISSALLAGWLAPSLGWRGLFLFGLLPILLVIWMTLAIDDQKIWDHYGQEEEECSQPIKINELFKTKSLTAQTLALMVMTTVQIAGYFGMMNWLPTIIQTSLNLSVKSSSLWMVATIVGMCLGMLCFGQLLDCFGPRLIYSLFLLASSICVYLFQFANSMASMVIGGAIVGFFVNGMFAGYGAMITRLYPHHIRSTANNVILNVGRALGGFSSVAIGSILDASGISMVMIFLASLYVISFGAMWTIGQLKAERYQQLR

SEQ ID NO: 14538 - protein, 475 aa, Streptococcus pyogenes MGAS8232
MAKQYKNLVNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVNFINFTGSTPIGEGIGKLAGMRPIMLELGGKDSAIVLEDADLALAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAVKISNESEYGLQASIFTTNFPKAFGIAEQLEVGTVHLNNKTQRGTDNFPFLGAKKSGAGVQGVKYSIEAMTTVKSVVFDIQ

SEQ ID NO: 14539 - protein, 244 aa, Streptococcus pyogenes MGAS8232
MTEAIISIKDLHKYYGHNEVLKGINLDIMPGEVVVIIGPSGSGKSTLLRTMNLLEVPTKGQIRFEGIDITDKKNDIFSMREKMGMVFQQFNLFPNMTILENITLSPIKTKGMAKAEADKTALSLLDKVGLSEKTKAYPASLSGGQQQRIAIARGLAMDPDVLLFDEPTSALDPEMVGEVLAVMQDLAKSGMTMVIVTHEMGFAKEVADRVMFMDGGVIVEEGSPNQLFDLTKEERTKDFLSRVL

SEQ ID NO: 14540 - protein, 480 aa, Streptococcus pyogenes MGAS8232
MLAFPKEFWWGGATSGPQSEGRFAKQHRNLFDYWYEEEPDLFYDYVGPDTASDAYHQIESDLALLASLGHNSYRTSIQWTRLIDDFEQATINPDGLAYYNRVINACLANGIRPVINLHHFDLPIALYQAYGGWESKHVVDIFVAFSKVCFEQFGDRVKDWFVHNEPMVVVEGSYLMQFHYPAIVDGKKAVQVAYNLALATAKVIQAYRRGPAELSNGRIGTILNLTPAYPASQSEADMAAAHFTELWNNDLFMEAAVHGKFPEELVAVLKKDGVLWQSTPEELALIAENRVDYLGLNFYHPKRVKAPDVIPVISPSWSPEWYYDPYLMPGRRMNVDKGWEIYPEAVYDIAIKMRDHYDNIPWFLSENGVGISGEDRYRDETGQIQDDYRIQFLKEHLTYLHKGIEAGSNCFGYHVWTPIDGWSWLNAYKNRYGLVENNIHTQVRRPKASAYWFKKVATHNCLISLEVMEEFGGSASHLSD

SEQ ID NO: 14541 - protein, 313 aa, Streptococcus pyogenes MGAS8232
MTKIYKTITELVGQTPIIKLNRLIPNEAADVYVKLEAFNPGSSVKDRIALSMIEAAEAKGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKASPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 14542 - protein, 216 aa, Streptococcus pyogenes MGAS8232
MCKEITIKEAVAHVKDGDTIMVGGFMTNGTPEKLIDALVEKGVKDLTLICNDAGFPDKGVGKMVANKQFSTIIASHIGLNREAGRQMTEGETVIDLVPQGTLAERIRSGGFGLGGFLTPTGIGTEVAKGKEVITIDGKDYLLETPLKADVALIFANKADKNGNLQYAGSENNFNHVMAANAKTTIVEAREIVDVGQMDPNFVHTPGIFVNYLVKGA

SEQ ID NO: 14543 - protein, 486 aa, Streptococcus pyogenes MGAS8232
MYKDDSLTLHTDLYQINMMQVYFEQGIHNRHAVFEVYFRKEPFNNGYAVFAGLQRMVEYLEQFQFSETDLAYLEELGYPENFLTYLKELRLELTIRSAKEGDLVFANEPIVQVEGPLGQCQLVETALLNIVNFQTLIATKAARIRSVIEDEPLLEFGTRRAQELDAAIWGTRAAMIGGADATSNVRAGKRFGIPVSGTHAHALVQAYGNDYDAFMAYAKTHKDCVFLVDTYDTLKVGVPTAIRVAKEMGDKINFLGVRLDSGDLAYLSKTVRQQLDDAGFTEAKIYASNDLDENTILNLKMQKAKIDVWGVGTKLITAYDQPALGAVYKIVSIEQEDGSMRDTIKLSNNAEKVSTPGKKQVWRITSREKGKSEGDYITFTDINVNELTEIEMFHPTYTYIKKTVRNFDAIPLLVDIFVKGELVYQLPTLAEIKAYAKKEFDKLWDEYKRVLNPQDYPVDLARDVWQNKMALIDNIRKDAYGKSDLK

SEQ ID NO: 14544 - protein, 247 aa, Streptococcus pyogenes MGAS8232
MITIRNLSKTFSGQKVLDSLALDIEKGQVIALVGASGAGKSTFLRSLNYLEKPDSGSISIGDFTVDFETITTEQVLILRRKLAMVFQQFNLFERRTALENVKEGLKVVKKLSDQEATKLAQAELAKVGLADRKHHYPRHLSGGQKQRVALARALAMKPDVLLLDEPTSALDPELVGEVEKSITDAAKSGQTMVLVSHDMNFVYQVADRVLFLDQGKILEQGTPEEVFRHPQKERTKEFFASYSKTYI

SEQ ID NO: 14545 - protein, 486 aa, Streptococcus pyogenes MGAS8232
MEKFFKLSENGTTVSTEIMAGLTTFFAMSYILFVNPSILGAAGMPSNAVFLATIIAAAISTLIMGLFANVPYALAPGMGLNAFFTYTVVFALGFSWQEALAMVFICGLFNIFITVTKFRKSIIKAIPVSLQHAIGGGIGVFLAYLGFKNANIITFSISAENIVMVNGVEPAKASAKTFADGLLFVDANGGVVPTISSFTDSSVLLAIFGLLLTTALVIRNFRGAILIGIVATTLVGIPLGIVDVSNLNFGIGHIGEAWTELGTTFLAAFDGLSSLFSDSSRLPLVFMTIFAFSLSDTFDTIGTFIGTGRRTGIFSQDDENALENSIGFSSKMDRALFADAIGTSIGALVGTSNTTTYVESAAGIAEGGRTGLTAVSTAVCFLLSILLLPLVGIVPAAATAPALIVVGVMMVSSFLDVNWSKFADALPAFFAAFFMALCYSISYGIAAAFIFYCLVKVVEGKTKDIHPIIWGATFLFIVNFIILTIL

SEQ ID NO: 14546 - protein, 378 aa, Streptococcus pyogenes MGAS8232
MNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYSLDISFTQAALGDTVEIPTVHGDVEMAIPAGTQTGKTFRLKGKGAPKLRGGGQGDQHVTVNIVTPTKLNDAQREALQAFAEASGDKMLHPKKKGFFDKVKDALEDI

SEQ ID NO: 14547 - protein, 404 aa, Streptococcus pyogenes MGAS8232
MKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISMSLQALLDNGDEVLVPMPDYPLWTACVSLGGGKAVHYLCDEEAGWYPDIADIKSKITSRTKAIVVINPNNPTGALYLKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 14548 - protein, 398 aa, Streptococcus pyogenes MGAS8232
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGSKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSKGFLGLDIGPKSIAEFDQALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 14549 - protein, 468 aa, Streptococcus pyogenes MGAS8232
MTKTLPKDFIFGGATAAYQAEGATHTDGKGPVAWDKYLEDNYWYTAEPASDFYNRYPVDLKLSEEFGVNGIRISIAWSRIFPTGKGDVNPKGVEYYHNLFAECHKRHVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDGGYSGEIGVVHALPTKYPFDANNPDDVRAAELEDIIHNKFILDATYLGKYSDKTMEGVNHILEVNGGELDLREEDFVALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDDGRIDYVKKHLEVISDAISDGANVKGYFMWSLMDVFSWSNGYEKRYGLFYVDFETQERYPKKSAYWYKKVAETQVIE

SEQ ID NO: 14550 - protein, 1165 aa, Streptococcus pyogenes MGAS8232
MKKKVNQGSKRYQYLLKKWGIGFVIAATGTVMLGCTPSILTHQVAAKTIVGLARDEAQQGDGNAKSGDGFQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPKMNEVWIDENYHAHAYRPLKKGYLRINYHNQSGHYDNLAVWTFKEVKTPTTDWPNGLDLSHKGPYGAYVDVPLKEGANEIGFLILDKSKTGDAIKVQPKDYLFKELDNHTQVFVKDTDLKVYNNPYYIDQVSLKGAEQTTPNEIKAIFTTLDGLDEDAVKQNIKITDKAGKTVAIDELTLDKDKSVMTLKGDFKAQGAVYTVTFGEVSQVARQSWQLKDKLYAYDGELGATLAKDGSVDLALWSPSADTVKVVVYDKQDQTKVLGQADLTKSDKGVWRAHLTSDSIKGISDYTGYYYLYEITRGQEKVMVLDPYAKSLAAWNDATATDVIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYKSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSIAYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPSNFEADAPGDVVQYIAAHDNLTLHDVIAKSINKDPKVAEEEIHKRIRLGNTMILTAQGTAFIHSGQEYGRTKQLLNPDYKTKVSDDKVPNKATLIDAVAKYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLADAEQAGVTAIAKPKGVQFTKEGLTIDGLTALVLKVSSKTANPSQQKSQIGNHQTKTPDGSKDLDKSLMTRPKRAKTNQKLPKTGEASSKGLLAAGVALLLLAISLLMKRQKD

SEQ ID NO: 14551 - protein, 328 aa, Streptococcus pyogenes MGAS8232
MLEDYYPSTTSYYHGGIDDDLYTAKWGMVMTFLDLNDSSLTPFEGTHFALIGFKSDKGVYINNGRVGAVESPAAIRTQLAKFPWHLGNQVMVYDVGNIDGPNRSLEQLQNSLSKAIKRMCDLNLKPIVLGGGHETAYGHYLGLRQSLSPSDDLAVINMDAHFDLRPYDQTGPNSGTGFRQMFDDAVADKRLFKYFVLGIQEHNNNLFLFDFVAKSKGIQFLTGQDIYQMGHQKVCRAIDRFLEGQERVYLTIDMDCFSVGAAPGVSAIQSLGVDPNLAVLVLQHIAASRKLVGFDVVEVSPPHDIDNHTANLAATFIFYLVQIMAQHS

SEQ ID NO: 14552 - protein, 336 aa, Sinorhizobium fredii
MLHTTVTQLIGQTPVMSIDVPGRNATLVLKIEKNNPGGSMKDRMARSMVIAALEDGRLAPGGTIVESSSGNTGTGLALAALEFGLRFIAVVDHHAAPDKIRMMRALGAEIRYVEGDFREDEVAVVERQRLAAQLGAQLPGALFMNQSDNPANPAGYTGLVDELVAQLPDGIDAFVGCVGTGGSMTGISQRVKRNNPAVRTIAVEPAGSIVFGKPGHPYYQSGTGTPAGDEVGKVLDYGCIDEGVQVTDTQAFETARYIARRKGLLVGGSTGGAIYKALEFIGAGKLTGTVVTTVADGGEKYLGTIFDEEWMAKRRLLDPAIAAQLDGWLFGKARAA

SEQ ID NO: 14553 - protein, 276 aa, Nicotiana sylvestris
MATNGCLISLPPFFTTTKSISSYPFLSTQLKPISLSSSLPTLLSLNKRTTQFPTFVSVLSEDDNTLVLDDQEQGGDFPSFVGEAGETEEYQEPSEDAKLFVGNLPYDIDSEGLAQLFQQAGVVEIAEVIYNRETDRSRGFGFVTMSTVEEADKAVELYSQYDLNGRLLTVNKAAPRGSRPERAPRTFQPTYRIYVGNIPWDIDDARLEQVFSEHGKVVSARVVFDRESGRSRGFGFVTMSSEAEMSEAIANLDGQTLDGRTIRVNAAEERPRRNTY

SEQ ID NO: 14554 - protein, 307 aa, Nicotiana tabacum
MAKEGTKVPRIKLGSQGLEVSAQGLGCMGMSAFYGPPKPEPDMIQLIHHAINSGITLLDTSDVYGPHTNEILLGKALKGGTRERVVLATKFGIVLGDEKKAEGKRAVHGDPAYVRAACEASLKRLDIDCIDLYYQHRVDTRVPIEITVGELKKLVEEGKLKYIGLSEASASTIRRAHAVHPITAVQLEWSLWSRDVEEEIIPTCRELGIGIVAYSPLGRGFLSSGPKLLEDMSNEDYRKYLPRFQAENLENNKNLYERICEMAVRKGCTPSQLALAWVHHQGNDVCPIPGTTKIENLNQNMKPCPSS

SEQ ID NO: 14555 - protein, 407 aa, Lolium perenne
MAEGLPALGWAARDASGHLSPYSFSRSVPKDDDVTIKVLFCGICHTDLHIIKNDWGNALYPIVPGHEIVGVVASVGSGVSSFKAGDTVGVGYFLDSCRTCYSCSKGYENFCPTLTLTSNGVDGGGATTQGGFSDVLVVNKDYVIRVPDNLPLAGAAPLLCAGVTVYSPMVEYGLNAPGKHLGVVGLGGLGHVAVKFGKAFGMTVTVISSSDRKRDEALGRLGADAFLVSSDPEQMKAAAGTMDGIIDTVSAGHPIVPLLDLLKPMGQMVVVGAPSKPLELPAFAIIGGGKRLAGSGTGSVAHCQAMLDFAGKHGITADVEVVKMDYGQHRHRAAREERRQVPLRHRRRRQPPAGHRRLTCATQCGRALVWSRKRFAGSQPHEQVNESLVCCLSSFHIWDAVPDFHVK

SEQ ID NO: 14556 - protein, 370 aa, Lolium perenne
MAPTAAEQTEHHQHTRKAVGLAARDDAGHLSPLAITRRSTGDDDVVIKILYCGICHSDLHALKNDWKNSRYPMIPGHEIAGEVTEVGKNVSKFKAGDRVGVGCMVNSCRSCESCDKGFENHCPGMILTYNSVDVDGTVTYGGYSSMVVVHERFVVRFPDAMPLDKGAPLLCAGITVYSPMKYHGLNVPGLHLGVLGLGGLGHVAVKFGKAFGMKVTVISSSPGKKEEALGRLGADAFIVSKDADEMKAVMSTMDGIINTVSANIPLTPLFGLLKPNGKMIMVGLPEKPIEIPPFALVATNKTLAGSIIGGMSDTQEMLDLAAKHGVTADIEVVGAEYVNTALERLAKNDVRYRFVIDIGNTLDNVAATTE

SEQ ID NO: 14557 - protein, 150 aa, Clarkia delicata
KGEVVNNHDELMSNFFAQPDALAYGKTPEQLKKENVSEHLIPHKTFTGNRPSLSILLPTLDAYRIGQLLGIYEHRVAVQGFVWGINSFDQWGVELGKSLATQVRKQLHASRVKGEPVEEGFNFSTKTLLTRYLQATSDVPADPSTLLPNI

SEQ ID NO: 14558 - protein, 429 aa, Clarkia delicata
AAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQG

SEQ ID NO: 14559 - protein, 39 aa, Clarkia epilobioides
PHKTFTGNRPSLSILLPTLDAYRIGQLLGIYEHRVAVQG

SEQ ID NO: 14560 - protein, 307 aa, Clarkia epilobioides
  misc_feature (77)..(87): Xaa can be any naturally occurring amino acid
AAHLKQKIDRMNNGDHINSTENRSVLHVALRAPRNSVICSDGKNVVPDVWNVLDKIKDFSERVRNGSWVGATGKELXXXXXXXXXXXFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFES

SEQ ID NO: 14561 - protein, 502 aa, Zea mays
MATANGSSKGPFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 14562 - protein, 503 aa, Zea mays
MATANGSSKGSFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDNKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 14563 - protein, 466 aa, Zea mays
KTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 14564 - protein, 511 aa, Zea mays
MASNGCNGNGNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 14565 - protein, 170 aa, Zea mays
MPRSRINGNFIDKTFSIVANILLQIIPTTSGEKRAFTYYRDGMLAQSEGNYAEALQNYYEAMRLEIDPYDRSYILYNIGLIHTSNGEHTKALEYYFRALERNPFLPQAFNNMAVICHYRGEQAILQGDSEIAEAWFDQAAEYWKQAIALTPGNYIEAQNWLKITKRFEFE

SEQ ID NO: 14566 - protein, 478 aa, Nicotiana tabacum
MAAVNGVGISWPSKLTQGQRPKLVFSPSPRRCTPSSSTIKMTASVDEKKKTFTLQKSEEAFSKAKELMPGGVNSPVRAFKSVGGQPIIIDSVKGSRMRDIDGNEYIDYVGSWGPAIIGHADDEVLAALAETMKKGTSFGAPCLLENTLAEMVISAVPSIEMVRFVNSGTEACMGVLRLARAFTGRPKIIKFEGCYHGHADPFLVKAGSGVATLGLPDSPGGPKAATSDTLTAPYNDISAVESLFEEHKGEVAAIILEPVVGNAGFIQPNLDFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGPGTYEYLDKITGELTQGILDAGKKTGHAMCGGYIRGMFGFLFAEGPVNNFSDAKKSDTEKFGRFYRGMLEEGVYFAPSQFEAGFTSLAHTSEDIQKTVAAAEKVLKQI

SEQ ID NO: 14567 - protein, 478 aa, Nicotiana tabacum
MAAVNGVGISWPSKLTQSQRPKLVFSPSPRRCTPSSSTIKMTASVDEKKKTFTLQKSEEAFSKAKELMPGGVNSPVRAFKSVGGQPIIIDSVKGSRMRDIDGNDYIDYVGSWGPAIIGHADDEVLAALAETMKKGTSFGAPCLLENTLAEMVISAVPSIEMVRFVNSGTEACMGVLRLARAFTGRPKIIKFEGCYHGHADPFLVKAGSGVATLGLPDSPGVPKAATTDTLTAPYNDISAVESLFKEHKGEVAAIILEPVVGNAGFIQPNPDFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGPGTYDYLDKITGELTQGILDAGKKTGHAMCGGYIRGMFGFFFVEGPVNNFSDAKKSDTEKFGRFYRGMLEEGVYFAPSQFEAGFTSLAHTSEDIQRTVAAAEKVLKQI

SEQ ID NO: 14568 - protein, 507 aa, Oryza sativa
MAAVAGTGVFAEILEGEVYRYYADGEWRVSASGKSVAIVNPTTRLTQYRVQACTQEEVNKVMETAKVAQKAWARTPLWKRAELLHKAAAILKEHKTPIAECLVKEIAKPAKDAISEVVRSGDLVSYTAEEGVRILGEGKLLVSDSFPGNERNKYCLSSKVPLGVVLAIPPFNYPVNLAVSKIGPALIAGNALVLKPPTQGAVAALHMVHCFHLAGFPKGLINCVTGKGSEIGDFLTMHPGVNCISFTGGDTGIAISKKAGMVPLQMELGGKDACVVLEDADLDLVAANIVKGGFSYSGQKCTAVKVVLIMESVADIVVEKVKAKLAKLTVGPPEADSDITPVVTESSANFIEGLVMDAKEKGATFCKEKGATFCQEYRREGNLIWPLLLDHVRPDMRIAWEEPFGPVLPVIRINSVEEGIHHCNASNFGLQGCVFTKDINKAIMISDAMETGTVQINSAPARGPDHFPFQGLKDSGIGSQGITNSINMMTKVKSTVINLPSPSYTMG

SEQ ID NO: 14569 - protein, 220 aa, Saccharomyces cerevisiae
MDKHTAAIPTLTIKVVLLGESAVGKSSIVLRFVSDDFKESKEPTIGAAFLTKRITRDGKVIKFEIWDTAGQERFAPLAPMYYRNAQAALVVFDVSNEGSFYKAQNWVEELHEKVGHDIVIALVGNKMDLLNNDDENENRAMEAPAVQNLCDRENLLYFEASAKTGENIYQIFQTLGEKVPCPEQNTRQSSTHDRTITDNQRIDLESTTVESTRETGGCNC

SEQ ID NO: 14570 - protein, 292 aa, Streptomyces venezuelae
MRHTRLRDLEVSRIGLGTMGMSFGYTGSGSDDAGSVRALHRALDLGVTFLDTAEIYGPYTNERLVGRALGARRDQVVLATKFGLVSHAGGGPGQLDSSPANVRTAVEGSLRRLGTDHIDLCYQHRVDTVGALAELVAEGKIRHIGLSEAGPATIRRAHAVHPVTAVQSEYSLWTRDPEEAVLPVLRELGIGFVAYSPLGHGFLTGTVRAAGRFTPRTSGRTTPASPRRTCPGHLRIADEIAAVAAEADATPAQVALAWLLTRARPAESEHPWPRGELRQGCGGHIPHPGGVP

SEQ ID NO: 14571 - protein, 503 aa, Tropaeolum majus
MSGTKATSVSVPLPDFKQSVNLKYVKLGYHYSITHAMYLFLTPLLLIMSAQISTFSIQDFHHLYNHLILHNLSSLILCIALLLFVLTLYFLTRPTPVYLLNFSCYKPDAIHKCDRRRFMDTIRGMGTYTEENIEFQRKVLERSGIGESSYLPPTVFKIPPRVYDAEERAEAEMLMFGAVDGLFEKISVKPNQIGVLVVNCGLFNPIPSLSSMIVNRYKMRGNVFSYNLGGMGCSAGVISIDLAKDLLQVRPNSYALVVSLECISKNLYLGEQRSMLVSNCLFRMGGAAILLSNKMSDRWRSKYRLVHTVRTHKGTEDNCFSCVTRKEDSDGKIGISLSKNLMAVAGDALKTNITTLGPLVLPMSEQLLFFATLVGKKVFKMKLQPYIPDFKLAFEHFCIHAGGRAVLDELEKNLKLSSWHMEPSRMSLYRFGNTSSSSLWYELAYSEAKGRIKKGDRVWQIAFGSGFKCNSAVWKALRNVNPAEEKNPWMDEIHLFPVEVPLN

SEQ ID NO: 14572 - protein, 195 aa, Amylomyces rouxii
MAEIRRKLVIVGDGACGKTCLLIVFSKGTFPEFYVPTVFENYVADVEVDGKHVELALWDTAGQEDYDRLRPLSYPDSHVILICFAVDSPDSLENVQEKWISEVLHFCQGLPIVLVGCKKDLRNDPGTIEELRRNSQKPVSSEEGASIAQRISAYKYLECSAKTGEGVREVFEHATRAALMVSKKKKSKSGVCNLL

SEQ ID NO: 14573 - protein, 512 aa, Torenia hybrida
MSPLALMILSTLLGFLLYHSLRLLLFSGQGRRLLPPGPRPWPLVGNLPHLGPKPHASMAELARAYGPLMHLKMGFVHVVVASSASAAEQCLRVHDANFLSRPPNSGAKHVAYNYEDLVFRPYGPKWRLLRKICAQHIFSVKAMDDFRRVREEEVAILSRALAGKRAVPIGQMLNVCATNALSRVMMGRRVVGHADGTNDAKAEEFKAMVVELMVLSGVFNISDFIPFLEPLDLQGVASKMKKLHARFDAFLTEIVRERCHGQINNGGAHQDDLLSTLISFKGLDDGDGSRLTDTEIKALLLNLFAAGTDTTSSTVEWAVAELLRHPKTLAQVRQELDSVVGKNRLVSETDLNQLPYLQAVVKETFRLHPPTPLSLPRLAEDDCEIDGYLIPKGSTLLVNVWAIARDPKVWADPLEFRPERFLTGGEKADVDVKGNDFELIPFGAGRRICAGVGLGIRMVQLLTASLIHAFDLDLANGLLPQNLNMEEAYGLTLQRAEPLLVHPRLRLATHVY

SEQ ID NO: 14574 - protein, 431 aa, Glycine max
MVLSWSRRNVFRRAKKEKSQTQLEVEVVIPNHFHCPVSLELMTDPVTLSTGITYDRVSIEKWIEGGNRTCPVTNQVLTTFDIIPNHAIRRMIQDWCVENSSYGIDRIPTPRIPISAYEVSDTCTRILSACQRGDDKRCQELVGKIKVWSRESERNKRCIVGAGAGAVLAYAFDCFSSNSIEKHVVLLEEVLEVMTWMVPLGEEGVSKLSSGASLNSLVWFLEGKDLASRQSAALLLKEVCVQELAKVGEVVEALVKMVREPIGSTSTKACLATIFNLVSLAANREGIAQRFVELGLVSLLLEAIVDGEKGVCEKALGVLDCICDCEKGKEVVKSNALALPLVVRKLLRVSPLASGFAVSILRKICDKREEGILIEALQVGLFQKLSVLLQVGCDESTKENATGLLKLLNGYRNKAECTDSSLNFEHLKKPF

SEQ ID NO: 14575 - protein, 2029 aa, Nicotiana tabacum
MSEDEKLLKEAKKLPWDERFAHKNWKVRNDANIDLAAVCDSITDPKDPRLREFGPLFRKTVADSNAPVQEKALDALICYLKAADADAGRYAKEVCDAVVVKCLTGRPKTVEKAQMVFLLWIELEAVEAFLDAMEKAIKNKVAKAVVPAIDVMFQALSEFGAKIIPPKRILKMLPELFDHQDQNVRASSKGLTLELCRWISKETVKSILFEKMRDTMKKELEAELVNVTGTAKPTRKIRSEQDKEPELEVVSDAVAAGPSEESAADVPQRIDEYDLVDPVDILIPLEKTGFWEGVKAAKWSERKEAVAELTKLASTKKIAPGDFAEICRTLKKLITDVNIAVAVEAIQAIGNLARGLRTHFSGSSRFLLPVLLEKLKEKKPTLTDALTQTLQAMHKSGCLILTDIVEDVKTATKNKVPLVRSLTLNWVTFCIETSNKAVILKAHKEYVPICMESLNDGTPEVRDAAFSALAAVAKSVGMRPLEKSLEKLDDVRKKKLSEMIGGSGGDPVSTSSSGAVPSSGGIMSSTQASTGSLVKRSAASMLSGKKPVQAAPPSKKGASAKSGTNKRGDGATQLKASKPVEVEDVEPAEMSLEEIESKLGSLIQPETITQLKSAVWKERLEAISSFKEQVEALKELDPSVEILVRLLCAVPGWSEKNVQVQQLVIDIINHIASTASKYPKKCVVLCLQGVSERVADIKTRAQAMKCLTTFCEAVGPGFVFERLYKIMKEHKNPKVLSEGILWMVTAVDDFGVSHLKLKDLIDFCKDTGLQSSAAATRNATIKLIGALHKFVGPDIKGFLSDVKPALISALDAEYDKNPFEGASVAPKKTVKTSDAPSLSSGGLDSLPREDISGKITPALLKGLESSDWKARLESIETVNKILEEANKRIQPTGTGELFGALRGRLCYSNKNLVIATLSTVGGVASAMGPAVEKSSKGILSDILKCLGDNKKHMRECTLNTLDSWLAAVHLDKMVPYITGALTDAKLGAEGRKDLFDWLSKQLTGMKEFPDAVHLLKPVASAMTDKSADVRKAAEACFGELLRVCGQEMVSKNLKDIQGPALAIVVERLRPYGVLQETFDLGRTSSTGTTSKVGSKIGKSTGPAERASRHGNRAGASRAIPTRNSRQETLMSVQDISVQSQALINVKDSHKGERERIVVRRFKFEEPRLEQIQDLESDLMKYFREDLHRRLLSTDFKKQVDGIEMLQKALPSIAKELIEVLDIVLRWFVLRFCESNTSCLLKVLEFLPELFEMLRNEGYMMTEAEAAIFLPCLVEKSGHNIEKVREKMRELTKQIIHAYSAAKTFPYILEGLRSRSNRTRIECADLVGYLLDNHEAEIGGQLKSLKDVANLTAERDGETRKAALNTLATGYKILGDDIWKYLGKLTEAQRSMLDDRFKWKAREMDKRREGRPGEARAALRRSVRDNGTDIAEPSGEVSRSLAGPILNRDIYNNTEFPMERIVNLRPVSGTMGPSDWNEALDIIASDSPEQSVEGMKVVCHLLAVATNDPEGSAMDDIVKDADKLVSCLANKVARTFDFSLMGASSRSCKYVLNTLMQTFQNRTLAHAVRESTLDILITELLLWLLDERVPRMDDGSQLLKALNVLMLKILDNADRTSSFVVLIKLLRPLDPSRWPSPATDESLVIRNQKFSDLVVKCLIKLTKVLQSTIYDVDLDRILQSIHIYLQELGMDEIRRRAGADDKPLRMVKTVLHELVKLRGTAIKGHLSMVPIDMQPPPIILAYIDLNLQTLAAARMLTPSVPGQTHWGDSAANNPAPATHNADAQLKQELAAIFKKIGDKQTCTIGLYELYRITQLYPKVDIFAQLQNASEAFRTYIRDGLAQMEKNAAAGRTPSSVPMSTPPPSSLNLSSPKFGKLSPVNTNPLNDAKSVNNKVEPSQFSLPPSYGEDDRGGNALLSRGLSSEHLELRHQLGEQRNDRLPSGVTSGTLEAIRERMKSMSLAATGGNPDPSSRTLMSMNGNVSHMVSTQAPGIEHSSIENSIQSGVLPMDEKALSGLQARMERLKSGSMEF

SEQ ID NO: 14576 - protein, 128 aa, Pseudomonas sp. LS47-4
HVKEALEKVPGVQSAIVSYAKGAAQLALDPGTAPDALTAAVAGLGYKAMLADAPPTDNRTGLFDKVRGWMGAADKGSGGERPLQVAVIGSGGAAMAAALKAVEQGAQVTLIERGTIGGTCVNVGCVPS

SEQ ID NO: 14577 - protein, 405 aa, Methanosarcina acetivorans C2A
MITNSRKGIHLTENIIESGDPQARYDSVIEKDSKYVMQTYGRQPLVLSKGKGAVVQDIYGKEYIDCVAGIAVNNVGHCHPTVVKAIQAQAENLIHVSNLYYTEIQAEFAETLASITGMERVFFCNSGAESVEAAMKLARVATGKSAFVAAEHSFHGRTIGALSVTHKSMYRDPFMPPVSSETTFVPYSDAEAIRQAISENTAAVILEPIQGEGGINIPDPGYLKEVREICDETGALLIFDEVQTGFGRTGTWFCKEQFGVEPDIMSMSKAIGGGFPMGAIAAHNGINFGRGQHASTFGGGPLACAAALASVKVIREEKLLERSKEMGAYFMKKLAGMVRDDVVEVRGKGLMIGVEIKYPCGKFVDFAREQGVLVNCTSDSVLRLVPPLVITKEQIDTVVDVLEQA

SEQ ID NO: 14578 - protein, 468 aa, Methanosarcina acetivorans C2A
MSEHYESASLVKTLRPFHVWALGVGIVLVGEYMGWNFTVAKGGVLGSLLAMLVAGTMYVIISLCASELGAATKLAGGPYDWARLFIGPGAAASVGLAVYMEYIALEAADAIVVAFIAQSIFPELQVFPVTLLVIALLTFINYRGVVAALTLNFFLTMIAFISIVVFFFATAFGGVDIHPEYLFHGALPNGMIGLFAALQFGPWFYLGIEGAAMCAEECKHPSRAVPLGQQAGMITLLVGAAMTLYLCSVLIPTDQLGVSVYPLFEAAQNSGMFIFIALLGLGTFLTCVASANGCVCDSSRSWFALSRDNYVSSWFSAVHPRYNTPYRAVIFTMPVAIGFAFSGFLDQVITFSIVSGLLCYVLIPFALIRFRSLFPQNTSTIRPFVSPLQPYIAYFAIAIAITILSTLYWGYKYNLIFAFVFYGIAYFYFSHRHRSLNIENNWTEMGWPLPRGSENTGIRKEATGIGDE

SEQ ID NO: 14579 - protein, 336 aa, Methanosarcina acetivorans C2A
MKINTWFGSLEVGSGGEILAFDLFPKGIRELALRSLSLRSSRENLPPEGFDLKAAALECGFVASLSEYYSLLHEVTLEAAKLQVSEAITPDQRIVQAVEALDDINETTNSLSERLFEWYGGYFPESGLVGEALALFIVKYGSRENVPPDDPLYLKARDSMGAKLETADEALLKGFAESVCSLYSRRKQLEAYIESSMEALAPNLTTIAGPMLGARLISIAGSLEKLAAFPSSTIQVIGANKALFKHLRARAPSPKHGVIYSHPFINTSPWWVRGKVARALAAKISLAARIDFYSATKDLSLMGELEEKVRKIRAANPKPPQKRQEGRGKPKKKRRK

SEQ ID NO: 14580 - protein, 227 aa, Methanosarcina acetivorans C2A
MPDIKLLSEGIFEIMKDKRQLATLNLDPGKVVYGEKLISVEGAEYRTWDPRRSKLGAMVLKKFNIPLSKDSKVLYLGAASGTTVSHVSDIASEGAVYSVEFASRSMRDFIRLASRRKNIFPILADAGKPDSYAHIVEPVDLIFQDVAQPNQAEIAARNAARFLNKNGYLLLSIKARSIDTAASPKEIFKEEVKKLEQAFEPGFEILTARDLMPYHEDHLGVLAKLKE

SEQ ID NO: 14581 - protein, 375 aa, Methanosarcina acetivorans C2A
MRKLRIRIEVKSYKVNKRCINMAENIQSKGYAGKDESGKLVPWSFERRPVGNNDILIDIKYCGVCHSDIHQIKGHWGPQQYPQVPGHEIVGVVAAVGKNVTNFKVGDRAGVGCMVSSCMECESCKNGEEHHCDNNATIMTYGYLEESSPTGISQGGYSQNIVVAEHFAIKIPDSIDLQEAAPLLCAGITIYSPLMKANIKKGDKVGVAGIGGLGHMAIKLAVSKGAEVYAFTTTESKKEDCLAFGATEVIVVNSPSDLQPWKGKMDYMISTIPYAYEMSSYIDCVKPYGYFTQVGQPIGGELTINNFNMIFNRVNFNGSLIGGIPETQEVVDYCAENKIYPQIRMIEPEMINETWDKVVNKEARYRYVIDMSSLK

SEQ ID NO: 14582 - protein, 424 aa, Methanosarcina acetivorans C2A
MVSEVTLDKSRQMYEKAKTLIPGGVSSPVRAIKPYPFYTASADGSKIRDLDGNEYIDYCLAYGPAVLGHNHPVIKAAIKEQLDKGWLYGTPTELEVTLAEKVAGYYPSIDMLRFVSTGTEATMSALRLARGFTRKNKFIKIEGGFHGAHDAVLVKAGSGATTLGEPDSLGIPADFTKYTLQAPYNDIETMTTLVEKNRDDLAAVIIEPVLGNIGPILPLPGYLKELRKLTKENDVLLIFDEVITGFRLAMGGAQEYFGVVPDMTTLGKIVGGGLPIGVFGGRREIMEMIAPSGAVYQAGTFSGSPCSVAAGIAVLDYLKKEDIHAKLNSTGDYMRAVVSEIVEDEGLDYTVCGIASMFKIFFGAEPHNYQEALKCDKEGYLSFFHRMLANGVFLPPSQFETNFISAAHSEEDIEKTLEAYVENL

SEQ ID NO: 14583 - protein, 300 aa, Methanosarcina acetivorans C2A
MTTSGCDKNITVGVIGLGIMGSSFASNLLSRGYNVHVYNRTKEKAQPLIERGATFHSTPRELASVADIIMTSLTDEAAVNSVAFGEDGLLNGAKKGCLWIDLSTIDPSSSVKHAEAAKKAGLERLDTPVVGSKDLASKGELIILVGGSQEVLRKHEKFLNKLGKSVIYLGADGNGHKMKLAINLHLGLLAESFSEALVFSQKLGFDAKTFVETINNTPIRNYISQGKGPRIVEGNFEPAFSLNNLAKDLRLVNEQITKTGAILPMTKVSIEEYSRTVQNGEGQKDFSVIALEIQRKNGIA

SEQ ID NO: 14584 - protein, 120 aa, Methanosarcina acetivorans C2A
MIDLDTLKYENGLILAVVQDQKSREVLMCAYMNREALEKTVKTGIAHFWSRSRKQLWKKGETSGHLQKVKEIRIDCDMDSVLLLVEQVGGACHMGYRSCFYRNLKGEVVGEKVFEPKDVY

SEQ ID NO: 14585 - protein, 366 aa, Methanosarcina acetivorans C2A
MVIMAEDTDLFSQYRMGDLTLPNRMVMAPMTRSRAGDDDIPVPLTATYYVQRASAGMIITEGSQVSPQGVGFMHTPGIYSAAQAASWKKITDAVHKAGGRIFIQLWHVGRVSHSDLLGGALPVAPSALPVEGYIHTPGGKKPIPVPRALKTDEVPDIVRQFRQAAENARAAGFDGVEIHGANTYLLDQFLRSGSNKRTDKYGGSLENRARLPLEVTKAVIEVWGGDRVGYRISPHNIAHSMSDANPGETFSYFAKELNKTGLGYLHLIEPIGGRSGFVPPEARLGPILRRIFERTFILNGGYGLQSGNEAIDSGEADLIAFGVPFLANPDLPERFRQNAPLNEPKLDTFYVGGEKGYTDYPALVNR

SEQ ID NO: 14586 - protein, 446 aa, Methanosarcina acetivorans C2A
MEKDYDIIIIGTGTSGRTFADKVASSGLKTAIIDSREYGGVSPPIGCDPKKMFVDIAEITDWNNRLIGKGAGTQNPLKIDWPSLIEFRRTFTEKCSRKTENHFVELGIDTYHGKAYFENKNTVAVGEDKLKGEYIFLATGAKPRKLNIPGEEYIITSGEFMETEKLPERIIFIGGGHISMEFSHITLKAGSEAIILHRSEKLLKSFDSDMVNFLINESEAAGIKIFTNKPVIAVEKEGNSFLVRAGSESEIRSFRADMVVHGAGRVPYIEELHLEKAGVRVEGGAIEVDKHMRTSNPRIYAGGDCASEGMQLTPVAAYQGEVAAVNILTEDSVEADYKGIPSAVHTMPVLASVGISTVKDSDKYKIIFRDRSSEKTGRSEGADFVASKVIIDEANDRIMGAHILGPNAGEAINIFAAVMRLGLKASDMKKMIFSYPTVCSDIPYML

SEQ ID NO: 14587 - protein, 492 aa, Methanosarcina acetivorans C2A
MRIDAYISEYARKTPQSVALEDSKNSVSYGCLEKDISNIALYLKDFKRSRFTILAESDIQYVKLLLAVYRSENIAIPLPIEFPRFSLERILDSAHVNNIITTDTQYSRFGKSFFERFGTVVVTYNDMSVNILRKEIKDETNNPELRLVLYTSGTTGTPKGVMLSDRNLIANGESIIGVLGITSEDKGALVISPHHAFGNSILNSHLMAGGSVRIGTMNFMNSVFNLIGSGVSIFYGVPSTYRMLLKYPDRFRQVFTGVRTAASAGGGMDRSIVKEIRELAPWLEILPMYGQTEATARLAYVPAEDVDKFIDTIGKAIPGVTLDVFDFECRSVEPNIEGELVARGENILIGYLDDEIATKSKVVNGWLHTGDLAQKLPNGYIRLLGRKDDIIKIGDHRVNPREIERYIEENNTVSRVFVVPVSHELMGTAISLMVMPAEGTEIEALYAFCRKNFPGYLCPREILFIDYIPLSENGKISNRSIIEEYQHVKSSM

SEQ ID NO: 14588 - protein, 215 aa, Methanosarcina acetivorans C2A
MNIILFGPPGAGKGTQAKKLVDFYGIPQISTGDILRANVREGTELGLAAKAYMDKGELVPDQVLIGIIKNRLNEADCEKGFILDGYPRTVPQADALEAILDEIEKPIDVVLNLEVPDEVLVGRISGRLMCKCGASYHIISNPPKKDNVCDICGGEVFQRADDTAEAVQNRLDVYKKQTQPLINYYKEKGILVTLDGTKEIDVVFEDLKAILAKFA

SEQ ID NO: 14589 - protein, 312 aa, Methanosarcina acetivorans C2A
MTLTEMIETFKKELNPSKIMDSLEKTASFYDESENDSKASGSWEELQNQERSSAAGFFHSSERSRLTSDEREPLIKLTDVWKIYQMGEVEFAALKGIDLEIYEGEFLVILGPSGSGKSTLMNLLGCLDIPSEGTVYLDSNDISELEESELARIRGQMIGFIFQSFNLIPTLSTEENVLLPLEFQEEDAHLARKKAEYLLDIVGLSNKKTNLPSQLSGGQKQRVAIARSLAVNPPIILADEPTGNLDSKTGDYILEFLDGLHEKEGKTIIIVTHDLDLVKYATRVVYIRDGEIEKIEIRTKKEPSTINESDMN

SEQ ID NO: 14590 - protein, 500 aa, Methanosarcina acetivorans C2A
MKYISSLRMKAIDTNCSYLGLSPLQLMENAGAAIAQSVKEKLGSGKVLFVAGRGNNGGDAFVAARHLAGIPGYIVRVILLGKDRDIGTEEAYHNYSLLKFSRVQTLEIRDSGQLAVSELFSEADLLVDAIFGTGVKGNIKEPESTAIDLINNEGKAGKIIIAVDVPSGLDPDRGNFEKAVYADLTVTFHRMKAGLLDEQAKEYTGTIKVAEIGVCADAEHYTGPGDLQMLKKRKLEAHKGNAGRILVIGGGPYSGAPALAALAALRAGADLVTVAVPESVAGIVASYSPDLIVRKLFSSVLCPEDLSILPDLINSHDVVVMGMGLGRATETLETVRKLLPFCRKAVLDADALAALSGTLFETLAGNCEIIVTPHAGEFARLRDMETPDSPETREKAVREFAAEKGVVTLLKGKVDIISDGKQTLLNRTGNPGMTVGGTGDVLAGITGSLFSRNPAFLAAACAAYINGAAGDLAFEKAGNALLATDVIGKISEIIKEAGIG

SEQ ID NO: 14591 - protein, 299 aa, Methanosarcina acetivorans C2A
MDRIISVVGHTALDYIIDVENIAGKNESSPVIDYEEYPGGGAANIAVAIAKLGGKSQLMSPVGMDFSSSGYEQLLKDAHVDLSRLYSIEALKLSKAFIFTDREDNQTTYFYWGASSKFKELEPEPVDFAHLATADCIYNAKIAQIAGFVSFDPGQDLVTYSQEKLETILAHTDILFANRHEIKRVSEMTGKSFSELRAMIEVIVITYDAEGSRIYTGNEEWKIPVVSVKAVDPTGAGDAYRAGFLLAYTREYSLPTCGKIGSTVASFAVQSRGCQTSLPTWEEMKSRYEASFGKLEVES

SEQ ID NO: 14592 - protein, 365 aa, Methanosarcina acetivorans C2A
MIFDPITVCNLELQNRFVRSATHEFMAEKDGTPTSRLGDLYEELAINEVGLIITGYSYVLPGGQSDNLQQAIYDDRFIEPYQKITERVHRYRSKIVIQIVHGGRQADISDEYPVPIAPSVVKNGHSSVVPREMTEQEILDMIEAFTRAAGRAKVAGFDGIQLHCAHGFLLSNFISPYTNRRTDRWGGSVENRARIVTEIIRRIKEDAGDDFPILVKMNATDGFLPGSSKAGLGLDAPECVEIAKILERAGVCAIEVSGGIGEAGGVTIKTAINSPAKEAYFKNYSKMIKAAVNVPVILVGGIRSLSVMECLLENGCADLISMSRVFISEPDFIPKLRSGAVKKARCVSCNLCFDSEGIRCNFEFD

SEQ ID NO: 14593 - protein, 382 aa, Methanosarcina acetivorans C2A
MATKRDYYEILGLPKDASVEDIKKTYRKLALQYHPDRNKDPGAEDKFKEISEAYAVLSDTEKRAQYDRFGHAGIDNQYSAEDIFRGADFGGFGDIFEMFFGGGRRGGPMGPRRGSDLQYDLYITFEEAAFGVRKDIDIPRTERCSTCSGTGAKPGTSPKRCPTCGGTGQVRTTRSTLGMQFISTTTCSTCHGRGQIIESPCPVCGGAGRVRNKRTITVNVPAGADSGMSLRLSGEGDSGEPGAPSGDLYIIIHVMEHRHFKRVDYDVISELSITFTQAALGADVMVDTLYGKVKMNIPAGTQTHSVFRLRDKGIQRLHGHGKGDQLVRVIIKTPTKLNQEQKELLRQFENLSKGKKPQEEEKSKAEKHKKGIFEKVKDAFES

SEQ ID NO: 14594 - protein, 476 aa, Methanosarcina acetivorans C2A
MKNYDLIVIGTGSGMNYVNSIIDSKPEMKIAVIDKDEPGGICLTRGCIPSKLLLYPAELVREIWTAPLFGIRLEIKDIDFRMIMERMRRRIGKDIDTIRDGLNEDTYLDYYHEAAEFISPYTLRVGEETLHSEMIFLCTGSKPSIPPVKGLEETGYLTSDTVLELEERPKSLAILGGSYIGAEYGHFFSAMGAEVTVIGRNSHFLPQEEPEISELARIKMSEYMKIITNHEAIEVRKESNGQKTVVAKDRKSGEEIKITADEILVATGRTPNTDILHPEKAGIKIDSQGWIMVDKYLETSQPNIWAFGDANGKYLLKHVGNYESGIVYLNAIMKEKVRADYHAVPHAVFSYPEIAGVGMSEKEALEEYGENRVVIGFKLFEDTAKGSAMEARGYFVKVILDSLEETILGAHIIGPHASILIHQIIPLMYAPSRSAKPIIRSMDIHPSLSEVVTRAFYSRFSPEQYHHIMKHLGLED

SEQ ID NO: 14595 - protein, 429 aa, Methanosarcina acetivorans C2A [sequence omitted]

SEQ ID NO: 14596 - protein, 389 aa, Methanosarcina acetivorans C2A
MTFPMYSDRINALPPYLFAAIDEAKDEMIAKGVDVIDLGVGDPDLPTHPHIVEAMREAVCDPKTHQYPSYAGMPEFREAAAEWCKKYKGIELDPATEVLSLIGSKEAVAHIPLAFVNPGDVVLYTDPGYPVYKIGTLFAGGEPYSLPLKAENSFLPDLDSIPADILKRAKLFFFNYPNNPTSATADMKFFEKVVEFCKKNDIIAVHDNAYSQMVYDGYDAPSFLAAEGAMDIGIELYSHSKTYNMTGWRLGFAVGSKALIKGLGKVKSNVDSGVFDAIQIAGIAALSSSQACVDDTNKIYEERRNVLIEGLTAMGLEVKPPKATFYVWAPVPTGFTSIEFAKLLLEEAGIVATPGVGFGDAGEGYVRFALTKPVERIKEAVERMKKLQF

SEQ ID NO: 14597 - protein, 224 aa, Methanosarcina acetivorans C2A
MNIVETRNLAKYYTFDSGLRVEALRGINVNIEEGDFVSFMGPSGSGKSTLLNIVGCLDQPTSGNVFIEGREIDYRNSSNLVRLHRQTIGFIFQAFNLISTMNAMENVCYPLYFNRVPHSRQEKRATELLNLVGLGDRMHHLPSELSGGEQQRVAIARALANNPKLILADEPTGNLDSGTGKKVTDLMRKINREQGVSFLVTTHDHEMARTADRVIKLKDGKITD

SEQ ID NO: 14598 - protein, 326 aa, Methanosarcina acetivorans C2A
MQNRKVQNRKVQNRKVQNRNKAVKPVNDMKALTFGEALFDIIKGTVHLGGAPLNLAAHLAKLGAKPAVLTAVGKDELGKTLLSRAEEMGVDTSYILLDEKRPTGTVTVELQAEGIPIFTINEGVAWDAITPDEREFEALAAEEWDVFCFGTLAQRSEENRKTLKRLLSEIKAKHFFYDVNLRAGFYRKEWILSSLERCTILKMNEEEAAKISGMLFGTTYACRTLCRLLTDRYPKISVICITKGPEGAAVYQDGVYEEIKTTPVEVADTVGAGDAFSAGFLYTFLSGYGVSKAVSVAIMLGTYVASKPGSVPEYSEELRKELGILE

SEQ ID NO: 14599 - protein, 338 aa, Methanosarcina acetivorans C2A
MTISVYLMTQLSILCDGVLKMLKKFTSLFPLWAILLSAVAYLHPEYFAPHQGLIVPFLSLIMLGMGVTLSVGSFLAVLKRPYVVLLGTLMQYTLMPLAAWAVSLALKLPADLMAGVILLGCCPGGTASNVICYLAKGDVALSIVLTSVSTMLAFLATPFLTWLFIGQTVNVDVTGMLVSVVRIVIVPVVLGLAINYFFEARIRAVRDVFPAISAAAIVIIIAIIIGTNSENLEQSGLLVLLAVVLHNSLGLAGGYGVAKALKLSEKEARTLAIEVGMQNSGLSVALAIKHFTAAAALPGAIFSIWHNLSGAFLAGHWSKETVPDPDKSERPKTIGHIH

SEQ ID NO: 14600 - protein, 430 aa, Methanosarcina acetivorans C2A
MAETKSMGLWASASIGVGAMVGAGIFSIFGTAAQISGNAVYVSFIIAGMIALLNTYSYAKMGVRYPSAGGPVEFMLKGFGDGILSGGLNLLLWVGYVFGLALYAKGFSYYAITFLPAGSAPVWTSFFATAIILAFTAINFRGAKTVGKSELFIVSIKVGILLLFAAAGMFYVTPGNLSISAWPAPKNLFFGAGMVFLAYQGFGLITNAAEDMKNPEKNLPRALYLSVVLVIIIYVSVSLAVIGNLSVPEIQNAQDYALAAAAKPFLGDIGFKIMAFAALFSTSSAINASLYGGANVSYILAKDGELPEIFERKVWHRSPEGLFITSSLVILCANFLQLEGIGMLASTCLLMVYVAVNISHLRLLKETGAKSYIIWASLLSSLTFFCVLLYYEFMHSKTTLGLLGFTVFCCFAAEWTYRKYSGRLIKERTG

SEQ ID NO: 14601 - protein, 400 aa, Methanosarcina acetivorans C2A
MLYRKMPENGDELSILGFGCMRLPLKEDGTIDEQRARSLVRYAIDQGINYVDTAWPYHMGESEPFLGRTLADGYREKVKLATKLPSWLVESREDMDKFLNAQLERLKTDHIDYYLIHGLAGKLWDKLEALDATDFLNKAKADGRIVNAGFSFHGPVEDFKRIVDAYPWTFCQIQYNFMDEKHQAGTEGLKYAASKGLGIIVMEPLLGGNLAGQVPDEVKEIWAESPVKRTPPEWALRWVWNHPEVTVALSGMNEESQVEENLKIAGEAYPNSLTEDELQLISRVEKKYHELMKVGCTGCEYCMPCPSGVYIPECFRIYNDLHMFGNVEGARFKYAVNMSGVFTNSDPGGFASQCTECGQCMEKCPQGLKIPELLKAVAEELEGPDLEQRIAMAKKLFKRD

SEQ ID NO: 14602 - protein, 461 aa, Methanosarcina acetivorans C2A
MDLNQNTGGSLIKIAMLSPIAWSTPPKKYGPWEYMVSLLTEGLVKRGIEVTLFATADSHTAGELHAVCPRPYEEDKDMVRKVYEGLHISEVFERANEFDIIHNHFDYLPLTYSGLVDTPVVTTIHGFSSRKILPVYKKYNNSTFYVSISDAYRCNELDYIATVRHGIDIETFPFNDRPEDYLLFISRIHREKGAKEAIEVAKKAGRKLRMAGFIADPEYFKNEVEPHIDNDQIVYEGHVSQERKKELLSNAYALLHMINYEEAFGLGVVEALACGTPIIAINRGAMPELIMDGETGFLVNNVTEAAEAVEKLNSISRRRCRESVEKRFSVDRMVEDYIRVYETILEKRKREAKRPWGFYEILAQKPGYKVKRITVLPQEQISLQRHAHRNEHWYVVSGEGLVTKNSDYLKVLVGDTVDIPVNEIHRIKNTGIQNLVFIEVAQGDYLGEDDIERLEDKYGRT

SEQ ID NO: 14603 - protein, 248 aa, Methanosarcina acetivorans C2A
MSYLIIVRHGESGWNVDGRFGGWVDVPLTGKGIKEALLCAAELEGIDLDVTFTSKLIRAQETLFLILSKQKKIGVFVHEEAGTGEDRTEREDGSRKDRKEKRYAYPPNTEKNLIPIHSNEALNERYYGILQGKKKDKMKAKYGEEQILHWCRSFDEGPPEGESLKDIYRRAVPYFEKEIFPILQDGKNVIVCAHQNSLRALIKHIEGISNEDIRKIRLANARPVIYTFSGGRLVRENAETDPSVKRNL

SEQ ID NO: 14604 - protein, 406 aa, Methanosarcina acetivorans C2A
MERELKFATKCVHAGEEPDPVFGAHTTPIFQTSTFIFKNVEQGAARFAGEESGYVYTRIPPNTPTHAVLAEKVAVLEGGEAGQTFASGMAAITAVVLSTLKQGDHLISTDVVYGCTYSLFSEILPGFGIDVSFVDTSDIKKVRAAFKPETRMVFLETPANPTITVCDIREISKLAKAQGAICIVDNTFATPYFQKPLELGADISLSSCTKYIGGHADLLGGIVVGSRDFMKSLGKVVGYTGGIMGLHEAWLCIRGLKTLHIRMERHAENALTVANFLEAHPTVEWVRYPGLSNHPQHEVAKKQMSGYGGMLSFEIRGGVEAGRRLMDSVRLCSLAVSLGATDTLIQHPASMTHACIPGHIRNKVGIKDGLVRLSVGIEDPEDIIADLEQALSKVYCRRGNGFDPCN

SEQ ID NO: 14605 - protein, 312 aa, Methanosarcina acetivorans C2A
MTLTEIIENFKTKLNPSTIMDSLEKTASFYDESENDSEASGSWEELQNQKRSSSTGFSHSSERSRLTSNEREPLIKLTDVWKIYQMGEVEFAALKGIDLDIFEGEFLVVLGPSGSGKSTLMNLLGCLDIPSEGTVYLNSNDISELEESELARIRGQMIGFIFQSFNLIPTLSTEENVLLPLEFQEEDAHLARRKAEYLLDIVGLSDKKKNLPSQLSGGQRQRVAIARSLAVNPPIILADEPTGNLDSKTGDYILEFLDGLHEKEGKTIIIVTHDLDLVKYATRVVYIRDGEIEKIEIRTKKEPSTINESDMN

SEQ ID NO: 14606 - protein, 288 aa, Methanosarcina acetivorans C2A
MVETTSFLNFLETVGVLGTLIFVLTSMLGMGFSLTVQQILAPLSNRKLVILSLAANFILVPLLALGVLLIFPLSEGLSIGLFLLGTSAGAPFLPKLAQVAKGDTAFAVGLMVLLMVVTIFYVPIVLPLFLSGVTISPWDIAKSLILLMLLPLVLALFIRARHEEIASGLLPLMTQATNLSLLVLFVAFFVVYLSDLISVIGSTAVLAAAVFLLISFIIGYFLGGSAGPVKRVLALGTAQRNLSAALAISALNFTDPDVMVMIMVVALAGLILLMFIGGELGKRAEKLA

SEQ ID NO: 14607 - protein, 412 aa, Methanosarcina acetivorans C2A
MSQKTAGKDYLTMDDVELDNKRILLRVDFNSPMDANGNILDDRKIKSHLYTLRSLENSRVVMMSHQGRPGDKDYTTLEAHAKLATELLGRKVTYEDDIFSACARNAIKSLEKGDILLLENTRFYAEENMNRAPEEQARTQMVRKLYPLFDVFINDAFSVSHRSQCSVVGFTEVLPSVAGILMDREITGLDKGLKCHEHPAVFALGGTKAKDIVKVISDILKRGGADRILTTGVVATVFMMAIGIEVGEVNRKFIEDHKYLDQVSIASRLLKEYSGKIIVPKDIALNNDGKREEVKVDKIKGDLPIADIGPETISDYSKFLKEAKLSVFHGPAGIFELESFRLGTEELLKAAAQSNYSIAGGGHTLAAIDQLGLESKYSHLSMGGGASITYLSGEHMPGIEALKNYASRCCKD

SEQ ID NO: 14608 - protein, 308 aa, Methanosarcina acetivorans C2A
MGQIYSDITWTIGNTPLVRLNHITKGLHTDVLVKVESFNPMGSVKDRIGLAMLEEAEREGKIKEGTTIVEATSGNTGIALAGVCAARGYKLILVMPETMSIERRKLLKALGAELVLTPGPEGMKGAVNKAEQMASADPTLYYMPQQFQNPANPEAHRRTTAEEIWRDTDGKADVLVAGVGTGGTITGIAGVLKKRKTGFRAIAVEPTESPVLSGGSPGPHRIQGIGAGFIPDVLQLGLVDEIIKVSADEAISTGRRLAREEGILAGISSGAATCAALQVASRKEMSGKTIVVILPDTGERYLSTDLFS

SEQ ID NO: 14609 - protein, 477 aa, Methanosarcina acetivorans C2A
MWEEGGSILDYGEPETLEKWRNSEKTEKSEDPMRKQETELDFFEQEIGLLDVVGPRAREIIGQDCKVMSACVSRPYPLVVDRAKGSVIKDIDGKEYIDFIAGIAVMNSGHSNPEVNAAISAQLEKMVHCGYGDFFAEPPLKLAKKLRELSGYSKVFYCNSGTEAVEAAMKLALWKTKRPNFIAFYNAFHGRTLGALSLTCSKVRQKEHFPTMRTVHTHYAYCYRCPLNLEYPSCGVECAKQIENLIFRKELSPEDTAAVFIEPVQGEGGYIVPPQEFHKEVKRICTDNDVLLIADEVQTGCFRTGPFLAMENFEVRADITCLAKALGAGLPIGAMLADSTLMDWPPGVHSNTFGGNLLSSASALASLEFLEKENMENRVREMGTHIRQRLRELQENCPCIGDVRGLGLMIGAEIVKSDKSIDPIRRDRIVREAFKEGVLLLPCGDSVIRFSPPLVMTDEEADLGLDKFEKALRRAAK

SEQ ID NO: 14610 - protein, 503 aa, Methanosarcina acetivorans C2A
MVLYSLFQGDFVVQEYKLHIGGESRDSATGETFDNINPATLENLATVQVAGSEDVDRAVEAAEEGFRVWSEVPAPRRAEVLFRTARILQERKEDLARLMTEEMGKVLPETRGDVQEAIDIAIYAAGEGRRMFGETTTSELKDKFCMTVLRPIGVVGMITPWNFPLAIPGWKIMPALIAGNAIVFKPASDTPLLAIKLVEILMEAGLPPGVVNLVTGPGGSTGKAIVQHPRIKAISFTGSLETGKWIMEECAKTMKRVSLELGGKNPVIIMDDADLELALEGVLWGAFGTTGQRCTATSRLILHEKIKDEFTARLLAKTKLLRVGNGLLPETDIGPIINKAQLEKIERYVRIGMEEGATLLLGGKAIDPGLPGYFFEPTVFTDVRPDMRIAQEEIFGPVLSIITVSGLEEAIEVANNTRYGLSSAIYTENVGKAFRAVKKIEAGITYVNAPTIGAEVHLPFGGVKGTGNGFREAGTEAIKEFTEIKAVYIDYSGRLQRAQIDME

SEQ ID NO: 14611 - protein, 272 aa, Methanosarcina acetivorans C2A
MATELRATEHGRQKISEKFDELKQKKEGALIGYVMAGDPSAEATFGIVKALVNGGADIIELGFPFSDPVADGPTIQAAGQRALAAGMDIEHYFELVRGLGVEVPLVCMTYYNPVFRYGVDKFVEHAADAGISGLIIPDIPVEEAADLKSSCEKYGLDLIFLVAPTTTDARIRKILERGSGFIYLVSRLGVTGARADVSGSTKELLSRVKTDIPKAVGFGISTGKQAAEVRKAGADAVIVGSVFVRIIEEGNGVNEKLEALARELKSGILGAN

SEQ ID NO: 14612 - protein, 160 aa, Methanosarcina acetivorans C2A
MTEETIKNPDKTIENGDTISVDYVGKLEDGTVFDTSEKEAASEAGIYNEMRDYKPLTFTVGAGQMIKGFDEGVVGMKVGEEKTLEIPPEEAYGEYMEEYVRELPRNAVNFTPETGMQLATENGLRGKVTEVGEENFVVDFNHELAGKTLIFKIKVISLEA

SEQ ID NO: 14613 - protein, 333 aa, Methanosarcina acetivorans C2A
MPSKLFITFPPIKLQMIIGVMGPEGSYSERAAKLWIQKNSLKDAEFRYFGDIEDAFLAAVKGNADVSVIPVENSIEGSVGVTLDLLLENEAVIIGEIVVKIEHCLLSKGGPDKIRVILSHPQGLAQCRHFLKRHFPEAELRSTGSTSHAARLAGEFEEMAAIASPEAAERYGLKILLSNIQDRKENHTRFIIIRAGQKTSSEQTMDAAGVEGKSIPEPCRREEPEFHPETSREKVSHSACKTSLIVYLEKDRPGALYELLGAFAKRGINLTKIESRPSKKELGDYYFYIDFEGCTSDALIKGALEDIKSKAGTKSKANTLKVLGSYPAFRNFV

SEQ ID NO: 14614 - protein, 506 aa, Methanosarcina acetivorans C2A
MKTSNVELNPNKLVQYLNKPASEFTKDDIIRFIKENGIKMLNFRYVGGDGRLKALTFVIRDEEHLDNLLSAGERVDGSSLFSYIEADTSDLYVLPKYRTAFVNPFEEIPTVDILCSYFDKDGTPLISASETIMKKASQVLTEKTGYELQAMGELEYYIIANSGEVNMGFPAVDQRGYHESNPFTKYDQLRKEAMMYIAEAGGKIKYGHSEVGNFTDNNYYYEQNEIEFETDTLENSADRLLIAKWMLRMLADQYGVVISFAPKITVGKAGSGLHVHMKLLKDGKSIMVENGDISDAAKRAMAGLLDVAAGITAFGNRVPTSYLRLVPHQEAPTNICWGDRNRSALIRVPLGWFSDDCSKMIAHVNPNYCEDFKSHSYKSTFEFRAADPSADLYLLFAAFAVGIRHGFEMDNALEIAKNLYIDVNIFKDEHKDRLAQLEHLPASCYESAQALKKYKDIFTQYDVFTEGMIDDTVKYLESLDDYQLSERLYGKNEEIKKLVDSYIHIA

SEQ ID NO: 14615 - protein, 416 aa, Methanosarcina acetivorans C2A
MLRVMTSRNFLTIDDFDIRGKTILLRVDMNSPMDTQGHILDDMRIKSHIATLKDLESAKVVLLAHQSRPGKKDFTTMKPHAHLLSRYLGKQVTYVDDIFGTFAKTHIASMEDGDVIMLENVRFYSEESLERTPAEQANTYMVKKLAPFVDIFLNDAFAVAHRSHLSVVGFTEVLPSGAGRVMEKELVSLDRGVKGGERPSIFVLGGAKVDDSLRVTENVLTSGGADRVLLTGVVANVALAASGVNIGKVNMDFIKSQGYENQIEKARGLLAKFKDRIGLPKDVALNDNRERVEVHISELNSDSLPINDIGLETIVDYTNEIQNSKTVVLNGPAGVSEIEDFALGTHEIIKAAIKSDFSIIGGGHISVEVAHLGLEHRFSHISTGGGACIDYLAGEKLPGVESLKAAYIKYQEAKKL

SEQ ID NO: 14616 - protein, 2523 aa, Methanosarcina acetivorans C2A
MKDETNISGFIYSCTYVHECAFHPNRGRCRKAPPDRVVPMKRINLLNKATFLSSWIFWLGLLVCLVLIVTPVAAAGPEWTANSSWNTPDVGEYSVPALADLDDDGDYDLMIGAKDGITYGYENTGTPDSPVWTAKSEWNVPDVGSWSSPALADLDCDGDYDLMIGEIGGVTYGYENTGTSDSPVWTAKSEWNTPDVSQNAAPSLADLDGDGDYDLMIGEGYGVTYGYENIGSSGSPEWAANSSWNIPSIGYYSSPALADLDGDYDYDLMMGGYDGVIYGYENTGSSDSPEWAANSSWNIPSVGSRSLPALADLDCDGDYDLMIGESTGITYGYENTAPIIVPLAGFSASPTTGNVPLTVRFTDESANNPASWLWEFGDDTNATMRNPVHTYNAAGTYNVTLTATNIAGNSTESKTGYITVLEAVIPVANFSAEPTTGDVPLTVQFTDESANNPTSWLWDFGDGGDTNATMRNPVHTYNAAGTYNVTLTATNIAGNSSESKTGYITTVLTAVIPVANFSAEPTTGDVPLTVQFTDESANDPTSWLWEFGDDTNATMQSPVHTYNAAGTYNVTLTATNIAGNSSESKTGYITVTGEPIKLADSAWPKFGYDLNNTGQSPYAGPQSNNIVWTYTAGEYFTNGGPSIGPDGTIYINNVDKKLYAFYPNGTLRWTNTTGARSYSTPAIDSDGTLYGGDYNGKLYAVNPDGTFKWEYTTGDKFMGSPAIGSDGIIYAAGYNGNLFAFYSDGTLRWSYSTPGFDYSTPAIATDGTIYIGTYNSYLYAINPDGTLKWTYQVGGEIYNSPAIAADGTIYVGCEDNNLYAINANGTLKWTYTTGAQIYGAPAIGADGTIYVGDYSGILSAINPDGALKWTYEANYRFYSTPVIGSDGTVYIGDYSGTMNDNSGNIYAINRDGTLKWEYATGRIHSSASIGSDGTLYLGSYDNNLYAFRDVADFNAGPKMGGAPLTVQFTDESTGSPTSWLWDFGDGDDTNSTVQNPVHVYTAPGIYNVTLTGADAYHSYSTEKIGYINVTNDSSGVTAPIPSFTTDASSGRVPFTVQFTDTTTGNVSTWSWDFGDGETSDEQNPVHTYVTEGTHTVTLTATGPGGTDTATSTMEVAAPLNTGSYDGGSPLLTVQEGTVSGGLWHGSWPGFSGYGEQTFTLPPHTEIKWARLYADVYCGLMTDIKSFSMTIDIDGDGDGIYELQKHDAASIDYTNTPAWVNDHVVRVTSDYFMWYDLTDNITGNEVNIKATGGGSDGRIKHVTLVVAYDDGDDDEIHYWVNQGHDTANTGSYTGSTVFGTSALSDPDAVNLSSIYCASVNGAYTYNGESLSSGGPQGEYFGYNDWNVTEYFNSGEDSTVTYAPTGSYYKIQLALLTASGAGSSGGDGPVADFTANVTSGGIPLTVSFTDESTGSPASWLWDFGDGNNSTEQNPVHTYSTEGTYSVNLTVTNEDGSDSELKTDYITVTQAGQVATNDLSISGLVNTVPASAVFARETNPVKVLNVQNTGTATLSNISIAVYASDVSSGTVPVDTTTIASLAGDAKTTVTLIDPTIRDLEGGTVTYTAVVDPDNLIAETDETNNNKSSSAKPLRYNGYKGKGIYWEGGSNITTRHTFDLQGNLLYSTQPDSAYQPVGWESRTETWTASDLPVPDGSTIEKAFLYVAYNWDQTPGGYPWLNINFNGNALDNGNISTGNGTLYRDWSNFGAYADYEYGLCVYNVTDKFSSAGNSLVMTPVGENKNALYPSTLVVVYGNDNETRKQIFINEECDELAYSLTGYGTTPEEATAYAPFTGMFIDVEKVQNAMLYSFAGSAGPDEGNLLFNGNIVATNAWQGSSNSGSPLVFDATNYINATGNEAGIQGTTSGGMDALQQILVVEYTSSGTVPSTDFSADPTSGTAPLNVTFTDESAGAPISWSWDFGDGNTSAQQNPSHIYTAPGTYTVNLTVTNNTGSSSVTKTDYISVAGGSTYTVGEDTVVIWNYGSTTWTAPPGISEVEYLVVAGGGGGAGHYSNGGGGAGGFLNGTLAVTPGMGYAIMVGAGGPGGDAGGSIGMNGSDSQFSTVIATGGGAGGNLGSAGLSGGSGGGAGSSTSATLPGGDGVSGQGHAGGSNYPTGGGGELAGGGGGGASGTGGDGAYRLGGDGGDGITSSITGTEVVYACGGGGGANLGPGGTGGSSAVNGGTGGGPQSGNVNGEAGLDSTGTGGGGAGWYGTGGDGGDGIVIIRYHTSVPVAPVAGFLADPTSGTAPLTVQFTDNSTGSPTEWSWDFGDGATSNESSPMHTYSAAGNYTVNLTVENAAGSDFELKSDYIKVSEASGSTVTLYFDPTSSSVSENESIEINLVASNFPAGLSGYNLTVALDGPAVAEIVDIEYPSWALITQNSTLPGSSIYMKTVDLEDSIKEGAADVVLATLTVSGKEKGSANLSIGVKRLEEDSGDSIEPALLTGTIEVTLLSPLPDQEYTPRDLDGDGLYEDLTGNGEFSFVDIVAYFHNMDWIEENMPVEYFDFNGNGRIDFDDVVDMFAMI

SEQ ID NO: 14617 - protein, 495 aa, Methanosarcina acetivorans C2A
MKCMRIDAYIAEHARNTPHQTALEEGKKSISYSCLDEDISTIASFLTDFEHCGFAILAESGIQYIKMLMAVYRSGNIAIPLPIELPGLSLERILDAARINNIIATKKQYLRFGNGFFERFGTVIVVSDDTAVEVLSKRVVCERNNPELRLVLYTSGTTGTPKGVMLSDKNLVANARSIIEVLNISSKDKGALVISPHHAFGNSIINSHLMAGGSVRTGTMNFMDPVFNLIESGVSIFYGVPSTYRILLRYPERFKKAFANVRTAASAGGAMDMSIVRSIRELSPGMQILPMYGQTEATARLAYLPTEDVDEFFDTIGKAIPGVTLDVFDSENRPVEPGITGELVARGDNILLGYLNDEEATEMKIIDGWMHTGDLAQKLPCGYLRLLGRKDDLIKIGDHRVNPREIEKEIEMNNEVSSVFVVPVFHELMGSAISLMVISNQETDVDTILAFCRKNLPGYLYPREILFIDHLPLSENGKISNRSIIEEYQHVKASM

SEQ ID NO: 14618 - protein, 460 aa, Methanosarcina acetivorans C2A
MEMKGIKSIILAGGSGTRLWPLSREMYPKQFLKFGDTSLFQETVLRCLEVSDISEIFVVTNEAQKFFVIGQIKEIGYSIPPENVLIEPEGKNTLPAIFFGMKEIEQKFGNSIVGVFSSDHVLDRAAMATIFSAEKLTSDYLVTFGVVPAFPHTGYGYIKAAESCEPGYRVSEFREKPDFETAQKYIEEGCLWNSGMFLFETRLFFEEVKKHAPSIFACFEKGGSIDEIYACVDNVSIDYGIMEKSDRVAVVKLDQKWSDLGNFAAIYDELEKDSVGNVVHECDSMLLNSDGNLVYSKCGKIVSLIDIKDMVIVDTSDALLICPKSSSQRVKEIVSDLKGRNDERAFIGQTVYRPWGSYTLLDASPGHKIKNITVLSDHRLSLQLHYHRSEHWVVVKGMACVEVNGEQFFLRPGESTFIRAGQRHRLSNPGKVPLEIIEVQLGELVDEDDIVRFDDEYGRS

SEQ ID NO: 14619 - protein, 469 aa, Methanosarcina acetivorans C2A
MQEVQGEKPGKAKKERTPMPEQPAEERRKNFNEVTLGYTKEDALAEASRCLACKDPKCVEGCPVNVDIPGFIQLICEENFEGAIERIKATNALPAICGRVCPQETQCEARCVLGKKSQPVAIGRLERFCADYEREKGVKAPEVMPPTGKKVAVVGSGPAGLTAAADLAKLGHKVTIFESLHKAGGVLSYGIPEFRLPKEIVRQEVEYIEKLGVEVKPNYIIGRIKTLDELCDDFDAVFLVTGAGLPNFMGIEGENLNGVYSANEFLTRVNLMKAYDPEYDTMVRHGKHVVVVGGGNVAMDAARSALRLGADEVSIVYRRGEDEMPARREEIEHAKEEGIIFRLLTNPVRILGDEKFNVTGVECIKMELGEPDKSGRRSPVPVEGTEFLVQADVVIIAIGTSPNPIIFKGSEGLEQNRRGTVVADEETGATSKCGVFAGGDAVTGAATVISAMGAGKKAAKAIDAFLKEK

SEQ ID NO: 14620 - protein, 489 aa, Methanosarcina acetivorans C2A
MNINVNINGRENMQIPDHKTKIVCTIGPASFSEEVLRKLVLAGMNVARINFSHGDFESHGKVIRRVRKVAEELDRTVAILADLPGPKIRVGKLKKEPLMLHKGNRITLTTDETSGSEDRIPVNYKQLPESVSPGSLIYLSDGFIQLLCLEISGKDVVCEVMVGGQLYSHKGLNLPGAKIYLDSVTEHDFKILEFALNEEVDAVSISFVEKAEDIRKVRNFASTMGKPVYVVSKIERSQAVQNIEEILEETDALMVARGDLGVEIPIQEVPSVQKELIRSAKLLSIPVITATHMLASMTDNIRPTRAEATDVANAILDGTDAVMLSEETAVGNYPVETVEMMAKIAKTTENWRSRTKWGLDTMLKGITAQKMSVDEVIALQVHEALQKLPVAVVLTPTRSGATPRRLSRFKPEPWILAFTRFPKTCSSLALSYGVYPIIVKEVSENWETETTEKAKELGFAKSGELVVFTQGPASGKPGGTNMLKILTLD

SEQ ID NO: 14621 - protein, 291 aa, Methanosarcina acetivorans C2A
MFLPNSFIDALADYESARYVIFGVPFDNTSSYRAGSRWAPDAMRQVSANFESYNPTFDIDLVDLPIYDAGNLETSASVDETLRDLYEDVKGLLNDGKLPIMLGGEHSLTYSTVKACAEFAGDDFGVLILDAHFDLRQEYRGFKHNHACVSRNILEQVTKNLVSIGIRSGPEEEWVFARENNLKYYTADDVESTGMVEVLKEAIEWLNCSQLYLSLDMDAIDPAYAPGLGTPEPFGLSARDVRTAIRTLAPFSMAFDIVEIAPEYDSGQTAMLGAKLMREFIASHAKSCTKI

SEQ ID NO: 14622 - protein, 450 aa, Methanosarcina acetivorans C2A
MEKEYDIIILGTGTAGRTLAGRAKSSGLKFAIIDSREYGGTCPLRGCDPKKVLAGASEATDWNNRLIGKGAGTEKPLEINWSSLIEFKRTFTRDYPRETEKMFADMGIDMYHGRANFENENTILVGKDKLKGKYIFLATGSKPRKLNIPGEEYLITSEEFMETEKFPEKIIFVGGGYVSFEFAHIALRAGAEVLILHRSEKPLRDFDSEMADLLVRASEAAGMRILTDRPVVAVEREGDRFLVRAEYKTETGSETQTFNADMVVNGAGRTPDIEDLRLENAGITAEKKGIIVDKHMQTSNPRVYAGGDCTAEGMQLTPVATLQGEIAAANIFDENRAEIDYTGIPSAVFTIPVLASVGITEAKVNDKHRVIFRDRSKWSTTRRAGLEFAASKIIVDETNDHIVGAHILGPNAEEAINIFATAMQLGLRASSIKKMAFTYPTTCSDIRYML

SEQ ID NO: 14623 - protein, 479 aa, Methanosarcina acetivorans C2A
MVAMKMQINGKAVEACGGEVFGIKNPATGELIEQVPRGTEEDVAVAVEAASSAFTGWASASPQQRGEVLYRAAEIVRQRKDELASLLTQEQGKPIVEARNEIEGFAHVLEYYCGLSGSQRGDFIPVPGNGYAFTVKKPLGVCAAIIPWNMPALIMGWKIAPVLISGNTLVLKPASNTPLTNLTLASIFVEAGLPAGVLNVVTGPGETVGESLVRSPEVRKISFTGEARTGKRVAELAACGMKRITLELGGSDPMLVCDDADLESAAAGALRGRFYNCGQTCTAVKRLYVFESVAEEFIKKLETGIKSLRLGNGMDKNISMGPLNNRTQWEYIKELAAEIEEKDAGRIITGGKVPEFKDSEKGYFFEPTLVSDVPGDSRLLKEEVFGPLLPVVTVKNLDEAIVGANSTCYGLGASIWTKNIDRARKGCEQLNAGIIWINQHLKVAPEVPFGGVKESGFGRENGPESLSEYLETKTIMLKI

SEQ ID NO: 14624 - protein, 469 aa, Methanosarcina acetivorans C2A
MLKNVQKLGKFLIIICMIFIALSSPAFAATAEENAVAIEGVQTALTFVWLLLASGLVFFMHAGFSLVETGLTRSKNTANILMKNFMTIVLGILIYWAVGWGVMYGADAAGLIGTDQFFLSGADNALWNGWFFQMVFAATGATIVSGAMAERTNFKAYLIYCIMMVAVIYPVYGHWVWSGADLALLTGADSPIVQAIGVPSHDFAGSGVVHSIGGYSALAGVLLVGARIGKFKDGKAVPIPGHNLTIAFLGTLILALGWIGFNGGSTLDGNDPYMNLVVVNTFLAAAAGAVVTMLITWMKTGKPDPSLTANGLLGGLVAITAPCGSVNNWAAIIIGAIAGIIIYAGVMFNENTLKVDDPVGAIAVHGYCGSWGLISVGLFSIGIGNGILADAAYAAEVPGLFYGGGISLLLIQLISVLCSIVWAFGISFIIFKILDAVVGLRVSEEEEIMGLDICEHGIRAYPEYLMREE

SEQ ID NO: 14625 - protein, 447 aa, Methanosarcina acetivorans C2A
MVQMKKCTTKEDVLEAVKERDVKFIRTQFTDTLGIIKSWAIPAEQLEEAFENGVMFDGSSIQGFTRIEESDMKLVLDPSTFRILPWRPATGAVARILGDVYLPDGKPFQGDPRYVLKTAISEAEKMGFSMNVGPELEFFLFKLDANGNPTTELTDQGGYFDFAPLDRAQDVRRDIDYALEHMGFQIEASHHEVAPSQHEIDFRFSDVLNTADNVVTFKYVVKSIAYHKGYYATFMPKPLFGENGSGMHSNQSLFKNGKNAFYDPDTPMQLSQDAMYYIGGLMSHIKEFTAITNPVINSYKRLVPGYEAPIYITWSSKNRSSLIRIPATRGEGTRVELRCPDPSCNPYLAFALMLRAGLDGIKSKIDPGEATNVNIFHLTEKERAERSIHSLPGDLKEAIDEMKGSQFVKEVLGEHVFSHYLCAKEMEWDEYKAIVHPWELEKYLPML

SEQ ID NO: 14626 - protein, 412 aa, Methanosarcina acetivorans C2A
MGHGYYNMRCKILKIQNKVTALLSLLLFISVLVTFTFLATAKSIEIININEFNTGEFNDNEWLEENINLSANEKIELGSYAISYSRNFQENGTGFIELVTFDKKVGFESSEKFYQLRSFSGSKEIRELKDKIIFLNSSIAISVNDTGLGKLKLKVWSKKDLFSEINMSTTAPEFLLISQSETVNIPLKINNNGCIGETVCLEASESEFYTHKFTYGDYRINKIKLNPKETKDVNIELRIDKDCTPGEYNFSVNASGRSSAVLIFPFIVEENSSKSIEKLAIQLSKIYVSGKSGSEIVIPVRIFNSGDVDLKDIGLDIKSPMDSWEIHVSEKKIDLIKSKEYETVDLTIRIPSETENGDYFVDLKGVADNVETEETKLRVNVKSQSNSAWIGIIIIVLVIAGLFFVFKKYGRR

SEQ ID NO: 14627 - protein, 263 aa, Methanosarcina acetivorans C2A
MINAAVLGACGRMGSLIIENITCSTDMQLVAAFDIGSIGKDAGEFAHVSNLGIQISDVKDLETVLKKTQADVLIDFTAAGATIVNAPIAAGCGVNLIIGTTGLTPEQRKVIDETIQKNKVRAVISPNYSVGVNVFFKIVREAAKYLSDYDIEIIEAHHNQKKDAPSGTALRAADVISEALGGKEYVCGREGIAPRGKEIGIHAVRGGDITGDHTVLFVGNSERIEIRHMAHSRQIFAKGAVRAAEWICKQEPGIYSMDDVLGL

SEQ ID NO: 14628 - protein, 488 aa, Methanosarcina acetivorans C2A
MGSDFSVKDAAGKIMQPAAEVQEEVPGKGPIHVRTEKEITRVVIIGGGACGMAAATKIRRQSDFKITVLSSDSHTAYSHCGIPFVLGREIENFEKLIVKPPGFFREKNIDVKLNEKVMSINLAKRVVLTGKGTYPYDKLVIATGSLPFIPRKSKANILPYGIFTLRSLADGKLFGKALETAQTVCIIGGGIIGIECASALTKRGIKTILITRSKDLLSSQFDSDMAAIVRAHLEALGVRVITGEPLFLPENFWKEKTVYIKDRHFPADLMLLATGVKPEVCLASEAGIDTGKAGGIVVNEMLQVKAGGEFLPNVYAGGECAEVTDLLTGESRLSPLGTTARRMADVIGNNITDKYSTFGPLADPWVAVAGDLQFGGVGLTPEQVKRQGIKVVSGFSRGRTRASYYPGRKDIYIKLFFKDGCLAGAQLAGGEGIKERIDALSLAIRKKTTIKDLLNLETCYAPPVSMLVDPLTPAVKAAVRNIRKAKTE

SEQ ID NO: 14629 - protein, 506 aa, Brassica oleracea
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPRDRRRSKYELVHTVRTHTGADDKSFRCVQQGDDENGKTGVSLSKDITDVAGRTVKKNIATLGPLILPLSEKLLFFVTFMGKKLFKDKIKHYYVPDFKLAIDHFCIHAGGKAVIDVLEKNLGLAPIDVEASRSTLHRFGNTSSSSIWYELAYIEAKGRMKKGNKVWQIALGSGFKCNSAVWVALNNVKASTNSPWEHCIDRYPVKIDSDSGKSETRAQNGRS

SEQ ID NO: 14630 - protein, 506 aa, Brassica rapa
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVSPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPGDRRRSKYELVHTVRTHTGADDKSFRCVQQGDDENGKTGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNSPWEHCIDRYPVKIDSDSGKSETRVQNGRS

SEQ ID NO: 14631 - protein, 263 aa, Nicotiana tabacum
KNMKIKLSRELIVTSNKTIDGRGFNVHIQNGAGIKIQCASNIIISNLRIHNIVPTPGGLLRESEDHVGLRSGDEGDGISIFDSRDIWIDHISMSRATDGLIDAVAASTNITISNCHFTDHEKVMLFGANDNYVLDKDMKITLAYNHFGKRLDQRMPRCRFGFFHLVNNDYTHWERYAIGGSSGATIISQGNRFIAEDELLVKEVTYREKLTASVAEWMKWTWISDGDDMENGATFTPSGDQNLLDKIDHLNLIKPEPSSKVGI

SEQ ID NO: 14632 - protein, 108 aa, Oryza sativa (indica cultivar-group)
DDDVVVACVVKAADAAAEGTFVKFLCSYGGRILPRHADGALRYVGGDNRVVSVDRSLPFHELQRKLREMCGWEAVCLRCQLPTEDLDALVSVTGDDDLANLLEEYDAA

SEQ ID NO: 14633 - protein, 205 aa, Olea europaea
SGGVTSMDDFLKKFFPAIYERKLHAKENNYCKYDDQLLQLFTSSLYLAALVASFGASKACNVLGRKPTIGLASILFILGAIASGIAPNKALLIIGRILFGFGVGFGNESVPLFLSEVAPMQHRGAVNILFQLFVTIGILIANLVNYAVSSIHPNGWRIALGLAGVPAIFLFIGSLIITETPSSLIERGKEFEGKEVLRKIRGVDD

SEQ ID NO: 14634 - protein, 290 aa, Juglans nigra x Juglans regia
MDQYEKVEKIGEGTYGVVYKARNRKTNQTLALKKIRLEQEDEGVPSTAIREISLLKEMQHGNIVKLQDVVHGEKRLYLVFEYLDLDLKKHMDSSPEFANDLRQIKMFLHQILRGIAYCHSHRVLHRDLKPQNLLIDRRSNSLKLADFGLARAFGIPVRTFTHEVVTLWYRAPEILLGSRHYSTPVDVWSVGCIFAEMVNQRPLFPGDSEIDELFKIFRVLGTPNEDTWPGVTSLPDYKGAFPKWPPKDLAAVVSSLDSTGVDLLSKMLSLDPSRRITARTALEHEYFKDI

SEQ ID NO: 14635 - protein, 168 aa, Atropa belladonna
MPRSRINGNFIDQTFSIVANILLRVIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAIQQGDSEIAEAWFDQAAEYWKQAIALTPGNYIEAHNWLKITRRFE

SEQ ID NO: 14636 - protein, 504 aa, Atropa belladonna
MTIHLLYFHANRGQENSMERWWFNSMLFKKEFERRCGLNKSMGSLGPIENTSEDPNRKVKNIHSCSNVDYLFGVKDIRNFISDDTFLVSDRNGDSYSIYFDIENQIFEIDNDHSFLSELESSFYSYRNSSYLNNGFRGEDPYYNSYMYDTQYSWNNHINSCIDNYLQSQICIDTSIISGSENYGDSYIYRTICGGESRNSSENEGSSKRTRTKGSDLTIRESSNDLEVTQKYRHLWVQCENCYGLNYKKFLKSKMNICEQCGYHLKMSSSDRIELLIDAGTWDPMDEDMVSLDPIEFHSEEEPYKDRIDSYQRKTGLTEAVQTGIGQLNGIPVAIGVMDFQFMGGSMGSVVGEKITRLIEHAANQILPLIIVCASGGARMQEGSLSLMQMAKISSALYDYQLNKKLFYVSILTSPTTGGVTASFGMLGDIIIAEPNAYIAFAGKRVIEQTLNKTVPEGSQAAEYLFQKGLFDQIVPRNLLKSVLSELFKLHAFFPLNQKSSKIK

SEQ ID NO: 14637 - protein, 492 aa, Gluconacetobacter xylinus
MTFMTATDVTVPNPETALPPITPIVLSGGTGTRLWPVSRASHPKQFWALASKQTMIGETLQRAMGEAFAPPIVVCNQAHRFLVAEQLRENGCENGRIILEPAVRNTAAAIAAAALVAAQDNPETLLWIMAADAAFRYPERLPAVLEKAAKVAREGYIVTFGMKPDVAETGYGYIRTGAPLHPDQPDEGVYRVTQFIEKPDHLRATEMLREGGYLWNSGMFMAPASVMLDELARHEPEVLENVRTALARSQHDLTFRRLEAESFLRCPNVSIDYAVMERTDRAMVIPADLGWSDVGNWNALWELGDKDAGGNVVVGDVVLEQSHNCYVRSEGMLTAVAGLTDIVLVVTTDAVLAIHRDYAQDVSALVAQLKKASRTEAEIHNRCYRPWGFYEGLIQGERFQVKRIVVYPGQKLSLQKHFHRAEHWVVVSGTALVTRDDENLLIQENESVYLPLGCMHRLENPGRIPLTLIEVQSGPYLGEDDIVRFEDTYGRQ

SEQ ID NO: 14638 - protein, 246 aa, Cathaya argyrophylla
YTYTLRNTEPEDVIIRVIYCGICHSDLVQMHNEVGMSRYPMVPGHEVVGMVTEIGSEVKKFKVGEHVGVGCIVGSCRSCPNCKESMEQYCNKRIWTYNDVNPDGTATQGGFASSMVVNQMFVVRIPENLPLEQAALLLCAGVTVYSPMKHFGMTEPGKRCGILGLGGVGHMGVKIAKAFGLHVTVISSSDKKKEEALEVLHADAYLVSKDTEKMREAAESLDYILDTIPVGHPLEPYLALLKTNGK

SEQ ID NO: 14639 - protein, 246 aa, Pinus banksiana
YTYNLRKKGPEDVIVKVIYCGICHSDLVQMRNEMGMSHYPMVPGHEVVGIVTEIGSEVKKFKVGEHVGVGCIVGSCRSCGNCNQSMEQYCSKRIWTYNDVNHDGTPTQGGFASSMVVDQMFVVRIPENLLLEQAAPLLCAGVTVFSPMKHFGMTEPGKKCGILGLGGVGHMGVKIAKAFGLHVTVISSSDKKKEEAMEVLGADAYLVSKDTEKMMEAAESLDYIMDTIPVAHPLEPYLALLKTNGK

SEQ ID NO: 14640 - protein, 245 aa, Pinus armandii
YTYSLRKKGPEDVIVKVIYCGICHSDLVQMRNEMGMSNYPMVPGHEVVGMVTELGSEVKKFKVGDHVGVGCIVGSCRSCGNCNQSMEQYCSKRIWTYNDVNHDGTPTQGGFASSMVVDQMFVVRIPENLPLEQAAPLLCAGVTVFSPMKHFGMTEPGKRCGILGLGGVGHMGVKIAKAFGLHVTVISSSDKKKEEAMEVLGADAYLVSKDAEKMMEAAESLDYIMDTIPVAHPLEPYLALLKTNG

SEQ ID NO: 14641 - protein, 246 aa, Pinus armandii
YTYSLRKKGPEDVIVKVIYCGICHSDLVQMRNEMGMSNYPMVPGHEVVGMVTELGSEVKKFKVGDHVGVGCIVGSCRSCGNCNQSMEQYCSKRIWTYNDVNHDGTPTQGGFASSMVVDQMFVVRIPENLPLEQAAPLLCAGVTVFSPMKHFGMTEPGKRCGILGLGGVGHMGVKIAKAFGLHVTVISSSDKKKEEAMEVLGADAYLVSKDAEKMMEAAESLDYIMDTIPVAHPLEPYLALLKTNGK

SEQ ID NO: 14642 - protein, 246 aa, Picea smithiana
YTYTLRNKGPEDVIVRVIYCGICHSDLVQMHNEMGMSNYPMVPGHEVVGVVTEIGSEVKKFKVGEHVGVGCIVGSCRSCSNCNGSMEQYCSKRIWTYNDVNHDGTPTQGGFASSMVVDQMFVVRIPENLPLEQAALLLCAGVTVYSPMKHFGMTEPGKKCGILGLGGVGHMGVKIAKAFGLHVTVISSSDKKKEEALEVLGADAYLVSKDAEKMQEAAESLDYIMDTIPVAHPLEPYLALLKTNGK

SEQ ID NO: 14643 - protein, 246 aa, Cedrus atlantica
YTFTLRKKGPEDVILRVIYCGICHSDLVQMHNEVGMSRYPMVPGHEVVGIVTEIGSEVKKFKVGDHVGVGCIVGSCRSCGNCNDSMEQYCSKRIWTYNDVNHDGTTTQGGFASTMVVDQMFVVRIPENLSLEQAAPLLCAGVTVYSPMKHFGMTEPGKKCGILGLGGVGHMGVKIAKAFGLHVTVISSSDKKKEEALEVLGADAYLVSKDAEKMQEAAESLDYILDTIPVGHPLEPYLSLLKTNGK

SEQ ID NO: 14644 - protein, 246 aa, Pseudotsuga menziesii
YTYILRNIGPEGVLLRVIYCGICHSDLVQMRNEMGMSNYPMVPGHEVVGIVTEIGSEVKKFKVGEHVGVGCIVGSCRSCGNCNQSMEQYCSKRIWTYNDVNHDGTTTQGGFASTMVVDQMFVVRIPENLPLEQAAPLLCAGVTVFSPMKHFGMTEPGKKCGILGLGGVGHMGVKIAKAFGLHVTVISSSDKKKEEALEVLHADAYLVSRDAEKMMEAAESLDYILDTIPVSHPLEPYLALLKTNGK

SEQ ID NO: 14645 - protein, 246 aa, Pseudotsuga menziesii
YTYILRNIGPEGVLLRVIYCGICHSDLVQMRNEMGMSNYPMVPGHEVVGIVTEIGSEVKKFKVGERVGVGCIVGSCRSCGNCNQSMEQYCSKRIWTYNDVNHDGTTTQGGFASTMVVDQMFVVRIPENLPREQAAPLLCAGVTVFSPMKHFGMTEPGKKCGILGLGGVGHMGVKIAKAFGLHVTVISSSDKKKEEALEALHADAYLVSRDAEKMMEAAESLDYILDTIPVSHPLEPYLALLKTNGK

SEQ ID NO: 14646 - protein, 246 aa, Larix gmelinii
YTYTLRNKGPEDVIVRVIYCGICHSDLVQMRNEMGMSHYPMVPGHEVVGIVTEVGSEVKKFKVGEHVGVGCIVGSCRSCGNCNQSMEQYCSKRIWTYNDVNHDGTPTQGGFASTMVVDQMFVVRIPENLPLEQAAPLLCAGATVFSPMKHFGMTEPGKKCGILGLGGVGHMGVKIAKAFGLHVTVISSSDRKKEEALEVLHADAYLVSKDAEKMMEAAESLDYILDTIPVSHPLEPYLALLKTNGK

SEQ ID NO: 14647 - protein, 246 aa, Larix gmelinii
YTYTLRNKGPEDVIVRVIYCGICHSDLVQMRNEMGMSHYPMVPGHEVVGIVTEVGSEVKKFKVGEHVGVGCIVGSCRSCGNCNQSMEQYCSKRIWTYNDVNHDGTPTQGGFASTMVVDQLFVVRIPENLPLEQAAPLLCAGVTVFSPMKHFGMTEPGKKCGILGLGGVGHMGVKIAKAFGLHVTVISSSDRKKEEALEVLHADAYLVSKDAEKMMEAAESLDYILDTIPVSHPLEPYLALLKTNGK

SEQ ID NO: 14648 - protein, 246 aa, Larix gmelinii
YTYTLRNKGPEDVIVRVIYCGICHSDLVQMRNEMGMSHYPMVPGHEVVGIVTEVGSEVKKFKVGEHVGVGCIVGSCRSCGNCNQSMEQYCSKRIWTYNDVNHDGTPTQGGFASTMVVDQMFVVRIPENLPLEQAAPLLCAGVTVFSPMKHFGMTEPGKKCGILGLGGVGHMGVKIAKAFGLHVTVISSSDRKKEEALEVLHADAYLVSKDAEKMMEAAESLDYILDTIPVSHPLEPYLALLKTNGK

SEQ ID NO: 14649 - protein, 246 aa, Keteleeria evelyniana
YTYTLRKKGPEDVILRVLYCGICHSDLVHMHNEFGMSRYPLVPGHEVVGIVTEIGSEVKKFKVGEHVGVGFIVGSCRTCGHCNESMEQYCSKKIWSYDDVNHDGTPTQGGFASTMVVDQMFVVRIPENLSLEQAAPLLCAGVTVYSPMKHFGMTEAGKRCGILGLGGVGHMGVKIAKAFGLHVTVISSSDEKKEEALEVLGADAYLVSKDAEKIKEAAESLDYIMDTIPVAHPLDPYLSLLKTNGK

SEQ ID NO: 14650 - protein, 246 aa, Keteleeria evelyniana
YTYTLRKKGPEDVILRVLYCGICHSDLVHMHNEFGMSRYPLVPGHEVVGIVTEIGSEVKKFKVGEHVGVGCIVGSCRSCGNCNQSMEQYCSKRIWTYNDVNHDGTPTQGGFASTMVVDQMFVVRIPENLPLEQAAPLLCAGVTVFSPMKHFGMTEPGKKCGILGLGGVGHMGVKIAKAFGLHVTVISSSDKKKEEALEVLGADAYLVSKDAEKMQEAAESLDYIMDTIPVAHPLDPYLSLLKTNGK

SEQ ID NO: 14651 - protein, 246 aa, Tsuga canadensis
YTYNLRNKGPEDVIVRVIYCGICHSDLIQMRNEMGMSHYPMVPGHEVVGIVTELGSEVKKFKVGEHVGVGCIVGSCRKCGNCNESMEQYCSKRIWTYNDVNHDGTPTQGGFASSMVVDQMFVVRIPENLPLEQAAPLLCAGVTVYSPMKHFGMTEAGKRCGILGLGGVGHMGVKIAKAFGLHVTAISSSDKKKEEALEVLHADAYLVSKDAEKMQEAAESLDYILDTIPVAHPLEPYLSLLKTNGK

SEQ ID NO: 14652 - protein, 246 aa, Tsuga canadensis
YTYNLRNKGPEDVIVRVIYCGICHSDLIQMRNEMGMSHYPMVPGHEVVGIVTELGSEVKKFKVGEHVGVGCIVGSCRKCGNCNESMEQYCSKRIWTYNDVNHDGTPTQGGFASSMVVDQMFVVRIPENLPLEQAAPLLCAGVTVYSPMKHFGMTEAGKRCGILGLGGVGHMGVKIAKAFGLHVTVISSSDKKKEEALEVLHADAYLVSKDAEKMQEAAESLDYILDTIPVAHPLEPYLSLLKTNGK

SEQ ID NO: 14653 - protein, 227 aa, Tsuga canadensis
NKGPEDVIVRVIYCGICHSDLIQMRNEMGMSHYPMVPGHEVVGIVTELGSEVKKFKVGEHVGVGCIVGSCRKCGNCNESMEQYCSKRIWTYNDVNHDGTPTQGGFASSMVVDQMFVVRIPENLPLEQAAPLLCAGVTVYSPMKHFGMTEAGKRCGILGLGGVGHMGVKIAKAFGLHVTVISSSDKKKEEALEVLHADAYLVSKDAEKMQEAAESLDYILDTIPVAHP

SEQ ID NO: 14654 - protein, 227 aa, Tsuga canadensis
NTGPEDVIIRVIYCGICHSDIFHTRNKMGLSHYPMVPGHEVVGIVTEIGSEVKKFKVGEHVGVGCIVGSCRICGNCNDSMEQYCKNMIWSYNDVNHDGTPTQGGFASTMVVDQMFVVRIPENLSLEQAAPLLCAGVTVYSPMKHFGMTEAGKRCGILGLGGLGHMGVKIAKAFGLHVTVISSSDKKKEEALEVLRADAYLVSKDAEKMQEAAESLDYILDTIPVAHP

SEQ ID NO: 14655 - protein, 246 aa, Tsuga mertensiana
YTYNLRNKGPEDVIVRVIYCGICHSDLIQVRNEMGMSHYPMVPGHEVVGIVTELGSEVKKFKVGEHVGVGCIVGSCRKCGNCNESMEQYCSKRIWTYNDVNHDGTPTQGGFASSMVVDQMFVVRIPENLPLEQAAPLLCAGVTVYSPMKHFGMTEAGKRCGILGLGGVGHMGVKIAKAFGLHVTVISSSDKKKEEALEVLHADAYLVSKDAEKMQEAAESLDYILDTIPVAHPLEPYLSLLKTNGK

SEQ ID NO: 14656 - protein, 245 aa, Tsuga mertensiana
YTYNLRNKGPEDVIVRVIYCGICHSDLIQMRNEMGTSHYPMVPGHEVVGIVTELGSEVKKFKVGEHVGVGCIVGSCRKRGNCNESMEQYCSKRIWTYNDVNHDGTPTQGGFASSMVVDQMFVVRIPENLPLEQAAPLLCAGVTVYSPMKHFGMTEAGKRCGILGLGGVGHMGVKITKAFGLHVTVISSSDKKKEEALEVLHADAYLVSKDAEKMQEAAESLDYILDTIPVAHPLEPYLSLLKTNG

SEQ ID NO: 14657 - protein, 227 aa, Tsuga mertensiana
NTGLEDVIIRVIYCGICHSDIFHTRNKMGLSHYPMVPGHEVVGIVTEIGSEVKKFKVGEHVGVGCIVGSCRICGNCNDSMEQYCKNMIWSYNDVNHDGTPTQGGFASTMVVDQMFVVRIPENLSLEQAAPLLCAGVTVYSPMKHFGMTEAGKRCGILGLGGLGHMGVKIAKAFGLHVTVISSSDKKKEEALEVLRADAYLVSKDAEKMQEAADSLDYILDTIPVAHP

SEQ ID NO: 14658 - protein, 228 aa, Tsuga mertensiana
NTGPEDVIIRVIYCGICHSDIFHTRNKMGLSHYPMVPGHEVVGIVTEIGSEVKKFKVGEHVGVGCIVGSCRICGNCNDSMEQYCKNMIWSYNDVNHDGTPTQGGFASTMVVDQMFVVRIPENLSLEQAAPLLCAGVTVYSPMKHFGMTEAGKRCGILGLGGLGHMGVKIAKAFGLHVTVISSSDKKKEEALEVLRADAYLVSKDAEKMQEAAESLDYILDTIPVAHPL

SEQ ID NO: 14659 - protein, 227 aa, Nothotsuga longibracteata
NKGPEDVIVRVIYCGICHSDLIQMRNEMGMSHYPMVPGHEVVGIVTELGSEVKKFKVGEHVGVGCIVGSCRKCGNCNESMEQYCSKRIWTYNDVNHDGTPTQGGFASSMVVDQMFVVRIPENLPLEQAAPLLCAGVTVYSPLKHFGMTEAGKKCGILGLGGVGHMGVKIAKAFGLHVTVISSSDKKKEEALEVLHADAYLVSKDAEKMQEAAESLDYILDTIPVAHP

SEQ ID NO: 14660 - protein, 230 aa, Nothotsuga longibracteata
NTGPEDVIIRVIYCGICHSDIFHTRNKMGLSHYPMVPGHEVVGIVTEIGSEVKKFKVGEHVGVGCIVGSCRICGNCNESMEQYCKNMIWSYNDVNHDGTPTQGGFASTMIVDQMFVVRIPENLSLEQAAPLLCAGVTVYSPMKHFGLTEAGKRCGILGLGGLGHMGVKIAKAFGLHVTVISSNDKKKEEALEVLHADTYLVSKDAEKMQEAAESLDYILDTIPVAHPLEP

SEQ ID NO: 14661 - protein, 244 aa, Nothotsuga longibracteata
TYTLRKKGPEDVIIRVIYCGICHSDLSAMRNEMGMSHYPMVPGHEVVGIVTEIGSEVKKFKVGEHVGVGFIVGSCRNCSNCNESNEQYCNKKIWSYNDVNPDGTPTQGGFASTMVVDQMYVVRIPENLSLEQAAPLLCAGVTVYSPMKHFGMTEIGKRCGILGLGGVGHMGVKIAKAFGLHVTVISSSDKKKEEALEVLGADAYLVSKDAEKMQEAAESLDYILDTIPVAHPLEPCLSLLKTNG

SEQ ID NO: 14662 - protein, 240 aa, Pseudolarix amabilis
YTYTLGNKGPEDVIVRVIYCGICHSDLVQMRNEMGMSHYPMVPGHEVVGIVTELGSEVKKFKVGEHVGVGCIVGSCRKCGNCNESMEQYCSKRIWTYNDVNHDGTPTQGGFASTMVVDQMFVVRIPANIPLEQAAPLLCAGVTVYGPLKHFGMTESGKRCGILGLGGVGHMGVKIAKAFGLHVTVISSSDKKKEEALEVLRADAYLVSKDAEKMQEAAESLDFIMDTIPVAHPLEPYLAL

SEQ ID NO: 14663 - protein, 237 aa, Abies firma
YTYNLRNKGPEDVILRVIYCGICHSDLVQMRNEMGMSNYPMVPGHEVVGIVTEIGSEVKKFKVGEQVGVGCIVGSCRKCGNCNESMEQYCSKRIWTYNDVNHDGTPTQGGFASTMVVDQMFVVRIPDNLPLEQAAPLLCAGVTVYSPLKHFGMTESGKRCGILGLGGVGHMGVKIAKAFGLHVTVISSSDKKKEEALEVLGADAYLVSKDAEKMQEAAESLDFIMDTIPVAHPLEPY

SEQ ID NO: 14664 - protein, 237 aa, Abies beshanzuensis
YTYNLRNKGPEDVILRVIYCGICHSDLVQMRNEMGMSHYPMVPGHEVVGIVTEIGSEVKKFKVGEQVGVGCIVGSCRKCGNCNESMEQYCSKRIWTYNDVNHDGTPTQGGFASTMVVDQMFVVRIPDNLPLEQAAPLLCAGVTVYSPLKHFGMTESGKRCGILGLGGVGHMGVKIAKAFGLHVTVISSSDKKKEEALEVLGADAYLVSKDAEKMQEAAESLDFIMDTIPVAHPLEPY

SEQ ID NO: 14665 - protein, 221 aa, Abies holophylla
YTYNLRNKGPEDVILRVIYCGICHSDLVQMRNEMGMSNYPMVPGHEVVGIVTEIGSEVKKFKVGEQVGVGCIVGSCRKCGNCNESMEQYCSKRIWTYNDVNHDGTPTQGGFASTMVVDQMFVVRIPDNLPLEQAAPLLCAGVTVYSPLKHFGMTESGKRCGILGLGGVGHMGVKIAKAFGLHVTVISSSDKKKEEALEVLGADAYLVSKDAEKMQEAAESL

SEQ ID NO: 14666 - protein, 231 aa, Abies holophylla
RNKGPEDVILRVIYCGICHTNLVEMRNKMGTSHYPMVPGHEVVGIVTEMGSEVKKFKVGEHVGVGRIVGSCGKCCNCNESMEQYCSKRIWTYNDVYHDGSRTQGGFASTMVVDQRFVVRIPENLPLEQAAPLLCAGVTVYSPMKHFGMTEAGKRCGILGLGGLGHMGVKFAKAFGLHVTVISSSDKKKEEALEILGADAYLVTEDAEKMQEAAESLDFIIDTIPVTHPLEP

SEQ ID NO: 14667 - protein, 245 aa, Metasequoia glyptostroboides
YTYNLRNKGPEDVIVRVIYCGICHSDLIQMRNEMGMSHYPMVPGHEVVGIVTELGSEVKKFKVGEHVGVGCIVGSCRKCGNCNESMEQYCSKRIWTYNDVNHGGTPTQGGFASSMVVDQMFVVRIPENLPLEQAAPLLCAGVTVYSPMKHFGMTEAGKRCGILGLGGVGHMGVKIAKAFGLHVTVISSSDKKKEEALEVLHADAYLVSKDAEKMQEAAESLDYILDTIPVAHPLEPYLSLLKTNG

SEQ ID NO: 14668 - protein, 431 aa, Methanopyrus kandleri AV19
MAAESIAKAVHDVLATWGAQGPGAIFFLVWAAVLVVGMQLGFMFLEAGQVRTKNVVSVLMKNLLDLSLGGIVFIFFGFALAFPDYAQSIGKWIATMFTANPWSADPMKAADPYNLAYCFFQFAFCATAATIVSGAVAERINFKACLVMTVLITGLLYPIFVLWTWGGGWMGGDTGLFAKVFGQPYHDFAGSTVVHAIGGFLAMAAAYLLGPRIGRFKNGKPVPIPGHNIPQAFLGALFLAITWYGFNVGSSAVLYDPTNESWISSLVATLAMCGGAAAAAFTTRFDPLWAANGLIAGLVAICAGCDIMSPFGALLTGIVAGLIIKPAFRLLEKLEIDDVVAACPVHGFAGVWGAIAAGIFGAEALGGAGGVSLAAQIVGALVCIAWALGSGFATFYVIDKVIGLRATEEEEKGLDETEFGVSAYPYMETRD

SEQ ID NO: 14669 - protein, 270 aa, Methanopyrus kandleri AV19
MISYLGPPGTFTEEAAERFSEEELGGNGKLQSARTITAVFSRVERGEADYGVVPWENSLEGSVGETLDNFLHRSVRVFGELVLPIVHALMSGSEPDDREPVVYSHPQAYEQARETLRELLGNHEFVPTASTAEAAKLASKEGAYALGPPRLAERFGLDIMEEIRLENNETRFAIISRRDRAPTKEDKTSVVFSVTDRPGALREILGIFADRGINLTKIESRPAKRGLGDYVFFLDFEGHRMLYPGSEALAELRERTPFSKVLGSYPKVFP

SEQ ID NO: 14670 - protein, 430 aa, Methanopyrus kandleri AV19
MGYEDEFPESLELFKRAERVMPGGVSSPVRRFDPYPFYVERAEGSRLYTVDGHVLIDYCLAFGPLILGHAHPEVVEAVVERVREGFHYGTPTLPELKLAEKVVELVPNVEKVRLVNTGTEATMSAIRLARAYTGREKIVKFEGCYHGAHDAVLVRAGSGASELGAPDSPGIPESVAENTLVCPFNDVEAFVETVERFDEEIGAVIVEPVLGNAGCVPPDEEFLKVLREYCDGTERLLIFDEVITGFRLELGGAQEYYGIDADLVCLGKILGGGLPIGAFGGPEEYMSRVAPEGKVYQAGTFNGNPVSATAGLVTLEVLERERPYDELSSKAERLASALEDGLEDRGIEGVVNRVESMFQVYFGIEEVRDYADVNSADHDAFKRFHRELLEHGVWIAASNYEAWFLSIAHTETDLERTEEAFEEALDRLTG

SEQ ID NO: 14671 - protein, 252 aa, Methanopyrus kandleri AV19
MPGRGCAHDEDPGHGPVHEDALRKLEELGEVVLEDADEEGLRRHVRDADAWVVRSGTQVTRELIEEAENLKVIARAGVGVDNIDVEAATERGIVVVNAPESSSISVAEHTMSLMLVLARRIPQADRSVRRGEWDRKLFMGVELAGKVLGVIELGRIGRQVAKRTKAFEMEVIAFDPYISEEVAEGLDVELVEDLDELLRRADVVTIYVPLTDETQGMIGERELKLMKESAFLINCARGEVVDEEALVRACSC

SEQ ID NO: 14672 - protein, 491 aa, Methanopyrus kandleri AV19
MPRRLQNVYKVPGRGRHQLRIAGKSIPGVSPLADEVYTVDFKKRQKENEEKVEKVMEQVESKDVKFVRLQFVDIHGFVKNFAIPAERLEDALVEGVLFDGSSIDGFVDIEESDMIAMPDPDTFAVLPWRPREGKVARIICDVYWPEGKPFEGCPRLNLKRVMNELAEKGYMMYCGPECEFYLLKQDPETGEVEAHDEGGYFDFYPLDRAEDIRREIIFAMEEFGLEVEMSHHEVGPGQHEIDFKFADAVTTADNVISFKQIVKAIARKHGLIATFMPKPIYGENGNGMHVHQSLWDPEGKENLFYDPDAEDQYYLSDTALYYIGGIMEHAHALCAVCNPLVNSYKRLVPGYEAPVYIAWSPKNRSAFIRVPAARGKATRIEYRSPDPACNPYLAFAAMAVAGVDGIENKIDPGDPVNENLYEMSEEERKELGIEHLPENLRDALEAFKEDEVVQSAFTDHIVEQWLELKWEEWSEYRERVTKWEIKKFIVY

SEQ ID NO: 14673 - protein, 275 aa, Methanopyrus kandleri AV19
MSGLVLERIFEEAEGEGRGALIGYLTCGHPGLEETVSLARALRDGGVDILELGVPFSEPIADGPTIQKAVDEALRAGTTPWDCLEVAEEVSEFVPVVLLCYYNTLHANGFERYLSAAAEAGVSGIIVADMPVEESDEVHSVARDLEIDVIYLVAPSTTDERLKKIGERASGFVYVISRYGVTGARRDLSEDTLELVRWVRDHVDVPVAVGFGISERWHVEEVIAAGADGAIVGSAFIKEIHRSEDIAEAEERVRELAKELVEGARDGYRRRSSSE

SEQ ID NO: 14674 - protein, 420 aa, Methanopyrus kandleri AV19
MGVYVAENFTGVYAFDEEGNLIDHEPFPKDPDEIVERLLKRERGEVLEEEEALLSRLDADVINFEGTKADRERLEEVFDGELVVEFPNVAGEVLRERARELAVEVGVVDSEEEYSELVYEVGMKLSKEKVRATVEERDQMIIQAINTIDDIDRILNILTDRVREWYGIHFPEINKIVKKHDDFVTLVAELGHRKNFTYDNIKEVLPEFPDHLAEKLEEAAKDSMGAEMDEKDLAAVQRIAEVARELYEIRRKTADYIDESMDDVAPNVKALVGPLIGARLIALAGGLKEMAKLPASTIQLLGAEKALFRHLTKGTKPPKHGVIFQHPLIHRSPWWQRGKIARALAGKLAIAARIDAYSGEYRGDELRRQLEQRVKEIKEKYPKPPKRKRGGRPPRGRRPRRRRSPRRSRRDRRRRSRRRR

SEQ ID NO: 14675 - protein, 232 aa, Methanopyrus kandleri AV19
MVEIEIEPHEEFEGVYWAIFEDGRKKPATENLVPGHQVYGERLVEYDGKEYRVWEPRRSKLAAMIMNGMEYFPFEEGSKVLYLGAAAGTTPSHVSDIIKESGVEYCVEFASRMMQELIPVCEKRPNMIPILGDATKPHGYAPLVEQVDVIYQDIAQPKQAEVVADNAEAFLRPGGYVIVAIKARSIDVTKEPEEVFEDEERKLEERGFEVLEVIDLEPYERDHVGIVAEYHG

SEQ ID NO: 14676 - protein, 499 aa, Methanopyrus kandleri AV19
MFITSKEMRRIELNSRWLGFEEDFMMENAGAGVARVVIGEYSPNDVLVVCGTGGNGGDGFVTARHLDSEGVDVDVLLVGRREAIKNEAAELNLRRLDRAGIPVQEVRDSEDLESVDFERDVVVDALLGFGIRGRLREPVRSAVLRINEASRAGTRVVSIDIPTGLDPDSGETPDVAVEADLVVSIHRHKRGVRKLRDVFLRRVNAGIPEIAERICGPGDLITSDIWRRDPWSHKGQHGRVLIIGGSRKYVGAPQLAARGALRAGVDLVFLLTVDAVPKNDPNVIYRAVPAERLEPEHLDEVDLEGVDTVVVGPGLGADADSVGILRELAESFDGMIIVDADGLRGISGVNVDDRFVLTPHAGEFRREFGEELGRSLEDRSEAVRRVSEELGCTILLKGRVDVIGSPDGEIRWNVTGTPAMTVGGTGDVLAGVVAGVAARCREGFEAACIGAFVVGSAGCLAERRLSQGLTAEDVAEYVPKVLRNPWAAEPEAVTEVRRD

SEQ ID NO: 14677 - protein, 434 aa, Methanopyrus kandleri AV19
MDVVIGAGPAGRTYAMILAEAGHEVLLLDRNGKEGTGGKCLNEACVVLGALIEAARLVVWAKLGIPGVELDVGDINFRRLTRSVRKVVETIRQRLIKETERAGVEILRAEAVKVDESLNVYTKDGDVLEADRVLIATGSRPAIPEVEGVDSDAVFTFREILEMEVPSELCVVGGGPTALESAFAFAALGSEVVLAYRSRILPNAPEEVRREILKDLELVGVNAVRAGELRAIRETSSGVECRFERGATVADAVLLATGLEPNSDIAANSGLPLRKDGSVVVDDGMRTPRDGVYAAGDVTGPPYLTPVARYEGTVAALNALGKNVRRGNPPAPRVIRLFRDFGRLELRGIDWEGSLPTPVGGPAFWMLHHGIKGKMVCRKRGVTTEAFIVAPRIAPMLPYPRCVEPDWRLIEVHPTPDPVIGLLKQLGLRRTLGE

SEQ ID NO: 14678 - protein, 446 aa, Methanopyrus kandleri AV19
MRVVVVGGGAAGVVAARTAREHGADVVLISADEHIAYSPCAIPFVISGEIERPEDILMRDPTHYERLGIDVRLGVRVEEVDPEEKVVTTEDGDTVEYDSMVLATGGEPLVPPIEGSELDGVFTVRRFSDIEPLLRAVQESERAVIVGAGPIGVEMAYALHERGLEVTLVEMLDRVLPQFLDDDVAAIVQERMEKEGVRVLLGSPVEAIEGDDRVEAVVVNGEEIEADLVVMAAGVRPVTDLFESIGASVLPFGVEVDPALRVKREDGGVFDDIYAAGDCVADWCPITGERVPSQLGTVAVRQGKIAGKNAAGGPRATWMGTLNTAVIRVFDLEAAGAGLTQTRAEELGLEVVSATVETTTRARYYPGGEPIAVKLIADADTHRIVGVQSVGGERVRERVDGVALAIRLAAKVEDLLSWDYSYSPPVARVIEPIYEAAELLREELHS

SEQ ID NO: 14679 - protein, 352 aa, Methanopyrus kandleri AV19
MALVYHEEYLRHEQHPTHPERRERLSYTVDRFEEEGLFEIEGIDLVEPDPVDREVIELVHDPEHVELIRRMSESGGGMIDLDTAVAPETYDQALLAAGGSVLAVELVVRGEYDTAFAMVRPPGHHAGRAKAAGFCYFNNAAIAAEYAIRELGVDSVAILDWDAHHGDGTQEIFYDRDDVLYVSIHQDGRTLYPGTGFPYEAGEGPGEGYTVNIPVLPRSGDRTYREAFQRIVEPVVREFDPDLILISAGQDCHFTDPITDLAVTAEGYRWMMQRATELAEDLGASGPVAVLEGGYSVEDGLPYTNLGVVCGMAGVPADLREPMDPQEENPRGPEGVRKVAREHSRYWTSVKA

SEQ ID NO: 14680 - protein, 471 aa, Methanopyrus kandleri AV19
MEYGCLIGGEWLEGDREIVVENPYDGSEVGRVLAPEVDVEALLKDAREGQRRWRERPTYEVREALAEAAHLLKKHEDELAELIALEGGKPIRDARYEVYRTREVLRLSAAEAERLYGETLPGDAQRGRTAELILTVREPVGVVLSITPYNFPLLLPTHKLGPALAARCSVVHKPATVTPLSSLRLAEILLDAGVEPLALQVVVGPGAELGEELARADFDALSFTGSRSVGEHLREISPIPRITLELGGNDPVIVDETADVEAAAEAAVRGACYHAGQVCIAVERAIVVEDVYEEFLEAAVEVAESLKVGDPLDEDTDVGPLIDDGAVEKVRRHVEDAVERGAEILTGGEPEGRLFPPTVLADVPEDALVAREETFGPVLPVIRAKDFEEAIRIANSTDYGLHAAVFTERLDRAVKATRKLEAGGVIVNESTIYRADYMPFGGVKASGVGREGVPQAVREFTEEKTVVIGRR

SEQ ID NO: 14681 - protein, 394 aa, Methanopyrus kandleri AV19
MRLHVATEDEIRRGETADVYFRRIRKVLEEEGLADTEVVAEISTRSLPEGWEWGVLCGVEEALALLEGRDVTVYAMDEGEVFRPGQPVMRIEGPYVEFCELETALIGCLAKATGIATKAARCKVAAGGKPVYSFGIRRQHPAIAPMVDRAAYVGGCDGVSGIKGAELIGERPVGTMPHAFVLVFGDQRKAWRAFDEHVPEDVPRIALVDTMYDEVEEALMAAEELRERLDGVRLDTPSSRRGDMAEIVREVRWELDLRGYEHVKIMVSGGLDEGEIRRLAEVGADAFGVGTAISDAPAVDFAMDLVEIEGEPRSKRGKLSGAKQVWRCPNCLDDVVLPRGKEPSPCPECGSEREPLLRKFVEEGEVVREPKSPKEARRHVLETVGELEGLDLTE

SEQ ID NO: 14682 - protein, 141 aa, Methanopyrus kandleri AV19
MSHVPLDPETARKVTSSLNYRFEIGGEPLVIAIAQDAENGDVLMTAFANEEAVYRTLTTGYAHYWSTSRREVWKKGEESGHVQRVVEVRVDCDKDAVLYVVEQEGGACHTGYRSCFYRRVTRDGSFEVVMDRVFNPDEVYR

SEQ ID NO: 14683 - protein, 502 aa, Methanopyrus kandleri AV19
MVGRYTRKLEDAELALTFDDVLLLPERSSVEPADVDVSTRVTVNYRINIPILSAAMDTVTEAEMAIAMARHGGLGVIHRNMTVEEQVKEVRRVKEARDVVQRDVVTISPDESVKRAVELMEKHDVGGLPVVDEEGKVVGIITRRDVGLLSEEEIGELDVKSVMTEEPVVIEEGEDLEERALRVMREEKIERVPVVDDEGRLLGIVTAKDVTELREETEAATDEERRYLAAAAVGPKDPDRAIALDEAGADILVVDCAHAHTETVINFVKEIKREVDADIIAGNIATAEAAEDLIAAGADALKVGIGPGSICTTRIVAGVGVPQITAVAWVADVAEEHDIPVIADGGIRYSGDIAKAIAAGADAVMLGNLLAGTDEAPGRVIRLRGRLYKQYRGMGSLGAMMKGESADRYFKQPEQGGRHVAQTKFVPEGVEGVVPYKGPVSEVLYTLVGGLRSSMGYVGAKNIEEMKKKARFVRITRAGYEESHPHDIAITDEAPNYPISNQ

SEQ ID NO: 14684 - protein, 389 aa, Methanopyrus kandleri AV19
MDARELIDKYHMNTYSRFPVTLVPGEGARVWDDEGNEYIDLVAGIAVNVLGHCHPAVVEAVKEQVERLIHCSNLYYNEPQAEAARLLAEAAPKDLNKVFFCNSGTESVECAIKLARKFTGCTKFIAFEGGFHGRTMGALSATWKPEFREPFEPLVPEFEHVPYGDVNAVEKAIDDDTAAVIVEPVQGEAGVRIPPEGFLRELRELCDEHGLLLIVDEVQSGMGRTGQFFAFEHEDVLPDIVCLAKGLGGGVPVGATIAREEVAEAFEPGDHGSTFGGNPLACAAVCAAVSTVLEENLPEAAERKGKLAMRILSEAEDVVEEVRGRGLMMGVEVGDDERAKDVAREMLDRGALVNVTSGDVIRLVPPLVIGEDELEKALAELADALRASG

SEQ ID NO: 14685 - protein, 427 aa, Methanopyrus kandleri AV19 [sequence omitted]

SEQ ID NO: 14686 - protein, 235 aa, Methanopyrus kandleri AV19
MSNYVIRLENVRKVYNSGSVKVEALKGVSLGVKNGEFLMIVGPSGSGKSTLLHIMGALDTPTSGRVEIAGKDMTNLSDEELAEIRNKYVGFVFQQYNLIESLTVLENVMFPMTLAGEEDEERAKDLLRKVGLKEEHFDKFPSQLSGGEQQRVAIARALANDPEVILADEPTGQLDTKNSQRIMKLLEKLNDSGHTIVMVTHDLSLVRWADRVILLRDGRIEREMSPEELDAEVLD

SEQ ID NO: 14687 - protein, 406 aa, Methanopyrus kandleri AV19
MYENISTMDDFEFENKWVLLRIDINSTVIDGKIEDDERIKRHLGTIKELMEHDARVAILAHQGRPGEDDFTTLEPHAEIMSEELDNFEYVPDVFGPTAKKKIRSLEPGEVILLENVRFYSEERINRDPEWHARRHLVRNLAPLFDIFVNDAFAAAHRSNASLVGFTRRLPSCVGRVMEREIEVLETMVRDEMEDGVFVIGGSKIEDAIKVIRRAIEMDNVRRVLLGGLVGNLFLWASGVDLGKPSRKFLDMKGYTGYLDEARELLEEGDDVILVPEDVALNRGGEREEVDVDELPADAPVFDIGTGTIERYRKEVESAGMVVANGPMGVYEEPGFEKGTYEVLNAIADSEAFSVIGGGHIIAAAKACGAYDSIDHVSTGGGAMLRMLAGERLPAIDAILTCPFSGC

SEQ ID NO: 14688 - protein, 226 aa, Methanopyrus kandleri AV19
MLRVPPVIVNFKAYSEAVGENALRLARVAAEVSEETGVEVGICPPHVDLRDVVREVGDEVTVLAQAVDAAEPGGRTGHVTPEMVVEAGADGTLLNHSERRMLLEDLKDVCRACINEGLLTIVCASDALAARAAGALSPHAVAVEPPELIGTGTPVSKADPEVVERSVEVVKEVSEETAVLCGAGITDGSDVRAAVELGADGVLVASGVVLADDPKEALLDLISGLE

SEQ ID NO: 14689 - protein, 469 aa, Corynebacterium efficiens
MTEHYDVVVLGAGPGGYVSAIRAAQLGKKVAVIEKQYWGGVCLNVGCIPSKALIKNAEIAHIFNHEKKTFGINGEVTFNYEDAHKRSRGVSDKIVGGVHYLMKKNKITEIDGFGTFKDAKTIEVTDGKDAGKTVTFDDCIIATGSVVNSLRGVEFSENVVSYEEQILNPVAPKKMVIVGGGAIGMEFAYVLGNYGVDVTLIEFMDRVLPNEDPEVSKVIAKAYKKMGIKLLPGHATTAVRDNGDSVEVDYQKKGSDKTETITVDRVLISVGFRPRVEGFGLENTGVKLTERGAIDIDEHMRTNVDGIYAIGDVTAKLQLAHVAEAQGIVAAETLAGAETQTLGDYMMMPRATFCNPQVASFGYTEEQAKEKWPDREIKVSSFPFSANGKAVGLAETDGFAKIVADAEFGELLGGHIVGANASELLNELVLAQNWDLTTEEISRSVHIHPTLSEAVKEAAHGVNGHMINF

SEQ ID NO: 14690 - protein, 424 aa, Atriplex prostrata
YLRAIAAKITERKDHFVKLETLDSGKPFDEALLDIDDVAGCFEYYADQAEALDAKQKAPIALPMDTFKSHVLRQPIGVVGLISPWNYPLLMATWKVAPALAAGCAAILKPSEMASVTCLELADVCKEVGLPPGVLNILSGYGPEAGGPLASHPDVDKVAFTGSTATGSKIMSSAAQLVKPVTLELGGKSPIILFEDVDLDQAAEWAAFGCFWTNGQICSATSRLLVHESIAAEYLDKLVKWCKNIKISDPFEDGCRLGPVVSKGQYEKVLKFISTAKSEGATILCGGSRPEHLKKGYFIEPTIISDVSTSMQIWKEEVFGPVLCVKTFSSDEEAIELANDTQYGLGAAVLSKNLERCEKVTKALEVGIVWVNCSQPCFCQAPWGGAKRSGFGRELGEWGIENYLNIKQVTSDISDEPWGWYKSP

SEQ ID NO: 14691 - protein, 500 aa, Atriplex prostrata
MAFPIPVRQLFIDGEWREPLLKNRIPIINPSTEEIIGDIPAATAEDVEVAVVAARKAFKRNKGRDWAATSGAHRAKYLRAIAAKITERKDHFVKLETLDSGKPFDEAVLDIDDVASCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDIDKIAFTGSSATGSKIMASAAQLVKPVTLELGGKSPVIMFEDIDIETAVEWTLFGVFWTNGQICSATSRLLLHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 14692 - protein, 346 aa, Zea mays
SKIIGTVNGLAAGWGNMGGGATQLIMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCAQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 14693 - protein, 242 aa, Shigella boydii
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAVIDAGAAGAISGSAIVKIIEQHINEPEKML

SEQ ID NO: 14694 - protein, 242 aa, Shigella boydii
LKERKEGAFVPFVTLRDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDHVKAAIDAGAAGAISGSAIVKIIEQHINEPEKML

SEQ ID NO: 14695 - protein, 242 aa, Shigella boydii
LKERKEGAFVPFVTLRDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPPLQGFGISTPDQVKAAIDAGAAGAISGSAIVKIIEQHINEPEKML

SEQ ID NO: 14696 - protein, 242 aa, Shigella boydii
MKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPSLQGFGIFRPDQVKAAIDARAAGAIFGSAIVKIIEQHINEPEKML

SEQ ID NO: 14697 - protein, 242 aa, Shigella boydii
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGHGYTYLLSRAGVTGAENRAALPLNHLVAKLKEYNAAPPLQGFGISAPDQVKAAIDAGAAGAISGSAIVKIIEQHINEPEKML

SEQ ID NO: 14698 - protein, 242 aa, Shigella flexneri
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHIYEPEKML

SEQ ID NO: 14699 - protein, 242 aa, Shigella flexneri
LKERKEGAFVPFVTLRDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDHVKAAIDAGAAGAISGSAIGKIIEQHINEPEKML

SEQ ID NO: 14700 - protein, 242 aa, Shigella flexneri
LKERKEGAFVPFVTLRDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 14701 - protein, 242 aa, Shigella flexneri
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAIFCLAIVKIIEQHINEPEKML

SEQ ID NO: 14702 - protein, 242 aa, Shigella flexneri
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAKNRAALPLNHLVAKLKEYNAAPPLQGFGISAPDQVKAAIDAGAAGAISGSAIVKIIEQHINEPEKML

SEQ ID NO: 14703 - protein, 242 aa, Shigella flexneri
LKERKEGAFVPFGTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALCHNVAPIFICPPNADDDLLRQIASYGRGYTYLLSRAGVTGAENRSALPLNHLVAKLKEYNAAPPLQGFGISAPDQVKAAIDAGAAGAISGSAIVKIIEQHINEPEKML

SEQ ID NO: 14704 - protein, 242 aa, Shigella dysenteriae
LKERKEGAFVPFVTLGDPGIEQSLKIIDTLIEAGADALELGIPFSDPLADGPTIQNATLRAFAAGVTPAQCIEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAAAISGSAIVKIIEQHINEPEKML

SEQ ID NO: 14705 - protein, 242 aa, Shigella dysenteriae
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAIFGSAIGKIIEQHINEPEKML

SEQ ID NO: 14706 - protein, 242 aa, Shigella dysenteriae
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPSLQGFGISAPDHVKAAIDARAAGAISGSAIVKIIEQHINEPEKML

SEQ ID NO: 14707 - protein, 242 aa, Shigella dysenteriae
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDARAAGAISGSAIVKIIEQHINEPEKML

SEQ ID NO: 14708 - protein, 242 aa, Shigella dysenteriae
LKERKEGAFVPFVTLGDPGIEQSLKIIDTLIEAGADALELGIPFSDPLADGPTIQNATLRAFAAGVTPAQCIEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKATIDAGAAGAISGSAIVKIIEQHINEPEKML

SEQ ID NO: 14709 - protein, 242 aa, Shigella dysenteriae
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDHVKAAIDAGAAGAIFGSAIVKIIEQHINEPEKML

SEQ ID NO: 14710 - protein, 242 aa, Shigella dysenteriae
LKERKEGAFVPFVTLGDPGIEQSLKIIDTLIEAGADALELGIPFSDPLADGPTIQNATLRAFAAGVTPAQCIEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 14711 - protein, 242 aa, Shigella sonnei
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPPLQGFGISTPDQVKAAIDSGAAGAISGSTIVKINEQHINEPEKML

SEQ ID NO: 14712 - protein, 242 aa, Shigella sonnei
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLHHLVAKLKEYNAAPPLQGFGISTPDYVKAPIDAGAAGAISGSAIVKIIEQHINEPEKML

SEQ ID NO: 14713 - protein, 242 aa, Shigella sonnei
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPPLQGFGISTPDQVKAAIGAGAAGAIFGLAIVKIIEQHINEPEKML

SEQ ID NO: 14714 - protein, 242 aa, Shigella sonnei
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPPLQGFGISTPDQVKAAIDAGAAGAISGSTIVKIIEQHINEPEKML

SEQ ID NO: 14715 - protein, 242 aa, Shigella sonnei
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPSLQGFGISTPDQVKAAIDAGAAGAISGSAIVKIIEQHINEPEKML

SEQ ID NO: 14716 - protein, 242 aa, Shigella sonnei
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPPLQGFGISTPDQVKAAIDAGAAGAISGSAIVKIIEQHINEPEKML

SEQ ID NO: 14717 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDHVKAAIDAGAAGAISGSAIVKIIEQHINEPEKML

SEQ ID NO: 14718 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPSLQGFGIFAPDQVKAAIDAGAAGAIFVSAIVKIFGQHFNEPEKML

SEQ ID NO: 14719 - protein, 242 aa, Escherichia coli
LKERKEGAFVPFVTLGDPGIEQSLKIIDTLIKAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 14720 - protein, 242 aa, Escherichia coli
LKERIEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDHVKAAIDAGAAGAIFGSVIVKNIEQTINEPEKML

SEQ ID NO: 14721 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPSLQGFGISTPDHVKAAIDAGAAGAISGSAIGKIIEQHINEPEKML

SEQ ID NO: 14722 - protein, 242 aa, Shigella boydii
LKKRKEGAFVPFVTLGDPGVELSLKIIDALIEAGADALELGIPFSDPLADGPTIQNATLRAFAAGVTPAQCFEMLTLIRQKHPAIPIGLLMYANLVFNKGIDEFYAQCEKVGIDSVLVADVPVEESAPFRQAALRHNVAPIFICPPNADDDLLRQIASYGRGYTYLLSRAGVTGAENRAALPLNHLVTKLKEYNAAPPLQGFGISTPEQVKAAIDAGTAGAISGSAIVKIIEHNMNQPEKML

SEQ ID NO: 14723 - protein, 440 aa, Nostoc sp. PCC 7120
MSNQGAFDGAANVESGSRVFVYEVVGMRQNEETDQTNYPIRKSGSVFIRVPYNRMNQEMQRITRLGGKIVSIQTVSALQQLNGRTTIATVTDASSEIAKSEGNGKATPVKTDSGAKGFAKPPAEEQLKKKDNKGNTMTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADELWQLIKNEKTHTYICGLRGMEEGIDAALSAAAAKEGVTWSDYQKDLKKAGRWHVETY

SEQ ID NO: 14724 - protein, 450 aa, Clostridium perfringens
MKKGLVVDLSKAAPYLKSHEVAYMQETINQAHNKLHNGTGAGNDFLGWVDLPVNYDKDEFARIKEAAKKIQSDSDVLVVIGIGGSYLGARAAIEMLTNNFYNSMSKDKRKTPAIFYAGNNISSSYMADLLKAIDGLDVSLNVISKSGTTTEPAIAFRILKDYMEKKYGKEEAKKRIYATTDAKKGALKTLADAEGYETFVIPDDVGGRFSVLTAVGLLPIAAAGINIDEMMEGAADAREEYANPSLADNECYKYAAARNALYNKGKAIEILVNYEPSVHYFNEWWKQLYGESEGKDNKGLFPAAVDFSTDLHSMGQYIQEGRRDIFETVINVGSPREEIVIEANDENIDGLNFLAGKTMDYVNKQAFRGTLLAHNDGEVPNVVVNVPELTPYYFGRLVYFFEKACGISGYVLGINPFDQPGVEAYKKNMFALLGKPGFEDLKAELEERLK

SEQ ID NO: 14725 - protein, 218 aa, Clostridium perfringens
MPVKIVLLGPPGAGKGTQAKSISNRYSIPHISTGDIFRKNISENTPLGIEAKSYMDNGQLVPDEVTINMVKDRLQQDDCKNGYLLDGFPRTVHQAEALDNFLTEREESIDTALLIEVPKEFILERMTGRRVCPSCGASYHIKFNPPTNDGKCDLCGSDVIQRKDDTEETVKERLDVYENQTQPLIDFYKNKKQLSVVDGTQAINEVFESICKILGSDK

SEQ ID NO: 14726 - protein, 184 aa, Nostoc sp. PCC 7120 [sequence omitted]

SEQ ID NO: 14727 - protein, 164 aa, Nostoc sp. PCC 7120
MRRLFALILVICLSFSFAPPAKALGADLTPCAENPAFQALAKNARNTTADPQSGQKRFERYSQALCGPEGYPHLIVDGRLDRAGDFLIPSILFLYIAGWIGWVGRAYLQAIKKDSDTEQKEIQLDLGIALPIIATGFAWPAAAVKELLSGELTAKDSEITVSPR

SEQ ID NO: 14728 - protein, 248 aa, Clostridium perfringens
MRTPIIAGNWKMHYTIDEAVKLVEELKPLVKDAKCEVVVCPTFVCLDAVKKAVEGTNIKVGAQNMHFEEKGAFTGEIAPRMLEAMNIDYVIIGHSERREYFNETDETCNKKVKAAFAHNLTPILCCGETLEQRENGTTNDVIKAQITADLEGLTKEQAEKVVIAYEPIWAIGTGKTATSDQANETIAAIRAMVAEMFGQEVADKVRIQYGGSVKPNTIAEQMAKSDIDGALVGGASLVAADFAQIVNY

SEQ ID NO: 14729 - protein, 241 aa, Nostoc sp. PCC 7120
MRKIVIAGNWKMFKTQAESQEFLKEFLPALEETPQEREVLLCVPFTDLAILSQSLHGSLVQLGAQNVHWAENGAYTGEISGPMLTEIGVRYVIVGHSERRQFFGETDETVNLRLQAAQKYGLTPILCVGETKQQRDSGETESLIVSQLDKDLINVDQTNLVIAYEPIWAIGTGDTCETTEANRVIGLIRSQLKNSDVPIQYGGSVKPNNIDEIMAQPEIDGVLVGGASLEAASFARIVNYL

SEQ ID NO: 14730 - protein, 251 aa, Neisseria meningitidis serogroup B
MWDQKWVIGNWKMNGRLQNNNALMHRFRIHPTAERVLIGLAAPTVYLLQLHNAMQIVLNNRILTCAQDVSRFPNNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 14731 - protein, 168 aa, Hordeum vulgare
MLVYQDKLSGDELLSDSFPYRELENGVLWEVDGHWVVQGAVDVDIGANPSAEGGGEDEGVDDQAVKVVDIVDTFRLQEQPAFDKKQFIAYIKRYIKNLTAKLEGEELDAFKKNVESATKYLLSKLKDLQFFVGESMHDDGSVVFAYYREGAADPTFLYFAHGLKEVKC

SEQ ID NO: 14732 - protein, 1032 aa, Escherichia coli O157:H7
MGDIMRPIPFEELLTRIFDEYQQQRSIFGIPEQQFYSPVKGKTVSVFGETCATPVGPAAGPHTQLAQNIVTSWLTGGRFIELKTVQILDRLELEKPCIDAEDECFNTEWSTEFTLLKAWDEYLKAWFALHLLEAMFQPSDSGKSFIFNMSVGYNLEGIKQPPMQQFIDNMMDASDHPKFAQYRDTLNKLLQDDAFLARHGLQEKRESLQALPARIPTSMVHGVTLSTMHGCPPHEIEAICRYMLEEKGLNTFVKLNPTLLGYARVREILDVCGFGYIGLKEESFDHDLKLTQALEMLERLMALAKEKSLGFGVKLTNTLGTINNKGALPGEEMYMSGRALFPLSINVAAVLSRAFDGKLPISYSGGASQLTIRDIFDTGIRPITMATDLLKPGGYLRLSACMRELEGSDAWGLDHVDVERLNRLAADALTMEYTQKHWKPEERIEVAEDLPLTDCYVAPCVTACAIKQDIPEYIRLLGEHRYADALELIYQRNALPAITGHICDHQCQYNCTRLDYDSALNIRELKKVALEKGWDEYKQRWHKPAGSGSRHPVAVIGAGPAGLAAGYFLARAGHPVTLFEREANAGGVVKNIIPQFRIPAELIQHDIDFVAAHGVKFEYGCSPDLTVEQLKNQDFHYVLIATGTDKNSGVKLAGDNQNVLKSLPFLREYNKGTALKLGKHVVVVGAGNTAMDCARAALRVPGVEKATVVYRRSLQEMPAWREEYEEALHDGVEFRFLNNPERFDADGTLTLRVMSLGEPDEKGRRRPVETNETVTLHVDSLITAIGEQQDTEALNAMGVPLDKNGWPDVDHNGETRLTDVFMIGDVQRGPSSIVAAVGTARRATDAILSRENIRSHQNDKYWNNVNPAEIYQRKGDISITLVNSDDRDAFVAQEAARCLECNYVCSKCVDVCPNRANVSIAVPGFQNRFQTLHLDAYCNECGNCAQFCPWNGKPYKDKITVFSLAQDFDNSSNPGFLVEDCRVRVRLNNQSWVLNIDSEGQFNNVPPELNDMCRIISHVHQHHHYLLGRVEV

SEQ ID NO: 14733 - protein, 425 aa, Clostridium perfringens
MDRNKEIFEESKKYMPGGVNSPVRSFGSVGINPPVIKSGKGAMIKDENGNEYIDFVLAWGPMILGHCDEDVVEAIKKTSEESIAFGASTKLELDLAKLLCETLDNVDMIRMVNSGTEATMSAVKLARGYTKKDKIIKFAGCYHGHFDGFLIEAGSGVLTEGIPGCLGVPEESIKNTLIGIYNDEKQVEELFEKYGNDIAGIIIEPVAGNMGVVKCDPKFMRKLRELCDKYGALLIFDEVMCGFRVAYKGAQTLFDVKPDLVTYAKIMGGGLPCGAYGGRREIMENLSPLGGVYQAGTMSGNPIVMSAGLATVKKLYENPSYYNHIEKIGSKLEKGVLEIAKKKGLGLVVNRQGGMITLFFTDLKEVKCYDDVKTCDGERFKRYFLHMLNKGFNIPPSQFEAMFLSVKHTEEHIDKFLEAFETFEG

SEQ ID NO: 14734 - protein, 459 aa, Nostoc sp. PCC 7120
MTFDYDLFVIGAGSGGLAASKRAASYGAKVAIAENDLVGGTCVIRGCVPKKLMVYGSHFPALFEDAAGYGWQVGKAELNWEHFITSIDKEVRRLSQLHISFLEKAGVELISGRATLVDNHTVEVGERKFTADKILIAVGGRPIKPELPGMEYGITSNEIFHLKTQPKHIAIIGSGYIGTEFAGIMRGLGSQVTQITRGDKILKGFDEDIRTEIQEGMTNHGIRIIPKNVVTAIEQVPEGLKISLSGEDQEPIIADVFLVATGRVPNVDGLGLENAGVDVVDSSIEGPGYSTMNAIAVNEYSQTSQPNIYAVGDVTDRLNLTPVAIGEGRAFADSEFGNNRREFSHETIATAVFSNPQASTVGLTEAEARAKLGDDAVTIYRTRFRPMYHSFTGKQERIMMKLVVDTKTDKVLGAHMVGENAAEIIQGVAIAVKMGATKKDFDATVGIHPSSAEEFVTMR

SEQ ID NO: 14735 - protein, 474 aa, Clostridium perfringens
MQKTKMIFTIGPSSDSEEILREFIRIGMNAARLNFSHGDHASHKEKIELIKRLRKEEKSATAILLDIKGPKIRTYNFKNGEAELKNGDEFTFSCGDEILGDNTKCSISYKELYEDIKPGGSILVDDGLLEFKVKEVRGTDIICEVIEGGTIKDHKGVNVPNVPIKLPAVTEKDRSDLIFGCEMEVDFVAASFIRKPEDVLEVREILDSHGGKDIKIISKIESQEGVDNIKEIIKVTDGVMVARGDMGVEIPIENVPIIQKNIIKKCNQAGKIVITATQMLDSMIRNPRPTRAEASDVCNAIFDGTDAIMLSGESASGSFPIEAAMTMSRIAKKAEANLDYNYLLRRLKDPNPNPDAFADAISYSASKTASKFPTKAIVAATQTGSTAKILSKYKPSCPIIAITPYEKVRRSLALNFGIISKKCAYFNSTDEIIEEARKVAKEFEIAETGDNIMVAAGFPTSITGGTNMLKIEKI

SEQ ID NO: 14736 - protein, 476 aa, Nostoc sp. PCC 7120
MSYAQTKTQTKSGYKAGVQDYRLTYYTPDYTPKDTDILAAFRVTPQPGVPFEEAAAAVAAESSTGTWTTVWTDLLTDLDRYKGRCYDIEPVPGEDNQFIAYIAYPLDLFEEGSITNVLTSIVGNVFGFKALRALRLEDIRFPVAYIKTFQGPPHGIQVERDKLNKYGRPLLGCTIKPKLGLSAKNYGRAVYECLRGGLDFTKDDENINSAPFQRWRDRFLFVADAITKAQAETGEIKGHYLNVTAPTCEEMLKRAEYAKELKQPIIMHDYLTAGFTANTTLARWCRDNGVLLHIHRAMHAVIDRQKNHGIHFRVLAKALRLSGGDHIHTGTVVGKLEGERGITMGFVDLLRENYVEQDKSRGIYFTQDWASLPGVMAVASGGIHVWHMPALVEIFGDDSVLQFGGGTLGHPWGNAPGATANRVALEACVQARNEGRNLAREGNDVIREAAKWSPELAVACELWKEIKFEFEAMDTV

SEQ ID NO: 14737 - protein, 1320 aa, Salmonella typhimurium
MGTTTMGVKLDDATRERIKMAASRIDRTPHWLIKQAIFSYLDKLENSDTLPELPALFVGAANESEEPVAPQDEPHQPFLEFAEQILPQSVSRAAITAAWRRPETDAVSMLMEQARLSPPVAEQAHKLAYQLAEKLRNQKSASGRAGMVQGLLQEFSLSSQEGVALMCLAEALLRIPDKATRDALIRDKISNGNWQSHIGRSPSLFVNAATWGLLFTGRLVSTHNEANLSRSLNRIIGKSGEPLIRKGVDMAMRLMGEQFVTGETIAQALANARKLEEKGFRYSYDMLGEAALTAADAQAYMVSYQQAIHAIGKASNGRGIYEGPGISIKLSALHPRYSRAQYDRVMEELYPRLKSLTLLARQYDIGLNIDAEEADRLEISLDLLEKLCFEPELAGWNGIGFVIQAYQKRCPLVIDYLVDLASRSRRRLMIRLVKGAYWDSEIKRAQMEGLEGYPVYTRKVYTDVSYLACAKKLLAVPNLIYPQFATHNAHTLAAIYHLAGQNYYPGQYEFQCLHGMGEPLYEQVTGKVADGKLNRPCRIYAPVGTHETLLAYLVRRLLENGANTSFVNRIADATLPLDELVADPVEAVEKLAQQEGQAGIPHPKIPLPRDLYGEGRINSAGLDLANEHRLASLSSALLSNAMQKWQAKPVLEQPVADGEMTPVINPAEPKDIVGWGREATESEVEQALQNAVNQAPVWFATPPQERAAILQRAAVLMEDQMQQLIGLLVREAGKTFSNAIAEVREAVDFLHYYAGQVRDDFDNETHRPLGPVVCISPWNFPLAIFTGQIAAALAAGNSVLAKPAEQTSLIAAQGIAILLEAGVPPGVVQLLPGRGETVGAQLTADARVRGVMFTGSTEVATLLQRNIATRLDAQGRPIPLIAETGGMNAMIVDSSALTEQVVVDVLASAFDSAGQRCSALRVLCLQDDIAEHTLKMLRGAMAECRMGNPGRLTTDIGPVIDSEAKANIERHIQTMRAKGRPVFQAARENSDDAQEWQTGTFVMPTLIELENFAELEKEVFGPVLHVVRYNRNQLAELIEQINASGYGLTLGVHTRIDETIAQVTGSAHVGNLYVNRNMVGAVVGVQPFGGEGLSGTGPKAGGPLYLYRLLAHRPPNALNTTLTRQDARYPVDAQLKTTLLAPLTALTQWAADRPALQTLCRQFADLAQAGTQRLLPGPTGERNTWTLLPRERVLCLADDEQDALTQLAAVLAVGSQALWSDDAFHRDLAKRLPAAVAARVQFAKAETLMAQPFDAVIFHGDSDKLRTVCEAVAAREGAIVSVQGFARGESNILLERLYIERSLSVNTAAAGGNASLMTIG

SEQ ID NO: 14738 - protein, 142 aa, Bacillus cereus
ARGNPSFDGFYRTVKMDDKTYTKWGWEISPEGFLEGLHMLKARYGDIKMYVTENGLGDEDPIIDGEIVDVPRIKFIEAHLKVMKRAIEEGINLKGYYAWSVIDLLSWLNGYKKQYGFIFVDHNDNLKRKKKLSFHWYKRVVD

SEQ ID NO: 14739 - protein, 380 aa, Mesembryanthemum crystallinum
MVCQMEANNKVNGGGENGSSSEGRPPNPLAATYRQCYSATRVSSTCKKTLMRHPSLVKATDIPIEPLAVADCESEFLPIVRSGAWTDIGFRSNMEDAYLCVDDFIHHYGVEHINESPNAFYGVFDGHGRKHAADFACCHLPRFIFEDNDFPREIERVITSAFLQTDNAFAEACSLDAGLASGTTALAALVLGRSLVVANVGDCRAVLCRRGKAIEMSRDHKPHCSREIKRIEASGGYVDDGYLNGQLNVARALGDWHMEGMKGADGGPLTAEPELITTELTQEDEFLIIGCDGLWDVFRSQNAVDFARRRLQDHNDPVMCSRDLVDEALKRKSGDNLAVVVVCFQPQPPPNLIVPRARVQRSVSAEGLRELQSFLDGLES

SEQ ID NO: 14740 - protein, 319 aa, Mesembryanthemum crystallinum
MGYLDSVLSSSNQVHVEEQPVSGGGISQNGKFSYGYASSPGKRSSMEDFYETRIDGVEGEVVGLFGVFDGHGGARAAEYVKQNLFSNLIKHPKFISDTKSAIAEAYTHTDSEFLKSENTQNRDAGSTASTAILVGDRLLVANVGDSRAVICRGGEAIAVSRDHKPDQSDERQRIEDAGGFVMWAGTWRVGGVLAVSRAFGDKLLKQYVVADPEIQEEVVDSSLEFLILASDGLWDVVTNEEAVTMVKPIQDTEEAAKKLMQEAYQRGSADNITCVVVRFLDNPIDSSSNRISGNHGDTSSRVLGGSHTDSSNRFLGKPR

SEQ ID NO: 14741 - protein, 141 aa, Bacillus cereus
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFD

SEQ ID NO: 14742 - protein, 167 aa, Bacillus cereus
LRKRASIPLVGLTSYQALHDIMQLQKGQKILIHAGSGGVGTFAIQLAKIMGATVTTTASEAGANLVTSLGADEIINYKTEKFEDILKNYDAVFDTIGGATLEKSFNIIKSEGNIVSVSGMPNARFGKEFGSGFFKTLLFSLASKKLTALEKKHNAQYSFLFMKPSGD

SEQ ID NO: 14743 - protein, 162 aa, Bacillus cereus
DHYILNGSKIFITNGGIADIYVVFALTDPESKQRGTSAFIVESDTPGFSVGKKESKLGIRSSPTTEIMFEDCRIPVENLLGEEGQGFKVAMQTLDGGRNGIAAQAVGIAQGALDASVEYARERHQFGKPIAAQQGIGFKLADMATDVEAARLLTYQAAWLES

SEQ ID NO: 14744 - protein, 478 aa, Arabidopsis thaliana
MTKKRKLEGEESNEAEEPSQKLKQTPEEEQQLVIKNQDNQGDVEEVEYEEVEEEQEEEVEDDDDEDDGDENEDQTDGNRIEAAATSGSGDQEDDDDEPIQDLLEPFSKEQVLSLLKEAAEKHVDVANRIREVADEDPVHRKIFVHGLGWDTKTETLIEAFKQYGEIEDCKAVFDKISGKSKGYGFILYKSRSGARNALKQPQKKIGSRMTACQLASKGPVFGGAPIAAAAVSAPAQHSNSEHTQKKIYVSNVGAELDPQKLLMFFSKFGEIEEGPLGLDKYTGRPKGFCLFVYKSSESAKRALEEPHKTFEGHILHCQKAIDGPKPGKQQQHHHNPHAYNNPRYQRNDNNGYGPPGGHGHLMAGNPAGMGGPTAQVINPAIGQALTALLASQGAGLAFNPAIGQALLGSLGTAAGVNPGNGVGMPTGYGTQAMAPGTMPGYGTQPGLQGGYQTPQPGQGGTSRGQHGVGPYGTPYMGH

SEQ ID NO: 14745 - protein, 196 aa, Arabidopsis thaliana
MSASRFIKCVTVGDGAVGKTCMLISYTSNTFPTDYVPTVFDNFSANVVVDGNTVNLGLWDTAGQEDYNRLRPLSYRGADVFILAFSLISKASYENVAKKWIPELRHYAPGVPIILVGTKLDLRDDKQFFIDHPGAVPITTNQGEELKKLIGSPIYIECSSKTQQNVKAVFDAAIKVVLQPPKQKKKKKNKNRCVFL

SEQ ID NO: 14746 - protein, 394 aa, Arabidopsis thaliana
MGMTSFTDGPAEESKLTGVGEIRLVPDLSTKQTIPWTKQESMVLADMQLKPGEAWGYCPRETLRRVAKVLKDEFDLVMNAGFENEFYLLKNVVREGKEEYMPFDFGPYCATSSFDAASPIFHDIVPALESLNIEVEQFHAESGKGQFEVSLGHTIASHAADNLVYTREVIRSVARKQGLLATFVPKYDYCDIGSGSHVHLSLWKNGENVFPASNNSSSHGISSVGEEFMAGVLFHLPSILAIIAPLPNSYDRIQPNTWSGAFQCWGKENREAALRAASPPGTPDGLVTNFEIKSFDGSANPHLGLAVIMAAGIDGLRRHLQLPTPIDINPADVAATLNRLPETLSEAVEALDKDKVLHDLLGQKLLVAIKGVRKAEVEYYSKNPDAYKQLIHRY

SEQ ID NO: 14747 - protein, 250 aa, Arabidopsis thaliana
MAGVAFGSFDDSFSLASLRAYLAEFISTLLFVFAGVGSAIAYAKLTSDAALDTPGLVAIAVCHGFALFVAVAIGANISGGHVNPAVTFGLAVGGQITVITGVFYWIAQLLGSTAACFLLKYVTGGLAVPTHSVAAGLGSIEGVVMEIIITFALVYTVYATAADPKKGSLGTIAPLAIGLIVGANILAAGPFSGGSMNPARSFGPAVAAGDFSGHWVYWVGPLIGGELAGLIYGNVFMGSSEHVPLASADF

SEQ ID NO: 14748 - protein, 42 aa, Capsicum annuum
PSFQELLAQAEEEFGFDHPMGGLTIHCKEDVFIDLTSRLRRL

SEQ ID NO: 14749 - protein, 101 aa, Capsicum annuum
MGLKKSNKHITQSVALKQILKRCSSFGKNENGLPHDVPKGHFVVYVGENRSRYIIPISWLTHPEFQSLLQRAEEEFGFNHDMGLTIPCDEEDFCSLMSIFR

SEQ ID NO: 14750 - protein, 146 aa, Capsicum annuum
MLSAKKLIKMARRWQKFAAKQRKRISFPRNNSNADGCSTPSSSIVEKGHFVVYTIDQTRYVFPLTYLENEVVMQLLNMSEEEFGLPSGGPITLPCDSSFMDYIISLIKKGVAAEDLHNAILLSIPSCCCSTSSCHQESGNQQIFVC

SEQ ID NO: 14751 - protein, 239 aa, Capsicum annuum
MALLGLLLMGISLMFQSVHGYGGWINAHATFYGGGDASGTMGGACGYGNLYSSGYGTNTAALSTALFNNGLSCGQCFQLMCVNARQYCLPGIITVTATNFCPPGGWCDPPNHHFDLSQPIFLRIAQYRAGIVPVAYRRVPCRRRGGIRFTINGHSYFNLVLVTNVGGSGDVHSVYIKGSRTQWQPMSRNWGQNWQNNAYLNGQSLSFKVTTGDGRTVVSYNAAPSSWSFGQTFSGGQFR

SEQ ID NO: 14752 - protein, 324 aa, Capsicum annuum
MGTSSLSLLFLLSFLLLLPSLFASSNPQQVVDEVHRSINGSRRNLGYLSCGTGNPIDDCWRCDPNWEKNRQRLADCAIGFGKNAIGGRDGKIYVVTDSGDDDPVTPKPGTLRHAVIQTEPLWIIFARDMVIQLKEELIMNSFKTIDGRGASVHIAGGPCITIQYVTNIIIHGIHIHDCKQGGNAMVRSSPSHYGWRTISDGDGVSIFGGSHVWVDHCSFSSCKDGLIDAIMGSTAITISNNYMTHHDKVMLLGHSDSYTQDKNMQITIAFNHFGEGLVQRMPRCRHGYFHVVNNDYTHWEMYAIGGSADPTINSQGNRFLAPDI

SEQ ID NO: 14753 - protein, 295 aa, Anabaena
DVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLAGGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 14754 - protein, 249 aa, Escherichia coli
AVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 14755 - protein, 431 aa, Pseudomonas fluorescens
MTDHSSLSRNVTMDQSPALPDLGSSFVLPNGVRLKNRLVKAAMSEQLGDRRHDPGPGMENLYRQWAQGGIGLSISGNIMVDRNAIGELRNVVLDAHSDLNAFRRWALAGSSHGTHLWAQLNHPGKQIIKLLCDEPVAPSAISLGSGLEKHFNCPRALTEDGIEKIIAQFATSARLAKVVGFTGVQIHAAHGYLINQFLSPLHNQRSDQWGGSLANRMRFLVRVYQAIRSVVGDAFPVGIKLNSADFMRGGFTEEESLQVVVALGNLGLDQLEISGGTYESPVMVGNQAASTREREAYFLNYAARVREVSTLPLVVTGGFRSGAAMTAALRDAATDFIGLARPLALEPDMPVKLLSEATYRVDLRPLSTGFAALDRIATLDVSWYEHQLQRMARHQLPKPGLSEWLSLGKTLLDFAACARKKRSTQCSTYKR

SEQ ID NO: 14756 - protein, 340 aa, Pseudomonas fluorescens
MRALQLVDKQRLALRELVLPARPAPGHARVRMAFMTLNHLDLFGYRGMAFARRTLPVTVGAEGAGFVQDVGPGSDPELIGQAMAIYPSVFCGCCPACLAGRENLCADSPGVMGFHCDGVAAEYVDVPLRMLVPIPAGVPMDMAACAPVTFATVHHMLIDNARLMSGETLLVHAGGSGIGSIAIRLARHLGVTVFATVGRADKVERARALGAEYVIDYREERFLRVIREQTARRGVDVVFEHVGADTWEQSLLSLARGGRLVICGSTTGVEAPTNLMHLFNQQIHIHGSFGAPLSGLRDALALIQQGVLPVIDCVMPVAGFESGLQRLRERDVFGKIVLQF

SEQ ID NO: 14757 - protein, 336 aa, Pseudomonas fluorescens
MPRHICITGASGFLGSHIVEKLLHHGCTVDALLRRPTAHLQGLAARHAQLRLHVVDLAQPGACNALFSECDTVIHCAASVTNNARPGSRLWQQTLEMNVNGTQNVIDGIRQAASVRTFVYTSSMAAILSPDMPAGHAFSEADWNHASLEASDPYWYSKTAAERLVTDAFQPWPCEPRVVCINPSVIIGPVLDPRHAATSIAILHDLHTGKTPACPDLNFHFVDVRDLAELHVRAALDDVIEGRFIVPGHEASMLELATMIKQRFPDSKAPQRRAPDWLMYLSAMLNPRLSRRYLRQNLGVRRVFDDQRARRAFQLSYRPLEHSVADTLQSLSPTAP

SEQ ID NO: 14758 - protein, 1015 aa, Escherichia coli; identical to SEQ ID NO: 12962
  misc_feature (196)..(196): Xaa can be any naturally occurring amino acid

SEQ ID NO: 14759 - protein, 436 aa, Saccharomyces cerevisiae
AVSKVYARSVYDSRGNPTVEVELTTEKGVFRSIVPSGAATGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 14760 - protein, 295 aa, Nostoc sp. PCC 7119
DVPVNLYRPNAPFIGKVISNEPLVKEGGIGIVQHIKFDLTGGNLKYIEGQSIGIIPPGVDKNGKPEKLRDYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 14761 - protein, 295 aa, Nostoc sp. PCC 7119
DVPVNLYRPNAPFIGKVISNEPLVKEGGIGIVQHIKFDLTGGNLKYIEGQSIGIIPPGVDKNGKPEKDRDYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 14762 - protein, 320 aa, Diospyros kaki
MEAFPVINMEILNGEGREAAMEKLRNACENWGFFEVVNHGISHELMDSVERLTKEHYKKFMEQRFKEMVASKGLEVVQSEINDLDWESTFFLRHLPSSNLSELPDLEDDYKKAMKEFAEDLEKLAEQLLDYLCENLGLEKGYLKKAFYGSKGPTFGTKVSNYPPCPRPELIKGLRAHTDAGGIILLFQDDKVSGLQLLKDGQWIDVPPLKHSIVINIGDQLEVITNGKYKSVMHRVIAQTDGNRMSIASFYNPGSDAVIYPAPALVEKEADHEQKQVYPKFVFEDYMKLYAGLKFQAKEPRFEAMKAMETPLNLGPIATV

SEQ ID NO: 14763 - protein, 168 aa, Rumex obtusifolius
MDAEVEYRCFVGGLAWATDDQSLERAFSNYGQVLESKIINDRETGRSRGFGFVTFSSEQAMRDAIEGMNGQDLDGRNITVNEAQSRGSGGGGGGYRGGGGGGYGGRREGGYNRGGGGGYGGGGGGYGGGGGGYGGGGGGYGGGRREGGYGGGGGDRYARGNSDSDWRN

SEQ ID NO: 14764 - protein, 426 aa, Hordeum vulgare subsp. vulgare
MAAADTSRVFLILIIALVMVIVVLLGICWRFLGPGIMRRLLRPRRCPSEVPEYFSGNMSGNLRTITYFDYVTLKKATKDFHQKNQLGRGGFGPVYLGKLDDGRKVAVKQLSVGKSGQGESEFFMEVNMITSIQHKNLVRLVGCCSEGTERLLVYEYMKNKSLDKILFAAADAPAPASAPPFLNWRTRHQIIIGIGRGLQYLHEESNLRIVHRDIKASNILLDDKFQPKISDFGLARFFPEDQTYLSTAFAGTLGYTAPEYAIRGELTVKADTYSFGVLVLEIISSRKNTDLNLPNEMQYLPEHAWRLYEQSKILELVDGRVQGGEGFEEKEVMLVCQIALLCVQPYPNSRPAMSEVVRMLTMKTDQSIPAPAKPAFLDRKNLNGDRDAASSDTATMEMMRSPAGYWMMTPSPMLEVDRPYDMSFGK

SEQ ID NO: 14765 - protein, 194 aa, Hordeum vulgare subsp. vulgare
MMLSSAYSTPAADELGGPPPLPPPPGADVSVIVGALTGVLLGLFLFLIYAKHCRQRGRGGARGAAGGLGLGFRASSTCDRCRSGVSLSVVDALPVVRFGDMGGAAAAAQPECAVCLGTFDPAADELLRVLPKCRHAFHADCVDTWLEAHSTCPVCRRRVGKEDAFAVIPELEAADADWYPAREAEMQIVVRRPA

SEQ ID NO: 14766 - protein, 336 aa, Neurospora crassa
MARVYADVNQNMPRAYWDYDSVNISWGVLENYEVVRKIGRGKYSEVFEGINVVNYQKCVIKVLKPVKKKKIKREIKILQNLAGGPNIVALLDVVRDSQSKTPSLIFEYVNNTEFRTLYPRFNDFDVRYYIFELLKALDFCHSKGIMHRDVKPHNVMIDHENRKLRLIDWGLAEFYHPGTEYNVRVASRYFKGPELLVDFQEYDYSLDMWSLGAMFASMIFRKEPFFHGQSNSDQLVKIAKVLGTDELFDYLDKYEIELDAQYDDILGRFQRKPWHSFINAENQRFVSNEAIDFLDKLLRYDHNERLTAKEAMAHPYFAPVRDEATRARYLAGETIN

SEQ ID NO: 14767 - protein, 333 aa, Neurospora crassa
MSSSSGVPESWIASFCSLLGHEYFAEVSEEFIEDDFNLTGLQTQVAMYKEALEMILDVEPEDDDDEEEEDEEDEEDMSGGDGINKPHGERRHHSRIASDLSVIESSAEMLYGLIHQRFICSRAGIQQMSEKYELGHFGICPRTNCNQTRTLPVGLSDTPGEDTVKLFCPSCLDVYVPPNSRFQTVDGAFFGRTFGALFLMTFPEYDLTKTGAESVSNLTRSGSDDTTVINGMYARNIAPGLGRGKIYQPKIYGFKVSEIARSGPRMQWLRSKPDDLSVLDEARRYAEQQGSDDEDESMGVSSRTASRRRGPPRRQKQNGSPMAIEQNGAESEL

SEQ ID NO: 14768 - protein, 285 aa, Neurospora crassa
MDDFVSESESDYASYWRDWFISSRGNEYFCEIDEDYITDRFNLTGLNTEVQYYQYALDLITDVFDLDCDDDMRETIEKSARHLYGLVHARYIVTTRGLQKMFEKYKKADFGKCPRVMCSSHPLLPMGLSDVPNSKPVKLYCARCEDIYNPKSSRHAAIDGAYFGTSFHNIFFQVYPTLVPAKSVERYIPRCYGFKVHAAAALVRWQNSQRDEMRRRLRKLEVESGFKDAEDEAELDDDDEEEEEEEEEEEELAAMDEAEGAQQQHAAAAAGTATGGVAAGGEGVH

SEQ ID NO: 14769 - protein, 376 aa, Oryza sativa (indica cultivar-group)
MATAGKVIKCKAAVAWEAGKPLSIEEVEVAKEMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFIGTSTFSEYTVMHVGCVAKINPAAPLDKVCVLSCGISTGLGATINVAKPKGSTVAIFGLGAVGLAAAEGARIRGASRIIGIDLNANRFEEARKFGCTEFVNPKDHDKPVQQVLAEMTNGGVDRSVECTGNINAMIQAFECVHDGWGIAVLVGVPHKDAEFKTHPMNFLNERTLKGTFFGNYKPRTDLPNVVELYMKKELEVEKFITHSVPFSEINTAFDLMHKGEAIRCIIRMEN

SEQ ID NO: 14770 - protein, 203 aa, Escherichia coli O157:H7
MLTEQQRRELDWEKTDGLMPVIVQHAVSGEVLMLGYMNPEALDKTIESGKVTFFSRTKQRLWTKGETSGNFLNVVNIAPDCDNDTLLVLANPIGPTCHKGTSSCFGDTAHQWLFLYQLEQLLAERKSADPETSYTAKLYASGTKRIAQKVGEEGVETALAATVHDRFELTNEASDLMYHLLVLLQDQDLDLTTVIENLRKRHQ

SEQ ID NO: 14771 - protein, 500 aa, Arabidopsis thaliana
MATIWFLSLLFLCCILLAAFKHKKRRTNQQQPPSPPGFPIIGNLHQLGELPHQSLWSLSKTYGPVMLLKLGSVPTVVVSSSETAKQVLKINDLHCCSRPSLAGAKELSYNYLDIAFSPFDDYWKELRRICVQELFSAKRVHSIQPIKEEEVRKLIVSATESASQKSPVNLSEKFLDLTVSVICKAAFSLDFHTSVLNNDGFDKLIHDAFLFLGSFSASNFFPNGGWIIDWLTGLQRRREKSVKDLDVFYQQMFDLHKQENKQGVEDFVDLLLKLEKEETVLGYGKLTRNHVKAILMNVLLGAINTSAMTMTWAMAELIRNPRVMKKVQSEIRNQMINKSVITLDDIDHLPYLKMVIKETWRLHPPVPLLLPREVMSEFEINGYKIQPKTLLYVNVWAIGRDPDSWKDADMFYPERFMDNNIDAKGQNFELLPFGSGRRICPGMYMGTTMVEFGLANMLYQFDWEVPDGMVVEDIDMEESPGLAVGKKNELLLVPVKYLGH

SEQ ID NO: 14772 - protein, 412 aa, Arabidopsis thaliana
MGICLSAQIKAVSPGASPKYMSSEANDSLGSKSSSVSIRTNPRTEGEILQSPNLKSFTFAELKAATRNFRPDSVLGEGGFGSVFKGWIDEQTLTASKPGTGVVIAVKKLNQDGWQGHQEWLAEVNYLGQFSHPNLVKLIGYCLEDEHRLLVYEFMPRGSLENHLFRRGSYFQPLSWTLRLKVALGAAKGLAFLHNAETSVIYRDFKTSNILLDSEYNAKLSDFGLAKDGPTGDKSHVSTRIMGTYGYAAPEYLATGHLTTKSDVYSYGVVLLEVLSGRRAVDKNRPPGEQKLVEWARPLLANKRKLFRVIDNRLQDQYSMEEACKVATLALRCLTFEIKLRPNMNEVVSHLEHIQTLNEAGGRNIDMVQRRMRRRSDSVAINQKPNAGFARQTAVGVIATAYPRPSDSPLFV

SEQ ID NO: 14773 - protein, 462 aa, Arabidopsis thaliana
MKCFHFTNGDKRTTTTIEEGVGGGDSVVSRASRLSWARSLSVASSTTSDPTRRSEFDSDWSFSPERLTFPKPLSQRWIGGLVPENDLKVFTFKELKIATKGFNRGLLIGEGGFGCVYRGVVDVSDSNGFDSKINVAVKQLNRQGLQGHKEWINEVNFLGVVNHPNLVKLVGYCADDDERGMQRLLVYELMCNKSLEDHLVGRVVSVSLPWMMRLKIAQDAAQGLAYLHEEMDFQLIFRDFKSSNILLDERFGAKLSDFGLARQGPPEGLGHVSTSVVGTVGYAAPEYVQTGKLTAKSDVWSFGVVLYELITGRRAVDRNRPRGEQKLLEWVKPYVSDSKKFHLIVDPRLEGQYYCMKSVQRVAALANKCLMKQPKSRPKMSEVVSLLGRIIDEEAENVPPPVADETEEIIKAELNGESEPELKKQGSSYRKKVLDLRDKMNLNKSLSKLDWRNWTPGLVRTW

SEQ ID NO: 14774 - protein, 1611 aa, Arabidopsis thaliana
MLPVLLEKLKEKKQSVTDPLTQTLQTMYKAGCLNLVDVIEDVKTAVKNKVPLVRSSTLTWLTFCLETSNKALILKAHKEYVPLCMECLNDGTPDVRDAAFSALAAIAKSVGMRPLERSLEKLDDVRKKKLSEMIAGSGGGDQAGTSSVTVQSSVGSTATGNSDASFVRKSAASMLSGKRPAPSAQASKKVGTGKPGGGKKDGSVRNEGSKSVEPPEDVEPAEMGLEEIENRLGSLVKPETVSQLKSSVWKERLEATLALKEEIEGLQELDKSVEILVRLLCAVPGWNEKNVQVQQQVIEIITYISSTAAKFPKKCVVLCITGTSERVADIKTRASAMKCLTAFCEAVGPGFVFERLFKIMKEHKNPKVLSEGLLWMVSAVDDFGVSLLKLKDLIDFCKDVGLQSSTAATRNATIKLLGALHKFVGPDIKGFLNDVKPALLSALDTEYEKNPFEGTAAPKRVVKTSVSTSTSSGGLDSLPREDISTKITPNLLKGFESPDWKMRLESIEAVNKILEEANKRIQPTGTGELFGGLRGRLLDSNKNLVMQTLTTIGGVAAAMGPAVEKASKGILSDVLKCLGDNKKHMRECTLAALDLWLGAVHLDKMIPYIIIALTDGKMGAEGRKDLFDWLTKQLTGLSDFVDAIHLLKPASTAMTDKSADVRKAAEGCISEILRVSGQEMIEKNLKDIQGPALALVLEKVRPGFVQEPFESSKAMAGPVSKGVTKISKSTSNGTLKQGNRSRAVPTKGSSQITSVHDIAIQSQALLNTKDSNKEDRERVVVRRIKFEELRPEQIQDLENDMMKFFREDLQKRLLSPDFKKQVDGLEILQKALPSVSKEIIEVLDVLLRWFVLQFCKSNTTCLLKVLEFLPELFNTLRDEEYCMTEAEAAIFLPCLAEKLGHNIEKVREKMRELMKQIIQAYSVGKTYPYILEGLRSKNNRTRIECTDLIGYLLETCGTEIGGLLKYLNIVASLTAERDGELRKAALNTMATGYQILGADIWKYVGKLTDAQKSMIDDRFKWKAKDMEKRREGKPGEARAALRRSVRDSGPEVAEQSGDISQTVPGPLFPRQSYGISEQMLERTPVPRTIAGVNGPTDWNEALDIIMFGSPEQSVEGMKVVCHELAQASNDPEESAIDELVKDADGLVSCLANKVAKTFDVSLMGASSRSCKYVLNTLMQTFQNKKLAHAVKEGTLESLITELLLWLLDERVPRMEDGSQLLKALNVLMLKILDNADRTSSFVVLISLLRPLDPSRWPSPATAEVYAVRNQKFSDLVVKCLIKLTKLLQSTIYEVDLDRLLQSIHVYLQDLGMEEIRRRAGADDKPLRMVKTVLHELVKLRGAAIKGHLSLVPIDMRPQPIILAYIDLNLETLAAARMLTATGPVGQTHWTDSTANNPSPPANSADVQLKQELGAIFKKIGDKQTSTIGLYDLYHITKSYPKVDIFSQLQNASEAFRTYIRDGLAQVEKNAAAGRTPSSLPLSTPPPSSLALPSPDIPSLSSLDVKPLMNPRSDLYTDDIRASNMNPGVMTGTLDAIRERMKNMQLASSEPVSKPLMPTNDNLSMNQQSVPPSQMGQETVHTHPVVLPMDEKALSGLQARMERLKGGSLEHM

SEQ ID NO: 14775 - protein, 296 aa, Arabidopsis thaliana
MEANSGGGGGAEGGRAVTGGGGGGGGSDVELVSKTLQVEHKLFYFDLKENPRGRYLKISEKTSATRSTIIVPSSGISWFLDLFNYYVNSEEHELFSKELQLDSKVFYFDIGENRRGRFLKVSEASVSRNRSTIIVPAGSSPDEGWAAFRNILAEIHEASGLFVMPNQVKPSDGQEHLVDDVGAGFIPGHGSQQPSSSEHNVDRTIDSPGQEETGMTGVSKVIRADQKRFFFDLGNNNRGHFLRISEVAGSDRSSIILPLSGLKQFHEVIGHFVEITKDKIEGMTGANVRTVDPPQR

SEQ ID NO: 14776 - protein, 255 aa, Arabidopsis thaliana
MTKDFAVPPVVFPSGGSSGGANVQQRRFPATPFQPPRPSSSAIPFMSFDIGSAAASSATPAGPFGGTIASSSSFGGGSASFEDEEPLLDELGIHPDQIWKKTRSILNPFRINQAVHKDSDLSGPIFLYLALCLFQLLAGKIQFGVILGWIVVSSIFLYVVFNMLAGRNGNLNLHTCTSLVGYCLLPVVVLSAVSLFVPQGAGPVRFVLAALFVLWSTRACSTLVVSLADGGEEHRGLIAYACFLIYTLFSLLVIF

SEQ ID NO: 14777 - protein, 452 aa, Arabidopsis thaliana
MGSRDYISSLPDEILGKILSLFCTNRAACTSVLSKRWRNLLELVDNLDLNDAYGNHQYFCDFVDRTLALLSNSTTVKRFSLNCAFHNDASRVNSWIRTVFDRGFLDLHLETAHMHRIDTEFFTSNTLLELTICGGFYAEGRLPPGRVFFPALKSLSLVSVEFTDTLMYQNFISGCPVLEELFLHYDNETQCPAWKGLVSSPSIKRLNIYDNPSELRYEAYKCCFQIPSLVYLDYSSYVAKQYAVDLVSLEEARLNIRYPERLVDQNEDIFGDVTDLLKGISNVKTLHLSSDSLEVFHLCCDTMPVFHNLLTLSFESDEEIGWQVVPLLLNKSPNLETLVIKSLVHQVTDMCGNACACISKRRKKKKKTTEDDECCLSTCQVKVLNISGYRGTCKELKQMRHFLENLKCLETVNVGVDVKRREYKNGNNKYQRITNAVMELPRFSSNCQIQFF

SEQ ID NO: 14778 - protein, 116 aa, Pinus pinaster
TVFTVILYGSPLSVIRLVIHTKSVEFMPSFYFSLFAFLGSVLWMVYGALSGDILIMAPNFVGIPLGLSQMALYCIYWNNSPVRVEATKLEAGGELKSIEQNIKEDIELYTEDIEKA

SEQ ID NO: 14779 - protein, 465 aa, Clethra barbinervis
VGFKAGVKDYKLTYYTPDYETKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRATFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDYIEKDRSRGIYFSQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTI

SEQ ID NO: 14780 - protein, 468 aa, Gordonia axillaris
KASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTWEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 14781 - protein, 465 aa, Monotheca buxifolia
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVCARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDYVEKDRSRGIYFTQDWVSLPGVLPVASGGIHVWHMPALTEIFGDDSVLQFGGGTIGHPWGNAPGAVANRVALEACVQARNEGRDLAREGNEIIREASKWSPELTAACEVWKEIKFEFEAMDTL

SEQ ID NO: 14782 - protein, 465 aa, Pouteria obovata
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRVPPAYSKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHVHAGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIRAASKWSPELAAACEVWKEIKFEFEAMDTL

SEQ ID NO: 14783 - protein, 462 aa, Samolus repens
  misc_feature (459)..(459): Xaa can be any naturally occurring amino acid
KAGVKDYKLTYYTPEYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAXDTL

SEQ ID NO: 14784 - protein, 463 aa, Shortia exappendiculata
SKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPAAYAKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIRQAAKWSPELAAACEVWKEIKFEFEAMDTL

SEQ ID NO: 14785 - protein, 462 aa, Schizocodon soldanelloides
KAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMLKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDYVEKDRSRGIYFTQDWVSLPGVLPVASGGIHVWHMPALTEIFGDDSVLQFGGGTLGHPWGNAPGGVANRVALEACVQARNEGRDLAREGNEIIRQAAKWSPELAAACEVWKEIKFEFEAMDTL

SEQ ID NO: 14786 - protein, 467 aa, Sarcosperma laurinum
ASVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDYVEKDRSRGIYFTQDWVSLPGVLPVASGGIHVWHMPALTEIFGDDSVLQFGGGTIGHPWGNAPGAVANRVALEACVQARNEGRDLAREGNEIIREASKWSPELAAACEVWKEIKFEFPAMDTL

SEQ ID NO: 14787 - protein, 329 aa, Arabidopsis thaliana
MTSSNGDNKGLVVSFGEMLIDFVPTESGVSLSESSGFLKAPGGAPANVAIAVSRLGGRAAFVGKLGDDEFGHMLAGILRKNDVDDQGINFDKGARTALAFVTLRSDGEREFMFYRNPSADMLLRPDELNLELIRSAKVFHYGSISLITEPCRSAHMKAMEVAKEAGALLSYDPNLREPLWPSPEEARKQIMSIWDKADIIKVSDVELEFLTGNKTIDDETAMSLWHPNLKLLLVTLGENGCRYYTKDFHGSVETFHVDAVDTTGAGDSFVGALLNQIVDDQSVLEEEERLRKVLRFANACGAITTTKKGAIPALPTDCEALSFLKIQVE

SEQ ID NO: 14788 - protein, 325 aa, Arabidopsis thaliana
MASNGDKGLIVSFGEMLIDFVPTESGVSLAEAPGFLKAPGGAPANVAIAVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFVGALLNQIVDDRSVLEDEERLRKVLRFANACGAITTTKKGAIPALPSDAEVRSFLEKK

SEQ ID NO: 14789 - protein, 281 aa, Arabidopsis thaliana
MSTSAASLCCSSTQVNGFGLRPERSLLYQPTSFSFSRRRTHGIVKASSRVDRFSKSDIIVSPSILSANFAKLGEQVKAVELAGCDWIHVDVMDGRFVPNITIGPLVVDALRPVTDLPLDVHLMIVEPEQRVPDFIKAGADIVSVHCEQQSTIHLHRTVNQIKSLGAKAGVVLNPGTPLSAIEYVLDMVDLVLIMSVNPGFGGQSFIESQVKKISDLRKMCAEKGVNPWIEVDGGVTPANAYKVIEAGANALVAGSAVFGAKDYAEAIKGIKASKRPAAVAV

SEQ ID NO: 14790 - protein, 327 aa, Arabidopsis thaliana
MDLFSSLPNELLYHILSFLSTKEAALTSVLSKRWRNLFAFVPYLEFDDSVFLHPEERKREKEGILQSFMDFVDRVLDLHGDSLIKTFSLKCKTGVDSDHVDRWICNVLARGVSDLDLFIDFRDLYSLPHEVGVSRTLVVLRVGSESDLYWWQKFLCLPMLKTLVLDSCWLCIGQFQILLLACPALEELDMTNTRWKDSNVTVSSSILKELTIDLHGCCSVVNLKSLSFDAPSLVYFYYCDSLAEDYPQVNLKNLVEAQINLLLTQAQIEQVRALNNEMLVADDVFPGLGNAWKLITGLRNVQQLYLSPDTLEVSFLSLVYFWLVGRI

SEQ ID NO: 14791 - protein, 467 aa, Arabidopsis thaliana
MDISALFLTLFAGSLFLYFLRCLISQRRFGSSKLPLPPGTMGWPYVGETFQLYSQDPNVFFQSKQKRYGSVFKTHVLGCPCVMISSPEAAKFVLVTKSHLFKPTFPASKERMLGKQAIFFHQGDYHAKLRKLVLRAFMPESIRNMVPDIESIAQDSLRSWEGTMINTYQEMKTYTFNVALLSIFGKDEVLYREDLKRCYYILEKGYNSMPVNLPGTLFHKSMKARKELSQILARILSERRQNGSSHNDLLGSFMGDKEELTDEQIADNIIGVIFAARDTTASVMSWILKYLAENPNVLEAVTEEQMAIRKDKEEGESLTWGDTKKMPLTSRVIQETLRVASILSFTFREAVEDVEYEGYLIPKGWKVLPLFRNIHHSADIFSNPGKFDPSRFEVAPKPNTFMPFGNGTHSCPGNELAKLEMSIMIHHLTTKYSWSIVGASDGIQYGPFALPQNGLPIVLARKPEIEV

SEQ ID NO: 14792 - protein, 397 aa, Pseudomonas syringae
MNSAGNAFVRLQGLLDDLPPAPGLPVIALHLGESRLGDPISLLEPLSELCDWTRYPPLTATTQLREAYSHWLQRRFGIAASLGNSIAIEPTPGTKQAVATCIALAVTRARARGVATPVVVLPNPFYPTYVAATDAAGARALFYDLSNGQLEANLAVQLALAGDSVAALVLCNPGNPLGKILAADTLAAISRQAHLAQASLLVDECYTDLVWHSAPPGYLSLVEAGTVAPCPFVVLHSLSKRSAAPGLRSGFIAGDPQSVADYANFNRSCGVSLAWPTCAASAALWQDDAHVQKQTQALKRNWDMADNCLAQVPGYQRAEAGFFLWLPVADGEDAARRLWTKQGLRVMPGRYLCHAESNGSNPGNGFVRLALVHQQSIMSEALLRLRAELTGLEAAQT

SEQ ID NO: 14793 - protein, 439 aa, Arabidopsis thaliana
MDLSSRFSSILILLLISISIASAEIRKSEIRSDDRPIIPLDEFGFTHSGRLELDASKIWLSNSNPDLDLSKVGFFLCTRDAWVHVIQQLEEEEITCALQSDLVKHVFTFNNLKGGDKSRFSTVFTENDADQYSLVFANCLQQVKISMDVRSAMYNLEGKKGGRDYLSAGRTVLPKVYFLFSVIYFSLAATWIYVLYKKRLTVFAIHFFMLGVVVLKALNLLCEAEDKSYIKKTGTAHGWDVLFYIFNFLKGITLFTLIVLIGTGWSFLKPYLQDKEKKVLMIVIPLQVVANFAQVVIDETGPYGQDWVTWKQIFLLVDVVCCCAVLFPIVWSIKNLREAAKTDGKAAVNLVKLTLFRQYYIVVICYIYFTRVVVYALETITSYKYMWTSVVASELATLAFYLFTGYKFRPEVHNPYFVVDDEEEEAAAEALKLEDEFEL

SEQ ID NO: 14794 - protein, 489 aa, Arabidopsis thaliana
MGGQCSSLSCCRNTSHKTAVLEAPDVDNGESSEITDVPNFREYTLEQLKAATSGFAVEYIVSEHGEKAPNVVYKGKLENQKKIAVKRFTRMAWPDSRQFLEEARSVGQLRSERMANLLGCCCEGDERLLVAEFMPNETLAKHLFHWETQPMKWTMRLRVVLYLAQALEYCTSKGRTLYHDLNAYRVLFDEECNPRLSTFGLMKNSRDGKSYSTNLAFTPPEYLRTGRITPESVIYSFGTLLLDLLSGKHIPPSHALDLIRDRNLQTLTDSCLDGQFSDSDGTELVRLASRCLQYEARERPNTKSLVTALTPLQKETEVLSHVLMGLPHSGSVSPLSPLGEACSRRDLTAMLEILEKLGYKDDEGVTNELSFHMWTDQMQESLNSKKKGDVAFRQKDFREAIECYTQFIDGGMISPTVCARRSLCYLMSDMPKEALDDAIQAQVISPVWHVASYLQSASLGILGMEKESQIALKEGSNLEAKMNGVPRVK

SEQ ID NO: 14795 - protein, 181 aa, Arabidopsis thaliana
MASSMFSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 14796 - protein, 382 aa, Arabidopsis thaliana
MSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATATASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 14797 - protein, 282 aa, Arabidopsis thaliana
MYKDRSGGGIMGGGGSSRSEILGGAIDRKRINDALDKHLKKSSPSTSRVFTSKDKDSVPSTSTAKSQLHSRSPDVESDTDSEGSDVSGSEGDDTSWISWFCNLRGNEFFCEVDEDYIQDDFNLCGLSGQVPYYDYALDLILDVESSNGDMFTEEQHEMVESAAEMLYGLIHVRYILTTKGMAAMMEKYKNYDFGRCPRVFCCGQSCLPVGQSDIPRSSTVKIYCPKCEDIYYPRSKYQDIDGAYFGTTFPHLFLMAYGNMKPQKPAQNYVPKIFGFKVHNKQ

SEQ ID NO: 14798 - protein, 231 aa, Echinochloa crus-galli var. formosensis
VLPVFTGECKECAHCKSAESNMCDLLRINTDRGVMIGDGKSRFSINGKPIYHFVGTSTFSEYTVMHVGCVAKINPVAPLDKVCVLSCGISTGLGASINVAKPPKGSTVAIFGLGAVGLAAAEGARIAGASRIIGVDLNAARFEEARKFGCTEFVNPKDHDKPVQQVLAEMTNGGVDRSVECTGNINAMIQAFECVHDGWGTAVLVGVPHKDAEFKTHPMNFLNERTLKGTF

SEQ ID NO: 14799 - protein, 177 aa, Echinochloa crus-galli var. formosensis
YYEAGARLAKWRAVLNIGPNEPSQLAIDQNAQGLARYAIICQENGLVPIVEPEILVDGPHDIERCAYVTEKVLAACYKALNEHHVLLEGSLLKPNMVTPGSDAKKVANEVIAEYTVRALQRTVPAAVPAIVFLSGGQSEEEATLNLNAMNKLNTKKPWSLSFSFGRALQASTLKAWS

SEQ ID NO: 14800 - protein, 197 aa, Medicago truncatula
MSGSRFIKCVTVGDGAVGKTCLLISYTSNTFPTDYVPTVFDNFSANVVVDGSTINLGLWDTAGQEDYNRLRPLSYRGADVFLLAFSLISKASYENIAKKWIPELRHYAPGVPIILVGTKLDLRDDSQFFQDHPGAAPITTAQGEELRKLIGAPVYIECSSKTQKNVKAVFDSAIKVVLQPPKQKKTKRKGQKACSIL

SEQ ID NO: 14801 - protein, 197 aa, Medicago truncatula
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIILVGTKLDLRDDKQFFVDHPGAVPITTAQGEELRKLINAPAYIECSSKSQQNVKAVFDAAIRVVLQPPKQKKKKSKAPKACSIL

SEQ ID NO: 14802 - protein, 345 aa, Arabidopsis thaliana
MLSLSCSSSSSSLLPPSLHYHGSSSVQSIVVPRRSLISFRRKVSCCCIAPPQNLDNDATKFDSLTKSGGGMCKERGLENDSDVLIECRDVYKSFGEKHILKGVSFKIRHGEAVGVIGPSGTGKSTILKIMAGLLAPDKGEVYIRGKKRAGLISDEEISGLRIGLVFQSAALFDSLSVRENVGFLLYERSKMSENQISELVTQTLAAVGLKGVENRLPSELSGGMKKRVALARSLIFDTTKEVIEPEVLLYDEPTAGLDPIASTVVEDLIRSVHMTDEDAVGKPGKIASYLVVTHQHSTIQRAVDRLLFLYEGKIVWQGMTHEFTTSTNPIVQQFATGSLDGPIRY

SEQ ID NO: 14803 - protein, 510 aa, Arabidopsis thaliana
MGGDDLSFTRLVITALFGLLMLLQIKETSASTSFVSSSVCKSDHLTYTKPYQQGSLFTINGNPVEKLRFCEALRFHKANGCIFEDSFSDDFCTIHSLLGRRFLEEKTVKDSKNSKPKTEYSHVKVSIAGSGFLLLCCALCCPCFHKERKANSHEVLPKESNSVHQVSSFEMSPSSEKIPQSPFRAPPSPSRVPQSPSRYAMSPRPSRLGPLNLTMSQINTATGNFADSHQIGEGGFGVVFKGVLDDGQVVAIKRAKKEHFENLRTEFKSEVDLLSKIGHRNLVKLLGYVDKGDERLIITEYVRNGTLRDHLDGARGTKLNFNQRLEIVIDVCHGLTYLHSYAERQIIHRDIKSSNILLTDSMRAKVADFGFARGGPTDSNQTHILTQVKGTVGYLDPEYMKTYHLTAKSDVYSFGILLVEILTGRRPVEAKRLPDERITVRWAFDKYNEGRVFELVDPNARERVDEKILRKMFSLAFQCAAPTKKERPDMEAVGKQLWAIRSSYLRRSME

SEQ ID NO: 14804 - protein, 395 aa, Arabidopsis thaliana
MGSCFSSRVKADIFHNGKSSDLYGLSLSSRKSSSTVAAAQKTEGEILSSTPVKSFTFNELKLATRNFRPDSVIGEGGFGCVFKGWLDESTLTPTKPGTGLVIAVKKLNQEGFQGHREWLTEINYLGQLSHPNLVKLIGYCLEDEHRLLVYEFMQKGSLENHLFRRGAYFKPLPWFLRVNVALDAAKGLAFLHSDPVKVIYRDIKASNILLDADYNAKLSDFGLARDGPMGDLSYVSTRVMGTYGYAAPEYMSSGHLNARSDVYSFGVLLLEILSGKRALDHNRPAKEENLVDWARPYLTSKRKVLLIVDNRLDTQYLPEEAVRMASVAVQCLSFEPKSRPTMDQVVRALQQLQDNLGKPSQTNPVKDTKKLGFKTGTTKSSEKRFTQKPFGRHLV

SEQ ID NO: 14805 - protein, 381 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 14806 - protein, 281 aa, Pisum sativum
MASATSSLCSSTLQSQINGLSLRKTSLLHSPSLTFSRRKFSTVVKASSRVDKFSKSDIIVSPSILSANFAKLGEQVKAVELAGCDWIHIDVMDGRFVPNITIGPLVVDALRPVTDLPLDVHLMIVEPDQRVPDFIKAGADIISVHCEQSSTIHLHRAVNQVKSLGAKAGVVLNPGTPLSAIEYVLDVVDLVLIMSVNPGFGGQSFIESHVKKIAELRRLCVEKGVNPWIEVDGGVTPANAYKVIEAGANALVAGSAVFGAKDYAEAIKGIKASKRPEPVAV

SEQ ID NO: 14807 - protein, 378 aa, Thellungiella halophila
MLSTLMKLLSACLWPSSSGKSSDSTGKQDGLLWYKDSGQHLLGEFSMAVVQANNLLEDQSQVESGPLSTLDSGPFGTFIGIYDGHGGPETSRFVNDHLFQHLKRFAAEHASMSVDVIRKAYEATEEGFLGVVTKQWPVKPQIAAVGSCCLVGVICGGRLYIANVGDSRAVLGRAMNATGEVIALQLSAEHNVSIESVRQEMRSLHPDDSHIVVLKHNVWRVKGLIQISRSIGDIYLKKAEFNKEPLYTKYRLREPIKRPILSGEPSITEHEIQPQDQFLIFASDGLWEQMSNQEAVDIVQNHPRNGIARRLVKMALQAAAKKREMRYSDLKKIERGVRRHFHDDITVVVIFLDTNVVSSAKGPSLSIRGGGMTFPKKL

SEQ ID NO: 14808 - protein, 409 aa, Thellungiella halophila
MPFVGDELHHSGWNSCSSCHGDASADRRYLVLPSLISGRIYAIDTKENPRAPSLYKYVDPKEIAEKTGLAYPHTAHCLASGEILVSCLGDEEGNAKGNGFLLLDSDFNIKNRWEKPGHSPLFGYDFWYQPRHKTMISTSWGAPKAFSKGFDLQHVADGLYGSHLHVYSWPGGEMKQLIDLGETGLLPLEIRFLHDPSKDTGYVGSALSSNMIRFFKNSDDTWSYEIVISVKPLKVENWILPEMPGLITDFLISLDDRFLYFVNWLHGDIRQYNIEDPKNPVLTGQIWVGGLLQKGSPVKAVGEDGNSFQFDVPQIKGKSLRGGPQMIQLSLDGKRLYATNSLFSAWDRQFYPELMDKGSHIIQIDVDTEKGGLSINPNFFVDFGDEPEGPALAHEMRYPGGDCTSDIWI

SEQ ID NO: 14809 - protein, 214 aa, Thellungiella halophila
MGVKRSPNMCASVGIQGIAWAFGGMIFALVYCTAGISGGHINPAVTFGLFLARKLSLTRAVYYIVMQCLGAICGAGVVKGFQPKQYQALGGGANTIAHGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 14810 - protein, 501 aa, Clarkia modesta
MASPALISETEAWKDLKAHLEDIKMTHLRELMGDTERCQSMMVEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKKLKDVIAVGIGGSFLGPLFVHTALQTDPESSKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNVPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISILLPTLDAYRIGQLLAIYEHRVAVQGFV

SEQ ID NO: 14811 - protein, 494 aa, Geobacillus stearothermophilus
SSIAAPKLKEKVEKFLSGKKKMYINGSFVESASGKTFDTPNPATGERLATVYEGDAEDIDRAVKAAREAFDRGPWSRMSAAERSRLMYKLADLMEENKEELAQLETLDNGKPIRETINADVPLAIEHMRYYAGWSTKIVGQTIPVNGPYFNYTRHEPVGVVGQIIPWNFPLLMAMWKLGAALATGCTVVLKPAEQTPLSALYLAELIEEAGFPAGVVNIVPGFGETAGDALVKHPQVDKIAFTGSTEVGKLIMANASKSLKRVTLELGGKSPNIILPDADFSKAIPGALNGVMFNQGQVCCAGSRVFIQKKQYDNVVADMVSHAKSIKQGFGLKADTEMGPLVSSEQQNRVLGYIEKGLEEGAELLTGGQKPSEQGYFVEPTIFANVEDSMTISKEEIFGPVIAALPYEDIDELIERANDTNYGLAAGVWTRDVTKAHYIANKLRAGTVWVNCYNVFDAASPFGGYKESGIGREMGSYALDNYTEVKSVWIAQN

SEQ ID NO: 14812 - protein, 169 aa, Clarkia similis
SFYQLIHQGRVIPCDFIGVVKSQQPVYLKGEVVNNHDELMSNFFAQPDALAYGKTPEELKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLQATSDVPA

SEQ ID NO: 14813 - protein, 178 aa, Clarkia similis
SFYQLIHQGRVIPCDFIGVVKSQQPVYLKGEVVNNHDELMSNFFAQPDALAYGKTPEELKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLQATSDVPADPSTLLPNI

SEQ ID NO: 14814 - protein, 168 aa, Clarkia similis
SFYQLIHQGRVIPCDFIGVVKSQQPVYLKGEVVNNHDELMSNFFAQPDALAYGKTPEQLKKENVSEHLIPHKTFTGNRPSISILLPTLDAYRIGQLLAIYEHRVAVQGFVWGINSFDQWGVELGKSLATQVRKQLHASRVKGEPVEGFNFSTKTLLTRYLEATSDVPT

SEQ ID NO: 14815 - protein, 169 aa, Clarkia similis
SFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQGFVWGINSFDQWGVELGKSLATQVRKQLHASRVKGEPVEEGFNFSTKTLLTRYLQATSDVPA

SEQ ID NO: 14816 - protein, 501 aa, Clarkia unguiculata
MASPALISETEAWKDLKAHLEGIKMTHLRELMGDTERCQSMMVEFDNIFLDYSRQQASPDTISKLYKLADAAYLKQKIDRMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALTYGKTPEQLKKENVSEHLIPHKTFTGNRPSISILLPTLDAYRIGQLLAIYEHRVAVQGFV

SEQ ID NO: 14817 - protein, 380 aa, Clarkia unguiculata
MATPSLISETETWKDLKAHLEGIKKTHLRELMGDTERCQSMMVEFDNIFLDYSRQQASPDTINKLYKLADEAHLKQKIDRMYNGDHINSTENRSVLHVALRAPRNSAICSDGKNVVPDVWNVLDKIKDFSERVRSGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 14818 - protein, 228 aa, Legionella gresilensis
AAAISLVVSTAFAAPDSTNATNSTNSSANSTNASATTTSNTSTNLSSDMDKLSYSIGADLGRNFKKQGIDISPSAMAKGLQDGMSGGQLQLTDDQMKDVLNKFQKDLMTKRNAEFTKKAEENKAKGDAFLNQNKSKDGVVALPSGLQYKPLETGKGAKPGKDDTVTVEYTGKLIDGQVFDSTEKSGKPAEFKVSQVIPGWTEVLQLMPAGSTWEVYLPPSLAYGPRGI

SEQ ID NO: 14819 - protein, 277 aa, Rosa hybrid cultivar
ACENWGFFELVNHGISHELMDKVEKLTKEHYRKCVEQRFKEMVASKGLESVNSEIEDLDWESTFFLRHLPFSNISQIPDLDEDYREAMKEFAVELEKLAEKLLDLLCENLGLDKGYLKKAFYGSEGPNFGTKVSNYPPCPKPDLIKGLRAHTDAGGIILLFQDDKVSGLQLLKDDQWIDVPPMHHSIVINLGDQLEVITNGKYKSVMHRVIAQPDGNRMSIASFYNPGNDAFISPAPAMLEKQTEECPTYPKFVFDDYMKLYAGLKFQAKEPRFEAM

SEQ ID NO: 14820 - protein, 398 aa, Candida albicans
MFLKNIFIGLAIALLVDATPTTTKRSAGFVALDFSVVKTPKAFPVTNGQEGKTSKRQAVPVTLHNEQVTYAADITVGSNNQKLNVIVDTGSSDLWVPDVNVDCQVTYSDQTADFCKQKGTYDPSGSSASQDLNTPFKIGYGDGSSSQGTLYKDTVGFGGVSIKNQVLADVDSTSIDQGILGVGYKTNEAGGSYDNVPVTLKKQGVIAKNAYSLYLNSPDAATGQIIFGGVDNAKYSGSLIALPVTSDRELRISLGSVEVSGKTINTDNVDVLLDSGTTITYLQQDLADQIIKAFNGKLTQDSNGNSFYEVDCNLSGDVVFNFSKNAKISVPASEFAASLQGDDGQPYDKCQLLFDVNDANILGDNFLRSAYIVYDLDDNEISLAQVKYTSASSISALT

SEQ ID NO: 14821 - protein, 446 aa, Achlya bisexualis
MFGQLVLMAIAVVLPRALAVVPVNVMLPLDTVVSDGKGGTMLKNNGTLNTQFQKLKANGATGIMSDCWWGLVESAGPRQYNFKAYQDMAQLAQNNGLTIQMVMSFHQCGGNVGDNCNIPIPKQWFTRNDVWYTTRSGLTTTEYISLWADSTPLDKFGRTPLDMYREFMQAFKTNVVDKFPNTVVEVQIGTGPSGELRYPSYQLQNNRWSYCGIGEFTSYDKFAAQDMAAHAKATNNPLWGTSPGPSNAGDFNCQPGVSGNCPFFNDNGFDNYASNYGKFFLDWYTSSLLNHGRALSKIGRAIFPSPYVLSVKVSGIHWWYNSYHHGAELTAGYYNTNNNNAYLQIAKMLKENDIRFCFTCMEMTDANDQCRSQAGSLVGQVRNAVSQLSSLKTSFAGENALPMSSNGQVSTVARQIAGAADFTFLRLTDNFDWGYFAYIVSSLKQA

SEQ ID NO: 14822 - protein, 308 aa, Helianthus annuus
MAILSRYSSSNTLFCIEEQVHEDEDELTHQDSSAIHPLDLQDLCWEHEELVSLFTKEEEQQKQTPWPSSCTLSFRKEAVDWILKVKGCHGFTPLTAILAINYLDRFLSSLHFQKANTPWMIHLVAVTCLSLAAKIQETHVPLLLDLQLEESKFLFEAKNIQKTELLVMSTLKWRMNLVTPISFLDHIVRRLGLSNHLHWDFFKKCEAMILYLVADSRFVCYKPSVLATATMLCVVEEIDPTNSIGYKSQLLDLLKTTKDHINECYKLVMDLSYDNHNKGKRDENERTIYPVSPAGFIGFMCHESSNDS

SEQ ID NO: 14823 - protein, 357 aa, Zea mays
MERGAGASEKGTVLVTGASGFVGSWLVMKLLQAGYTVRATVRDPANVGKTKPLMDLPGATERLSIWKADLAEEGSFHDAIRGCTGVFHVATPMDFLSKDPENEVIKPTVEGMISIMRACKEAGTVRRIVFTSSAGTVNLEERQRPVYDEESWTDVDFCRRVKMTGWMYFVSKTLAEKAALAYAAEHGLDLVTIIPTLVVGPFISASMPPSLITALALITGNAPHYSILKQVQLIHLDDLCDAEIFLFENPAAAGRYVCSSHDVTIHGLAAMLRDRYPEYDVPQRFPGIQDDLQPVRFSSKKLQDLGFTFRYKTLEDMFDAAIRTCQEKGLIPLATAAGGDGFASVRAPGETEATIGA

SEQ ID NO: 14824 - protein, 371 aa, Acetobacter pasteurianus
MDVRAAVAFEAGRPLEIERVQLEGPRAGEVLVEVKATGLCHTDKYTLSGADPEGLFPAILGHEGAGVVVEVGAGVQHLRPGDHVIPLYTPECRECKSCLSRKTNLCTAIRATQGKGLMPDGTSRFSFKGQPIHHYMGCSTFANYTVLPEIALAKIRPDAPFDKVCYIGCGVTTGIGAVLFTAKVEPGSTVVVFGLGGIGLNVIQGAKMVGADRIIGVDINPAREAMARQFGMTDFVNPRDLGPNGDVVGHLVELTGGGADYTFECVGNPTLMRQALECAHRGWGVSTIIGVAAAGQEISTRPFQLVTGRRWIGSAFGGARGRTDVPKIVDWYMENRINIDDLITHKLPLERINEGFDMMERGESIRTVVEF

SEQ ID NO: 14825 - protein, 161 aa, Phaseolus vulgaris
SVEWEAGEAIGEKAASEWLYVVPWGLRKVLNYVSQKYATPIFCTENGMDDEESDNLPLHEMLDDKLRVRYFKGYLASVAQAIKDGVDVRGYCAWSLLDNFEWAQGYTKRFGLVYVDYKNGLSRHPKSSAYWFSRFLKAAENKNGKEDLVHHFLHCLLLYYL

SEQ ID NO: 14826 - protein, 421 aa, Azoarcus evansii
MDRAIEHTKYLIAGSSHAALEAINAIRMHDAEGPITVVTRDAHLPYSPTVLPYVVSGKSAPERIFLRDDDFFARNKVAYRPKAALKALHADRNTAELADGSSVVYEKLLLATGASPAIPPIPGIDTVSYHVLRTLDDALKLRGAIAESKQAVVLGAGLVGMHAAENLVKAGATVTIVEMSEQLTSGYFDKVAADMIEQAFRDAGGKIMTGSRVVRLEPTAAGAKLTLENGTTLEADLLLVATGVKPEMDYLNGSGVEHAQGILVDDRMQTTAENVWAAATAQARGFFTGTKVMNAILPDATIQGRVAGMAMAGDPGVKDYAGAVPLNTYHFFGRHAISVGSSTVPEGGEVVTRFDEKTGRYLKAIFAADGPLTGIFGVNEFFDGGVMAQLILRRTDLTPLRSRFVANPLAVGREIMSQTWR

SEQ ID NO: 14827 - protein, 307 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVNCVDSTGAGDAFVAGLLTGLSSTGLSTDEREMRRIIDLAQRCGALAVTAKGAMTALPCRQELESEK

SEQ ID NO: 14828 - protein, 457 aa, Erwinia chrysanthemi
MHKGVAFSLLASCALASVAAQAAEKVAFPDRVCNVTRYGAEGHRLQIALNTESFQKAIDECAAAGGGTVLVPAGNYLVEPLFLKSNVRLHLEKNATLVASTGENAYRATDSTRYAEAENGWLPFISIADAQNVAITGEGTIDGQGAVWWERWRAAIRATGKKGGTDRPRLIYVTRSNRVLIDGVTLTNSPSFHVVMRYAHDVTVNGTHIIAPWHAPNTDAIDPIDSQNIRITNNVIDCNDDHIAIKAEKPDSRFPNGVVDNIYIANNVLKQGRGISIGSETSGGVNNVLVENNRFEGSMYGIRIKSLRGKGGEVKNVTYRHTRMLDVEVPLVFSGYYQAAPIVQAEVDKLLQAGGFTLGEQIYPPDTEPAQPFDKVKTPHFSQVTIVDLESTGRSKAAGYIIGVPEAPLSGFHFEQVRIDAEKGLRVRNAELAAKGLTLNVKQGDALLLDKGANVTR

SEQ ID NO: 14829 - protein, 135 aa, Arabidopsis thaliana
MMNTKKLIKMFRKWQQRAALHRKRISFQRPSTRSTTVEKGCFVVYTADNTRFAFPISYLSNSVFQEILEISEEEFGLPTGGPITLPFDSVFLEYLIKLIKRRMDGDTEKALLMSISSARCSLQKQEQSTQQLLVF

SEQ ID NO: 14830 - protein, 380 aa, Sclerotinia sclerotiorum
MVEILSSALSLLALGAAVSAAPAPAPTAAPNVADALAAVEKRAGSCTFSGSSGAAAAIKSKASCATIVISAVAVPSGTTLDLTGLKSGTHVVFEGTTTFGYEEWSGPLVSVSGTDITVTGASGSVLDGNGAKYWDGKGTNGGKTKPKFFYAHSLKGKSSINNVKILNSPVQVFSINSASGLTLSGITIDNSAGNSLGHNTDAFDVGSSTDITISGANVQNQDDCLAINSGTGITFTGGTCSGGHGLSIGSVGGRSDNVVSDVIIESSTIKNSANGVRIKTVSGATGSVSGVTYKDITLSGITKYGVVIEQDYENGSPTGKPTSGVPITGVTLSNVHGTVSSSATNVYVLCAKCSGWTWDVNVTGGKTSTKCAGLPSGVKC

SEQ ID NO: 14831 - protein, 233 aa, Sulfolobus tokodaii
MSELVKISKTQFENVFQCEFNDGTVRLCTKNLAPGFSVYGERLFKVEGVEYREWNAFRSKLGGAILKGLKQNPIVKGTKVLYLGAASGTTPSHVSDIVELEGKVYGVEFSPRVVREFLLVAQHRPNLFPILADARFPQYYRTLVEDVDVLYVDIAQPDETDIAIYNAKFFLKNGGYMMMAIKARSIDVTKEPTEIYEMEVNKLKENNFDVIQVIQLDPYDKDHAMVLAKYKGK

SEQ ID NO: 14832 - protein, 490 aa, Arabidopsis thaliana
MESMIRIILLSLIIFITILFFIKQKKGKKSNTPASPPRLPLIGNLHQLGRHPHRSLCSLSNRYGPLMLLRFGLVPVLVVSSADVARDILKTYDRVFASRPRSKIFEKIFYEARDVALAPYGEYWRQMKSVCVLHLLTNKMVRSFRNVRQEEISLMMEKIQKSSSLQVNLSELLGSLTNDVISRVALGRKYSDETDFKELMKRLTKLLGEFCVGTYVPWLAWIDWISGLDGQLKKTGNDLDEFLEKVVQDHEDGDAQRTDFVDVLLRIQREKSVGFEIDRLSIKAIILDVVVGGTDTSYALMEWAMTELLHRPECLNRLQEEVRTICKGNSSVSEDDIKDMNYLKAVIKETMRLHPPLPLMVPHESTQDVRLGDYHIPAGTQVMINAWAIGREAATWGPDAEKFRPERHLNSSVDFRGHNFELIPFGAGRRICPAISFAVILIEVTLANLVHRYDWRLPEEYIEDQTNVAESTGMVIHRLFPLYAIVSSTT

SEQ ID NO: 14833 - protein, 336 aa, Arabidopsis thaliana
MEWIRRETIGHGSFSTVSLATTSGSSSKAFPSLMAVKSSGVVCSAALRNERDVLDDLGDCSEIVRCFGEGRTVENGEEIYNLFLEYASGGSLADRIKSSGEALPEFEVRRFTRSIVKGLCHIHGNGFTHCDIKLENVLVFGDGDVKISDFGLAKRRSGEVCVEIRGTPLYMAPESVNHGEFESPADIWALGCSVVEMSSGKTAWCLEDGVMNNVMSLLVRIGSGDEVPRIPVELSEEGKDFVSKCFVKNAAERWTAEMLLDHPFLAVDDESGEEDEACSVSPRNPFDFPGWNSVQSPVNDSVMFGSLVGSPEERISGLVSEKVPDWSVSCDWVNVR

SEQ ID NO: 14834 - protein, 350 aa, Arabidopsis thaliana
MGNLKKSTRSDELSRSGPPQIPNPDWNNLYHRTTVASCLVQGVYAKERDRENNRNGSESLATPWWKSFNFTLDESEILYDAFDGSIYGAVFQNMINYENTPNSIVVPPRYVIALRGTVPSDVSDWIHNSRIVLEKLHGGGKHMHVIRKIYSLVAKHGNTAVWIAGHSLGAGLALLAGKDMAMSGLPVEAYIFNPPISLIPLEQCGYNHELNFVYRLTRDLFKAGIAKVVDLDEGQEGPRYKNLASWRPHLFVNQSDVICSEYIGYFNHVVTMTEAGLGEISRLASGYSVRRMLFGDGENWSSSSTPDHLHFLPSAFMIVNKTEASEFYNKHGIHQWWNHMLKQSTTFSSY

SEQ ID NO: 14835 - protein, 469 aa, Arabidopsis thaliana
MADPTSKDDHDGEGGRDKSSTFVQKLIDVEEAKTQIIYSLPMIFTNLFYYCIPLTSVMFASQLGQLELAGATLANSWATVTGFAFMTGLSGALETLCGQGFGAKSYRMLGIHLQSSCIVSLVFTILITILWFFTESVFLLLRQDPSISKQAALYMKYLAPGLLAYGFLQNILRFCQTQCIVTPLVLFSFLPLVINIGTTYALVHLAGLGFIGAPIATSISLWIAFVSLGFYVICSDKFKETWTGFSMESFHHVVLNLTLSIPSAAMVCLEYWAFEILVFLAGLMRNPEITTSLVAICVNTESISYMLTCGLSAATSTRVSNELGAGNVKGAKKATSVSVKLSLVLALGVVIAILVGHDAWVGLFSNSHVIKEGFASLRFFLAASITLDSIQGVLSGVARGCGWQRLATVINLGTFYLIGMPISVLCGFKLKLHAKGLWIGLICGMFCQSASLLLMTIFRKWTKLTAATV

SEQ ID NO: 14836 - protein, 342 aa, Arabidopsis thaliana
MGHLVTVYERSDRIGGLMMYGVPNMKTDKIDVVQRRVDLMTKEGINFVVNANIGKDPSYSLDGLKEENDAIVLAVGSTKPRDLPVPGRDLSGVHFAMEFLHANTKSLLDSNHEDGNYISAKGKKVVVIGGGDTGTDCIGTSIRHGCTNIVNLELLPQPPSTRAPGNPWPQWPRVFRIDYGHQEATTKFGKDPRTYEVLTKRFIGDDNGNVKGLELVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAADQVDKFLTKTDVDEDAKLQQDLNQMKHNTITN

SEQ ID NO: 14837 - protein, 407 aa, Arabidopsis thaliana
MFRDSFLFARTIGCFGCFGSSGSRNQQSPKPYDDDTHSCDSDVTSTARGEEEEDEEEVEQKSRSKRSEEILKYRLDNGLICRHIPVRETNELIRGEDENGDKTINEYVRVCKIGSGSYGKVVLYRSTLDGQYYAIKAFHKSHLLRLRVAPSETAMSDVLREVMIMKILEHPNIVNLIEVIDDPETDHFYMVLEYVDGKWVYDGSGPPGALGEKTARKYLRDIVTGLMYLHAHDVIHGDIKPDILLVTSSGTVKIGDFSVSQVFKDDDDQLRRSPGTPVFTAPECCLVSGITYSGRAADTWAVGVTLYCMILGQYPFLADTLQDTYDKIVNNPLIIPDGLNPLLRDLIEGLLCKDPSQRMTLKNVSEHPWVIGEDGHVPEYFCWCKRNAASKIEEGEANGISETSDPN

SEQ ID NO: 14838 - protein, 344 aa, Cytophaga sp. KUC-1
MLPKTMKAAVIREFGSLLKIEEVEVKRPGRNEILVKVIASGVCHTDLHAVEGDWPVKPKMPLIPGHEAVGYVVAVGQEVKNVKEGDAVGVPWLYSACGGCDQCITGWETLCDTQQNGGYSVDGGFAEYVIADARYVGLLPSNVNFMEMAPILCAGVTVYKGLKETEVKPGEWVAISGIGGLGHVAVQYAKAMGMHVAAIDVADDKLDLAKKLGADLVVNAKNQNPGEFLKKEVGGMHGALITAVSPIAFKQGLETLRRKGTMALNGLPPGNFDLSIFDTVLNRITIRGSIVGTRKDMKEAIEFAVEGKVKATVTPAKLENINEVFDKMKKGQIEGRVVLEIAKA

SEQ ID NO: 14839 - protein, 501 aa, Aeromonas hydrophila
MRCPYLHGLITCWQEVKINMAVIPVIMAGGSGSRLWPMSREHFPKQFLNLYGNNSMLQETVNRLAEIECTAPLILCNEKHRFIVAEQLRQLDILANNIILEPVGRNTAPAIALAAIQSLKDVDDTHDPILLVLAADHLIKDQRAFTNAVNSAIPFAESGKLVTFGIVPNAPETGYGYIHRGSELKSFLNEDKAYGVNQFVEKPNLAVAKGYLTSGEYYWNSGMFMFSARRYLAELKLSRPDIYQACVASMNDIRSDLDFIRINNDEFKQCPSDSIDYAIMEKTSDAVVIPMDAGWNDVGSWSSLWDISDKDACGNVSRGDVILTESHNNYVSAESILVSTIGVDNLVIIQTKDAILVSNKDKVQDVKSIVEELKRCGRKEYKTHREVYRPWGQYDSIDDGNGYQVKKILIRPGERLSTQMHHHRAEHWIVVSGTAKVTNAEREFLITENESTFIPIGAIHSLENPGKVDLELIEIRSGKYLEEDDIIRFSDKYGRVDGGEK

SEQ ID NO: 14840 - protein, 187 aa, Glyptostrobus lineatus
ICTYFAQPLHQRDYTRWPEKPEGWREIVDKYSEALMGLASKLLGIVSEALGLEPEAVTKACVEMDQKVVINYYPKCPQPDMTLGLKRHTDPGTITLLLQDQVGGLQATKDDGLNWITVEPVQGAFVVNLGDHMHFLSNGKFKTADHQAVVNSNYSRLSIATFQNPSQEAIVYPLKLEEGEQSFMEEP

SEQ ID NO: 14841 - protein, 187 aa, Glyptostrobus lineatus
ICTYFAQPLHQRDYTRWPEKPEGWREIVDKYSEALMGLASKLLAIISEALGLEPEAVTKACVEMDQKVVINYYPKCPQPDMTLGLKRHTDPGTITLLLQDQVGGLQATKDDGLNWITVEPVQGAFVVNLGDHMHYLSNGKFKTADHQAVVNSNYSRLSIATFQNPSQEAIVYPLKLEEGEQSFMEEP

SEQ ID NO: 14842 - protein, 187 aa, Taxodium distichum
ICTYFAQPLHQRDYTRWPEKPEGWREIVDKYSEALMGLASKLLAIISEALGLDPEAVTKACVEMDQKVVINYYPTCPQPDMTLGLKRHTDPGTITLLLQDQVGGLQATKDDGLNWITVQPVQGAFVVNLGDHMHYLSNGKFKTADHQAVVNSNCSRLSIATFQNPSQEAIVYPLKLEEGEQSFMEEP

SEQ ID NO: 14843 - protein, 108 aa, Streptococcus gordonii
DPGFLGLDIGPKSIAKFDEALTGAKTVVWNGPMGVFENPDFQAGTIGVMDAIVKQPGVKSIIGGGDSAAAAINLGRRDKFSWISTGGGASMELLEGKVLPGLAALTEK

SEQ ID NO: 14844 - protein, 480 aa, Streptomyces coelicolor A3(2)
MASAPAFDYAPAPESRAVVDIAPSYGVFIDGEFTEAADGKVFKTVSPATEEVLSEVAEAGEADVDRAVKAARKAFEKWSALPGAERAKYLFRIARIIQERSRELAVLETLDNGKPIRETRDADLPLVAAHFFYYAGWADKLDHAGYGADPRPLGVAGQVIPWNFPLLMLAWKIAPALATGNTVVLKPAETTPLSALFFADICRQAGLPKGVVNIITGDGRAGAALTAHPDVNKVAFTGSTAVGKQIARTVAGTRKKLTLELGGKGANIVFDDAPIDQAVEGIVNGIFFNQGQVCCAGSRLLVQESIHDELLDSLKRRLTTLRLGDPLDKNTDIGAINSAEQLARITALADQGEAEGAERWSPACELPSAGYWFAPTLFTNVTQAHTVARDEIFGPVLSVLTFRTPDEAVAKANNTPYGLSAGIWTEKGSRILAVANKLRAGVIWSNTFNKFDPTSPFGGYKESGFGREGGRHGLEAYLDV

SEQ ID NO: 14845 - protein, 475 aa, Streptomyces coelicolor A3(2)
MIIGGGPGGYEAALVAAQLGAEVTVVDCDGLGGASVLTDCVPSKTLIATAEVMTTFDSSYEELGIIVADDTPPMEQAARVVGVDLGKVNRRVKRLALAQSHDITASVTRAGARVMRGRGRLEGMQGLDGSRKVVVRAADGSEETLTADAVLIATGGHPRELADARPDGERILNWTQVYDLEELPEELVVVGSGVTGAEFAGAYQALGSRVTLVSSRDRVLPGEDPDAAAVLEDVFRRRGMNVMSRSRAQSVKRVGDRVEVTLSDGRVIGGSHCLMAVGAIPNTEGMGLEEAGVRLKDSGHIKTDRVSRTSAPGVYAAGDVTGVFALASVAAMQGRIAMYHFLGDAVTPLNLKTVSANVFTDPEIATVGYSQADVDAGKIDARVVKLPLLRNPRAKMQGIRDGFVKIFCRPGTEIVVGGVVVAPRASELIHPISIAVDNNLTVEQIANAFTVYPSLSGSIAEVARQLHTRKAGGEQ

SEQ ID NO: 14846 - protein, 330 aa, Streptomyces coelicolor A3(2)
MQHRTLGQQGLRVSALGLGVMGMSLAYGPSNDEDGISTIHRAHELGVDFFDTAELYGQGTGSNETLLGNAVNDFRDEVVLATKFGFDMTSKSLGSGVNSRPENIREVAENSLRYLRTDRIDLFYQHISDPDVPAEEVAGTVGDLITEGKVRYFGLSNVGPRYIRRAHAVTPVTALQYEYSIFEREVEDEILPVVRELGIGLVPYSPLGRGFLSGVVRPAGEYPEDDMRRWDERWQGENYAYNLNAAEQLRKLAATKGITPAQLALAWLLAQGEDVVPIPGTRSAARLEENVGAIDAELTEADLARIREVIPQGSAGSRYPASMMAGFRTD

SEQ ID NO: 14847 - protein, 346 aa, Streptomyces coelicolor A3(2)
MTTVAAYAAPAAKAPLERTTIERREVREHDVLIDIKFAGICHSDIHQAREGWGEAIFPMVPGHEIAGIVSEVGPGVTRFKVGDRVGVGCMVDSCRECENCKAGREQYCTSGNTGTYNAVGRDGEVTYGGYSEKVVVDENFVLGIPEGIALDEAAPLLCAGITTYSPLKRWNAGPGKKVAVVGLGGLGHMAVKLAHALGAEVTVLSQSLRKKDDGLKLGADHYYATSDPATFEELSGTFDLIVSTVSAPLDLGAYLGLLKTEGTLANVGAPEEPVSLNLFALLGGGKSLSGSMIGGIAETQEMLDFCAEHGIGAEIELIAASEINEAYERVLSSDVRYRFVIDTATI

SEQ ID NO: 14848 - protein, 482 aa, Trigonobalanus verticillata
MSRREGLMSPQTETKASVGFKAGVKDYKLTYYTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIRQAAKWSPELAAACEVWKEIKFEFPAMDTL

SEQ ID NO: 14849 - protein, 482 aa, Trigonobalanus verticillata
MSRREGLMSPQTETKASVGFKAGVKDYKLTYYTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFIFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIRQAAKWSPELAAACEVWKEIKFEFPAMDTL

SEQ ID NO: 14850 - protein, 365 aa, Cryptococcus neoformans var. neoformans
MADFVKLSIFGTVFEVTTRYVDLQPVGMGAFGLVCSAKDQLSGTSVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAGDIWSTGCIFAEMLEGKPLFPGKDHVNQFSIITELLGTPPDDVIQTIASENTIRFVQSLPKREKVPFSTKFPNADPVSLDLLEKMLVFDPRTRISAAEGLAHEYLAPYHDPTDEPVAAEVFDWSFNDADLPVDTWKVMMYSEILDFHNLGDISQNEAEGPVTGEVPAAPAS

SEQ ID NO: 14851 - protein, 240 aa, Cryptococcus neoformans var. neoformans
MNCPNVKLSGYTTDGTFSEYVVSFVNHVTPIPESLDSAGAASILCAGVTTYKALKVSNTKVGDWVALPGAGGGLGHLAVQYAKAMGLKVIAIDSGAAKEKLVKSLGADAWVDFKTSKDIVADIKAATGGDGPAAAVVTAANKTGYAQAIEYLKPSGTLVAVGMPDAEMGANVFWTVFKSIRIQGSYVGNRQDAIEALDIAASGQVKVVFEEKGLDSLKGVFEDLEAGKIAGRVVLKVSDE

SEQ ID NO: 14852 - protein, 501 aa, Arabidopsis thaliana
MENGKCNGATTVKLPEIKFTKLFINGQFIDAASGKTFETIDPRNGEVIATIAEGDKEDVDLAVNAARYAFDHGPWPRMTGFERAKLINKFADLIEENIEELAKLDAVDGGKLFQLGKYADIPATAGHFRYNAGAADKIHGETLKMTRQSLFGYTLKEPIGVVGNIIPWNFPSIMFATKVAPAMAAGCTMVVKPAEQTSLSALFYAHLSKEAGIPDGVLNIVTGFGSTAGAAIASHMDVDKVSFTGSTDVGRKIMQAAAASNLKKVSLELGGKSPLLIFNDADIDKAADLALLGCFYNKGEICVASSRVFVQEGIYDKVVEKLVEKAKDWTVGDPFDSTARQGPQVDKRQFEKILSYIEHGKNEGATLLTGGKAIGDKGYFIQPTIFADVTEDMKIYQDEIFGPVMSLMKFKTVEEGIKCANNTKYGLAAGILSQDIDLINTVSRSIKAGIIWVNCYFGFDLDCPYGGYKMSGNCRESGMDALDNYLQTKSVVMPLHNSPWM

SEQ ID NO: 14853 - protein, 373 aa, Petunia x hybrida
MPLHLRCSATVCVTGAAGFIGSWLVMRLLERGYNVHATVRDPENKKKVKHLLELPKADTNLTLLKADLTVEGSFDEAIQGCQGVFHVATPMDFESKDPENEVIKPTVRGMLSIIESCAKANTVKRLVFTSSAGTLDVQEQQKLFYDQTSWSDLDFIYAKKMTGWMYFASKILAEKAAMEEAKKKNIDFISIIPPLVVGPFITPTFPPSLITALSLITGNEAHYCIIKQGQYVHLDDLCEAHIFLYEHPKADGRFICSSHHAIIYDVAKMVREKWPEYYVPTEFKGIDKDLPVVSFSSKKLTDMGFQFKYTLEDMYKGAIDTCRQKQLLPFSTRSAEDNGHNREAIAISAQNYASGKENAPVANHTEMLSNVEV

SEQ ID NO: 14854 - protein, 386 aa, Arabidopsis thaliana
MAKPVSIEVYNPNGKYRVVSTKPMPGTRWINLLVDQGCRVEICHLKKTILSVEDIIDLIGDKCDGVIGQLTEDWGETLFSALSKAGGKAFSNMAVGYNNVDVEAANKYGIAVGNTPGVLTETTAELAASLSLAAARRIVEADEFMRGGLYEGWLPHLFVGNLLKGQTVGVIGAGRIGSAYARMMVEGFKMNLIYFDLYQSTRLEKFVTAYGQFLKANGEQPVTWKRASSMEEVLREADLISLHPVLDKTTYHLVNKERLAMMKKEAILVNCSRGPVIHEAALVEHLKENPMFRVGLDVFEEEPFMKPGLADMKNAIVVPHIASASKWTREGMATLAALNVLGRVKGYPIWHDPNRVDPFLNENASPPNASPSIVNSKALGLPVSKL

SEQ ID NO: 14855 - protein, 384 aa, Petunia x hybrida
MGSSQKWVIGLLLFSSIFFELTAITLADDKLEESRWGNDNGCGFGRRGCGGGRFGGRGPSFGRGRGAGGGFGGGAGGGAGGGLGGGGGLGGGGGAGGGGGLGGGGGAGGGFGGGAGGGAGGGLGGGGGLGGGGGGGAGGGGGVGGGAGSGGGFGAGGGVGGGAGAGGGVGGGGGFGGGGGGGVGGGSGHGGGFGAGGGVGGGAGGGLGGGVGGGGGGGSGGGGGIGGGSGHGGGFGAGGGVGGGVGGGAAGGGGGGGGGGGGGGGGLGGGSGHGGGFGAGGGVGGGAAGGVGGGGGFGGGGGGGVGGGSGHGGGFGAGGGVGGGAGGGLGGGGGAGGGGGIGGGHGGGFGVGVGIGIGVGVGAGAGHGVGVGSGSGSGGGGNGR

SEQ ID NO: 14856 - protein, 491 aa, Deschampsia antarctica
GPKSRSVEAISACLKAGMSVARFDFSWGDAAYHQETLENLKLAIKATKKLCAVMLGTVGPELQVVNKSEVTISLEENESVVLTPHQGQEASSKLLPINFSGLAKALKPGDTIFVGQYLFTGSETTSVWLEVSEVQGDDVVCVIKNSATLAGSLFTLHCSQIHIDLPTLSDEDKDVIKKWGAPNKIDFLSLSYTRHAEDVRQAREYLSKLGDLSQTLIFAKIENVEGLNHFDEILEEADGIFLSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKTSGVIKSHDRVVVCQKVGDSSVVKIIELDD

SEQ ID NO: 14857 - protein, 110 aa, Deschampsia antarctica
MAVISTACPPSLLAVQTLRSHSFQKNGSTCSTRATTFRVRAVKLPAGVQVPRAQPKLSEPFLGFTKTAEVWNSRACMMGLIGTFIVELILNKGVLEIIGFEMGKGLDIPL

SEQ ID NO: 14858 - protein, 232 aa, Deschampsia antarctica
TETGGFMMTPLPGAWPQKPGSATFPFFGVQPVIVDEKGQEIEGECSGYLCIKKSWPGAFRTLYGDHDRYETTYFKPFSGYYFTGDGCSRDKDGYHWLTGRVDDVINVSGHRIGTSEVESALVSHPQCAEAAVVGVEHEVKGQGIYAFVTLVDGVPYSEELRKSLIAKVRNQIGAFAAPDKIHWAPGLPKTRSGKIMRRILRKIAAKQLDELGDISTLADPGVVDQLIALKDC

SEQ ID NO: 14859 - protein, 336 aa, Eucalyptus gunnii
MPVDALPGSGQTVCVTGAGGFIASWIVKLLLERGYTVRGTVRNPDDPKNGHLRELEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAAWPEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPSPPEDSVRIQG

SEQ ID NO: 14860 - protein, 317 aa, Eucalyptus gunnii
MPVDALPGSGQTVCVTGAGGFIASWIVKLLLERGYTVRGTVRNPDDPKNGHLRELEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAAWPEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKSKLSRACRRKATYPSPPPRKIRCVFRDDLRSITVHICNPEK

SEQ ID NO: 14861 - protein, 468 aa, Styrax japonicus
  misc_feature (242)..(242): Xaa can be any naturally occurring amino acid
KASVGFKAGVKDYKLTYYTPEYETKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEXMMKRAVFARELGVPIVMHDYLTGGFTANTTLAHYCRDNGLLLHIHRAMHAVIDRQKNHGMHFRVLAKALRLSGGDHIHSGTVVGKLEGEREITLGFVDLLRDDFVEKDRSRGIYFTQDWVSLPGILPVASGGIHVWHMPALTEIFGDDSVLQFGGGTLGHPWGNAPGAVANRVALEACVQARNEGRDLAREGNEIIREASKWSPELAAACEVWKEIKFEFEAMDTI

SEQ ID NO: 14862 - protein, 298 aa, Schizosaccharomyces pombe
MSTEEQKEEIKDISSKQENSSEVPKAEEAGKVVESQKDTTSEEKKEETTEKKEDDGKKDLSFDEAEVLKQVEFYFSDTNLPHDKFLWTTSQKNDGWVPIQTIANFKRMRRFQPLEAIVNALRKSPELLEVDEAGEKVRRMIPLVRVDNKSVMERSVYCKGFGDEKDDTQIALEKFFEENAGPISAVRMRRDDDKKFKGSVFVEFKEPDVANKFLEKVKTAPLKWGEDELTIMSKKEYVDMKAELHKNDPPKFSSKRRRFDAFKEMDRQRPGKYSNRGRKFKKQRSSNASEEKPSAASE

SEQ ID NO: 14863 - protein, 218 aa, Clostridium acetobutylicum
MNSKIIRFENLRSFFKDGMTIMIGGFLNCGTPTKLIDFLVNLNIKNLTIISNDTCYPNTGIGKLISNNQVKKLIASYIGSNPDTGKKLFNNELEVELSPQGTLVERIRAGGSGLGGVLTKTGLGTLIEKGKKKISINGTEYLLELPLTADIALIKGSIVDEAGNTFYKGTTKNFNPYMAMAAKTVIVEAENLVSCEKLEKEKAMTPGVLINYIVKEPA

SEQ ID NO: 14864 - protein, 318 aa, Malonomonas rubra
MAKWTELQDKSFLEATARERAVGIVDEGTFTEFCGPFDKIYSPHLPLMGEAIEYDDGLVAGVGKIGKKPIFVISQEGRFIGGSIGEVSGAKMVKTIQLASDLYEEMVSEKPDLPEEMRPAVVISFETGGVRLHEANAGLLAHAEVMDQIQNCRGRVPIISLIGSRVGCFGGMGFVAAATDVIIMSQFGRLGLTGPEVIEQEMGKDEFDASDRALVYRTTGGKHKYIIGDCNYLAADSIRSFRETTTAVLQKPMEEIETFRRIGSMEKIKEQIELVKLSVSLKPKDSMDVWAHAGNENPESLINMTLDEFLAQAKRLKA

SEQ ID NO: 14865 - protein, 475 aa, Morina coulteriana
  misc_feature (1)..(9): Xaa can be any naturally occurring amino acid
XXXXXXXXXSAGFKAGVKDYKLTYYTPDYETKDTDILAAFRVTPQPGVPPEEAGAAVAAESSTGTWTTVWTDGLTSLDRYKGRCYHIEPVPGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDETVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRGACKWSPELAAACEVWKEIKFEFEAMDTL

SEQ ID NO: 14866 - protein, 475 aa, Pterocephalus lasiospermus
  misc_feature (1)..(5): Xaa can be any naturally occurring amino acid
XXXXXETKASAGFKAGVKDYKLTYYTPDYETKDTDMLAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIDKDRSRGIYFTQDWVSLPGVLPVASGGIHVWHMPALTEIFGDDSVLQFGGGTLGHPWGNAPGAVANRVALEACVQARNEGRDLAREGNEIIRAACKWSPELAAACEVWKEIKFEFEAMDTL

SEQ ID NO: 14867 - protein, 475 aa, Patrinia rupestris
  misc_feature (1)..(9): Xaa can be any naturally occurring amino acid
XXXXXXXXXSAGFKAGVKDYKLTYYTPDYETKDTDILAAFRVTPQPGVPAEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQTETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEIIRAAAKWSPELAAACEVWKEIKFEFEPVDTV

SEQ ID NO: 14868 - protein, 1306 aa, Schizosaccharomyces pombe
MSYTNHSPANLTRNSSFNHQHYSTTLRSPPSMRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLSPAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHDDSKAETDSLAASYKEESALPVASNVGLRQPNELRIDSINLPPAIVTPDTINYSVD

SEQ ID NO: 14869 - protein, 232 aa, Pisum sativum
MSQYQNQYGAQTRKTDEYGNPMNQVDQYGNPISGGGGLTGEAGRQHYGTTGGATDHGHGQQHRGVDQTTGYGTHTGGVGGYGTKPEYGSTNTGSGYGTGTGYGGSGTTEYVREEHHGDKKGVMDKIKEKIPGTEQSRTHTDGTGYGSTGYGASGGGIGNTGQEYVREELTVHPGDKKHGSAGQEYVKEERRGIGNTGQEYVREEHRVDHGEKKGIMDKIKEKLPGTGGCTGH

SEQ ID NO: 14870 - protein, 232 aa, Pisum sativum
MSQYQNQYGAQTGMTDEYGNPVNQVDQYGNPISGGGGLTGEAGRQHYGTTGGATGQGHGHGQQHRGVDQTTGYGTHTGGVGGYGTKPEYGSTNTGSGYGTGTGYGGSGTNPDYGSTNTGSGYGTGTGYGGSGTTEYVREEHHGDKKGVMDKIKEKIPGTEQSRTNTDGTGYGSTGQGYVREQQHGTGYGSTGQGYVREQQDVHHGDEQHGEKKGIMEKIKEKLPGTGACTGH

SEQ ID NO: 14871 - protein, 222 aa, Pseudomonas wisconsinensis
MSIRRLACSLLLSSLALPVLAAECPAMLQGELPKLRAKGENIELCQYAGKPLVVVNTASFCGFTPQFKGLEALYQRYKDQELEVLGVPSDDFRQESADSKETATVCYVNYGVTFAMTEPQPVSGANAIPLFKGLAEQSRQPRWNFFKYVVDRQGKVVASFSSLTKPDDPELIAARREGDRLATLIPSRFTALHPSGRWALSVCLPRLARRRTQFTRRALQEQ

SEQ ID NO: 14872 - protein, 400 aa, Escherichia coli
MKEKTIIIVGGGQAAAMAAASLRQQGFTGELHLFSDERHLPYERPPLSKSMLLEDSPQLQQVLPANWWQENNVHLHSGVTIKTLGRDTRELVLTNGESWHWDQLFIATGAAARPLPLLDALGERCFTLRHAGDAARLREVLQPERSVVIIGAGTIGLELAASATQRRCKVTVIELAATVMGRNAPPPVQRYLLQRHQQAGVRILLNNAIEHVVDGEKVELTLQSGETLQADVVIYGIGISANEQLAREANLDTANGIVIDEACRTCDPAIFAGGDVAITRLDNGALHRCESWENANNQAQIAAAAMLGLPLPLLPPPWFWSDQYSDNLQFIGDMRGDDWLCRGNPETQKAIWFNLQNGVLIGAVTLNQGREIRPIRKWIQSGKTFDAKLLIDENIALKSL

SEQ ID NO: 14873 - protein, 337 aa, Bacillus cereus ATCC 10987
MKKRALVSVSDKTGVVEFVKGLLEQGIEVISTGGTKKLLEENGLQVIGISEVTGFPEIMDGRVKTLHPNIHGGLLAVRDNETHVAQMNELGIEPIDFVIVNLYPFKETIAKPDVTFADAIENIDIGGPTMIRSAAKNHKFVSVIVDPVDYDVVLAELEENGEVKEETKRKLAAKVFRHTAAYDALISNYLTEQMGEESPETLTVTFEKKQDLRYGENPHQKATFYKAPFAATSSVAYAEQLHGKELSYNNINDADAALSIVKEFTEPAVVAVKHMNPCGVGVGTDIHEAYTRAYEADPVSIFGGIIAANREIDKSTAEKLHEIFLEIIIAPSFSKEA

SEQ ID NO: 14874 - protein, 277 aa, Rhizobium etli
EFASFYRSMGVDVTVVEVMPTIMPVEDAEITAIARKQLEKRGLKIFTSAKVTKVEKGAGSITAHVETSDGKVQQITADRMISAVGVQGNIENLGLEALGVLTDRRWLVADGYGKTNVAGIYAIGDVAGPPIVAHKAEHEGVVCVEKIAGVPNVHPTDKGKVPGCTYCNPQVASVGLTEAKAKELGSDIRVGRFSFAANRKAIALGEDQGMVKVIFDKKTGELLGAHMVGAEVTELIQGFVVAMNLETTEEELMHTIFPHPTVSETMKEAVLDAYGRV

SEQ ID NO: 14875 - protein, 210 aa, Mycobacterium smegmatis
MITAFARVDGHPVGVIANQPMVLSGAIDNEASDKAASFIRFCDSYNLPLVFVVDTPGAMPGVAEEKGGIIKRGGRFFNAIVEADVPKVTVIIRKAYGGGYAVMGSKQLSADLNFAWPTARIAVIGAEGAAQLLVKRFPDPNAPEVQKIRDDFIEGYNLNMATPWIAAERGYIDAVIQPHETRLLLRKSLRLLRDKQNGPKVQRKHGLLPL

SEQ ID NO: 14876 - protein, 370 aa, Fusarium oxysporum f. sp. lycopersici
MVRNIAIAALLPAAFASTLPRDPCSVTDYSGLATAVSSCTNIVLNGFQVPTGKALDLSKLKDGATVTFKGKTTFATTADNDFDPIVISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 14877 - protein, 468 aa, Mesorhizobium loti
MRLSNLGTEQLREKDRSFVFHPSTHLAKHSRGETPNRIMAGAEGVYIWDTEGRKSLDGFGGLYCVNMGYGCTEIAEAIARQAHEMPFAHIYASQGTEPVALLAEAVVEYFGQNMRRVFFGLSGSDANETNIKLVWYYNNILGRPEKKKIISRHRGYHGSGLVTGSLTGLAFFHNFFDLPLDLVRHTTTPHHYRQAHDGESEQAFSKRCADELEALIVAEGPETVAAFIGEPVLGTGGIVPPPKGYWTAIQSVLDKYDILLIADEVVCGFGRTGEKFGSHLYGMRPDFVTIAKGLSSAYLPISGSIIGDRVWSILEQGTEKHGALGHGWTYSGHTLCAAAALANIRLLKERNILEHVRDVGPYWHARMNAELAGHPIVGEVRGVGILSAVELMRDPKQRIPFESDLQVGVRAAAALFENGVIGRAMPHGDILGFAPPLIITRKEIDIIVNATAKSVETTYRALKAEGAI

SEQ ID NO: 14878 - protein, 477 aa, Mesorhizobium loti
MSEARSYELFINGKWRAGGSRVTLPVINPATEKVVASVASATVSDLDEALASAERSRKAWCSRPAKERGEILVAAARVLATQIEPAARDLSAEQGKTIAEATGEYARAVETLEWNGTHAEELSATIPLGPNRMIVPEPLGVVAAFTPWNYPAVLITRKLAPALAAGCPVILKGAEETPSVAVHIVESLRQAGVPDGVVNLVFGVPVHISRHLLSSPIVKVLTFTGSTAVGKQLAMLAANNLQRCILELGGHSPVIVCEDADLAKAIPAISEYKFECAGQSCNAPSRILVARTLYEEFLSRMTEAARKIRIGLPDDPATEMGPMANARRIEAMQRLTKDAVDRGAHIETGGTRLDGAGFYWPPTILTGVPKDARVLHEEPFGPILTVAPFDTLDEAIGEANDTEYGLAAYFFTDAADTQRKLTNSLSAGAVSVNYLKGVSADAPYGGVKQSGYGYEGGEQGVRSFQILKMVNGLGSFG

SEQ ID NO: 14879 - protein, 355 aa, Mesorhizobium loti
MNLDRTPLPFSQYSAAYALPRIIRCGSNLYLAQFAFMKLLPAKYIIGQAVARGTLTHDTIVLETSSGTFALGLAVVCREYGFSLEIFTDPVMDKGLENRLRSLGAEVFIITEKAKEGGYQRSRLDAMHARMRQLGESHFWPRQYETPDNPAAYRCFADQISELLGADVTLVGSVGSGGSTCGTIERLRQKALGARLIGVDTFNSVIFGQLDGERKLRGLGNSLVPKNVKHELYDEVHFTSASLAFAATQALHERHAIFAGPTSGASYIVGRWRARQHPEETVVVICPDEGHRYAEAVYDQEWLRQNECVLEGVLLDAPASEEHPSTALPPWNRYRWKRKTREAVLSALEGCNGPE

SEQ ID NO: 14880 - protein, 419 aa, Mesorhizobium loti
MDIDIFEAYESNVRRYGRSFPTVFTKSLGATIWDESGKPYIDFIVGSGALNYGHNNQDIMAPAIQYLANQNIVLSLDMYTTAKRDFIEVFVNSILKPRGLSYKIQFPGPTGTNANEAALALARKYTGRSSVMAFTNSYHGMSLGSLAVSGSASTRQLGGVARHDVIRVPYENYPNQTFDSASYIDHVLGDPGSGIEKPAAIILEPIQAEGGMNTASAPWLAEIQRICRKHDVVFIVDDIQAGSGRTGDFFSFEFAKVEPDIVCLSKSLSGSGNPLSIVLIRPEMDIWKPGEHSGTFRGNNLAFVTSAAMCKMWSDRQFTKAVEGTAVKLQEHLDRLVAKFPKCIEQKRGRGLMAGLKCRSQAVVGRVHDVAFENGLLIESSGPNRDVIKVLPPITISDDELDHGIAILDQALQEKTNGD

SEQ ID NO: 14881 - protein, 337 aa, Mesorhizobium loti
MLEKFERYPLTFGPTPIEKLDRLGKHLGGNVEIYAKREDCNSGLAFGGNKLRKLEYIIPDAIASDADTLVTIGGVQSNHTRMVAAVAAKIGMKCLLVQESWVPHEDVVYDRAGNILLSRILGAEVRLVDDGFDIGIRRSWEKALYEVKARGGRPYAIPAGASVHPNGGLGYVGFAEEVRAQEEQLGFAFDYMVVCTVTGSTHAGMLVGFAKDGRQRNVIGIDASATPAKTKAQVLSIARHTATLVELGSELAEDDVVLLEDYAHPRYGIPSEETKEAIRLCARLEGMITDPVYEGKSMQGMIDLVQKGFFPEGSRILYAHLGGAPAINGYGYTFRNG

SEQ ID NO: 14882 - protein, 396 aa, Mesorhizobium loti
MLAHRTNLFGTSGTAAARAAAKAAADAGKEIIDLTAGEIWSELAPTIRDGAIDAINKGVNRYTDSVGMVELREALARKISLDTGQIWKAEEVAVTSGAKQALFNAAMVLLNPGDEVIIPAPYWTTFPAQVLIAGGTPVFVDTKSNGYVPRPEHIKEAVTERTRAIVVNTPSNPAGAVYDVETLMAIAELAVSRNLWIIFDECYGDFVHGGHTHHPIVSVAPEIRARALIVNSFSKSLALTGWRIGYLAGPKGVINAVKALQSHTTSNPNVIAQHAVLAHLQRGGSDYEGKLRSRLTSARRVGLDVLSSLTRVPVARAQGGFYFYLDLSHLLRPGAEDGASTTADDIVTGLLAEAGVAAVSGTAFGDPAGLRLSYGIPPEKLATGLARLVEFLNAWK

SEQ ID NO: 14883 - protein, 421 aa, Mesorhizobium loti
MSQSQVWHPFTQHALEPAIPEIVRTEGAYLYKADGTRILDAISSWWVVTHGHRHPRIIRAIETTASSLDQIIFAGFTHEPAERLARALVGLAPTGLDWVFYSDSGSTSVEVALKMALGYFRNIGAPRSRIVVMEHSYHGDTIGTMSVGARGVFNAAYEPLLFEVDTIPFPASGREQETLDRFEAVSRDRRAAALIVEPLVLGAGGMLMYPASVLTELKKIAETSGTLLIADEVMTGWGRTGTMFACEQASISLDILCTSKGLTGGAIPLAATLATDAIFQAHYSEDRTKTFFHSSSYTANPIACAAALANVEIWRDEPVAERIATLSAKQAAGLQRFRDNPYFTDCRATGTIAALDLRTGSAGYLAEIGPKLRAFFLERGLLVRPLGNVLYLLPPYCITGEELDGLHDAIEEAGERFGTKP

SEQ ID NO: 14884 - protein, 497 aa, Mesorhizobium loti
MKGDDGLTVTQSLTRRLKNPELFDDLAGVPGRKAEQSTRRFSVFNPSTGELLAELPDMDVRDVSKAIDKAEAAQEHWAALTARERSDILWEWHQLILDHSEDLAAILTAEMGKPLAEAKSEIAHAAAYLQWYAEEANRIYGETISPPSNDRRMLVIKQPIGVVGAITPWNFPASMVARKISPALAAGCAIVLKPAEQTPLVAGAMFTLARMAGFPDGVLNLIYASEGDAVGRELCSNPKVRKISFTGSTEVGRLLMRECSDQIKRTSFELGGNAPFIVFDDADVDAAVDGALQAKFRNAGQTCVSANRLYVQSSVYNEFCDKFTKRVSALRVGDGFEPEVAIGPLIDKCALAKIEDHIRDAVRQGGKIRCGGNRIGESGTFFEPTVITDVERTMRVAQEETFGPLAPIIRFNDPDQVVREANDTIYGLAAYFYASNLKRVWRVAETLEYGMVGINTGRMSSEAAPFGGMKQSGIGREGSRHGLEDYLEMKYLCMGGL

SEQ ID NO: 14885 - protein, 471 aa, Mesorhizobium loti
MKVVPVIISGGAGSRLWPASRQSHPKPFLKVADGLSLIQHTVLRAASMQHVVELVTVTSTGHLFLTKDVFDELDSVVLPRTFLLEPEGRDTAAAVAAATVHAKATQGPDAVLCVFPADHMIGDLPAFQTAMNRAIEQAQQGRIATLGITPDRPDTAFGYIEADGEKVVRFVEKPNAETAKSYVASKRFFWNAGIFCFKAQVMLDEMAAHCPQVIDAVLDSYDNARVSHGEHVASVELSSEHFAMAPRISLDHAVMEKTHNLAVVPCEMGWNDIGSWNAMAELVAADGSGNRIRGDVHVVDTVGSYISSDKRVIGTVGISDLVIVDSPDALLVASRDRVQDVKKLFEGLKAAGHEAHLLHSTVHRPWGTYTVLEESERFKIKRIEVKPGGRLSLQMHHHRSEHWVVVSGTAKIVNGDQELLLTTNQSTYIPCGHKHRLENPGNIGLVMIEVQSGEYLGEDDIVRLEDVYGRT

SEQ ID NO: 14886 - protein, 293 aa, Meiothermus ruber
MNMAYKDYYKILGVPKNASEDEIKKAFKKLARKYHPDVNKEPGAEEKFKEINEAYTVLSDPEKRRYYDTYGAAAGSAGWQGPPPGPGGFGGFTGNVGDFSDFFQQLFGGRGGFGGLGDLFEQTPGRGARRVAGDLEAELPLSLEEAYRGGEKTISVGAERLTVRIPPGVREGQKIRLAGKGRAGGDLYLHVKLQSRPEMRLEGDDIYTVVEVPAPIAVVGGKVRVQTLDGPVEITIPRRTQAGRKLRLAGKGWPRKDKSRGDQYAEVRVTIPTNPSPEEERLYAQLAELIKVQ

SEQ ID NO: 14887 - protein, 253 aa, Chlamydia trachomatis
MSKLTQVFKQTKPCIGYLTAGDGGTSYTIEAAKALIQGGVDILELGFPFSDPVADNPEIQVSHDRALAENLTSETLLEIVEGIRAFNQEVPLILYSYYNPLLQRDLDYLRRLKDAGINGVCVIDLPAPLSHGEKSPFFEDLLAVGLDPILLISAGTTPERMSLIQEYARGFLYYIPCQATRDSEVGIKEEFRKVREHFDLPIVDRRDICDKKEAAHVLNYSDGFIVKTAFVHQTTMDSSVETLTALAQTVIPG

SEQ ID NO: 14888 - protein, 253 aa, Chlamydia trachomatis
MSKLTQVFKQTKPCIGYLTAGDGGTSYTIEAAKALIQGGVDILELGFPFSDPVADNPEIQVSHDRALAENLTSETLLEIVEGIRAFNQEVPLILYSYYNPLLQRDLDYLRRLKDAGINGVCVIDLPAPLSHGEKSPFFEDLLAVGLDPILLISAGTTPERMSLIQEYARGFLYYIPYQATRDSEVGIKEEFRKVREHFDLPIVDRRDICDKKEAAHVLNYSDGFIVKTAFVHQTTMDSSVETLTALAQTVIPG

SEQ ID NO: 14889 - protein, 253 aa, Chlamydia trachomatis
MSKLTQVFKQTKPCIGYLTAGDGGTSYTIEAAKALIRGGVDILELGFPFSDPVADNPEIQVSHDRALAENLTSETLLEIVEGIRAFNQEVPLILYSYYNPLLQRDLDYLRRLKDVGINGVCVIDLPAPLSHGEKSPFFEDLLAVGLDPILLISAGTTPERMSLIQEYARGFLYYIPYQATRDSEVGIKEEFRKVREHFDLPIVDRRDICDKKEAAHVLNYSDGFIVKTAFVHQTTMDSSVETLTALAQTVIPG

SEQ ID NO: 14890 - protein, 253 aa, Chlamydia trachomatis
MSKLTQVFKQTKPCIGYLTAGDGGTSYTIEAAKALIQGGVDILELGFPFSDPVADNPEIQVSHDRALAENLTSETLLEIVEGIRAFNQEVPLILYSYYNPLLQRDLDYLRRLKDAGINGVCVIDLPAPLSHGEKSPFFEDLLAVGLDPILLISAGTTPERMSLIQEYARGFLYYIPYEATRDSEVGIKEEFRKVREHFDLPIVDRRDICDKKEAAHVLNYSDGFIVKTAFVHQTTMDSSVETLTALAQTVIPG

SEQ ID NO: 14891 - protein, 253 aa, Chlamydia trachomatis
MSKLTQVFKQTKPCIGYLTAGDGGTSYTIEAAKALIRGGVDILELGFPFSDPVADNPEIQVSHDRALAENLTSETLLEIVEGIRAFNQEVPLILYSYYNPLLQRDLDYLRRLKDVGINGVCVIDLPAPLSHGEKSPFFEDLLAVGLDPILLISAGTTPERMSLIQEYARGFLYYIPYEATRDSEVGIKEEFRKVREHFDLPIVDRRDICDKKEAAHVLNYSDGFIVKTAFVHQTTMDSSVETLTALAQTVIPG

SEQ ID NO: 14892 - protein, 337 aa, Thermoanaerobacter tengcongensis MB4
MSILHTPLKIKDITIKNRIMMSPMCMYTASTEGMPNDWHIVHYATRAIGGVGLIMQEATAVESRGRITDRDLGIWNDEQAEELKKIVDICKANGAVMGIQLAHAGRKCNIPYEDVVGPSPIKAGDQYKLPRELTIDEIKSIVKAFGEAAKRANLAGYDVVEIHAAHGYLIHEFLSPLSNKRKDEYGNSIENRARFLIEVIDEVRKNWPQNKPIFVRVSADDYIEGGINIDMMVEYINMIKDKVDVIDVSSGGLLNVDINPYPGYQVKYAETIKKRCNIKTCAVGLITTQELAEEILSNERADLVALGRELLRNPYWVLHTYTSKEDWPKQYERAFKN

SEQ ID NO: 14893 - protein, 461 aa, Thermoanaerobacter tengcongensis MB4
MENLHTREYDLAVIGGGPGGYVAAIKAAKKGAKVALFEKDKLGGTCLNRGCIPTKAYARAAEVYGILKKAKEFGFDIQINYFDYAQVVKRKDTIVGELVEGIKALLKANKIEVFNKEAKVDKEKNVIFEGEKIKAKNIIIATGSSPAELPIEGIDSKNVLNSDTILEITSLPKSLCIIGGGVIGMEFAFIMNQFGVEVYVVEMMPNILPSLDKKVSSAVKFAAQKRGIKIYTSSTVEKVEEEGENSVVTIRSGDDIKKISVDKVFVSIGRKLNTSIGPIVDLLEFDKKAIKVDEHMRTNIEGVWAVGDVTGKMMLAHVASSQGEVAVDNIFGKSRTLDYYKIPAAVFTEPEIGYFGYTEEEAKEKFGEIKVGRFDFKHNGRAKTYGETEGFAKIISTEDGEVVGAWVVGSGASELVHIISTACQSGAKAEELKDVVYAHPTKSETIMEAFKDIFKEAIHKI

SEQ ID NO: 14894 - protein, 214 aa, Thermoanaerobacter tengcongensis MB4
MKISASILAADTAFLGKEVLELEKLGIDFIHVDVIDGHYANNFGFSPKTVKDLRRITDLPIEVHLEILNPENYVEIFSEAGADIIIVQFDTCSHPLRILRKIKALGKKAGVALSPCVSFESLRWCLNDVDYLLFMSVEPGFGGQNFETFTIDKIKLAKVQLKEMGFSIPIGVDGGVNLGNINLLREVGVDIVVVGSALFLNENKERFIFQVKGG

SEQ ID NO: 14895 - protein, 467 aa, Thermoanaerobacter tengcongensis MB4
MNDVGLIGLAVMGQNFALNMARKGYRVSVYNRTPERTKKFVEEKVRDESIFPFYTIEEFVKSLKKPRKIILMIKAGKAVDDMIAEILPYLELGDLIVDSGNSHFADTARRLEYLSQKNILFLGMGISGGEYGALHGPSLMPGGTKEAYDLIKDILLKAAAKTEDGPCCTYVGKGSAGHFVKMVHNGIEYAIMQLIAEVYDFMKKVLNMTNEQIGDVFEKWNKGELNSYLMEISYKIMRYKDKETGGFLIDYILDKAEQKGTGKWTAQTSLDLGVPTPTLNLAVEARIISHYKEERKILSKLYSKEKNIISVNKEEMIEHLKKALLFGVFMSFSQGLWLIDEASKQYNYGIDLSEILRIWKGGCIIRAEILDFLRDIIRENEEDANLLHSDKAIDFIKDKLNSIYQVTEIGKNYRIPLMTMNSALDYYFALTEENLPANIIQAQRDFFGAHTYERIDREGIFHTEWER

SEQ ID NO: 14896 - protein, 456 aa, Thermoanaerobacter tengcongensis MB4
MEAKEEERRNVAKEVMEIAWPSIAEQMLVMAVGMISTIFVGRISAAALAAVGLINMVIFFLQAVFAGLSTGVTVVVARLVGEEDIEGVKTATSQSFIMAVFLTLLFTLLGYAFDIPIIKTLFGKIEPEVFEFAILYYRIALIGFPFMVIALILGGALRGAGDTKTPMYVTAVVNIINLILNALLVFGVPYKGRYLIPPFGVKGAAFSVTAARIVGGILLPYLIYSGKNQAGIAIRGPFKLDFDMMKRIIKIGVPASLEQLVMQGGFLVVQIIVSTMGTTAIAVYQIGMNANSLAFMPIFGFSIAATALVGRSLGAEEFDMAETYAKVSRNISVVVISVIGVFMFVFSKQLAALYTTDPEVIRVSASILKIFAVVEPFLAIMVVMAGVLRAAGDISYVVITTVVGLWLFRIVLGSFLAKNFGMDIYGIWIGVFTDFIVRSIMYIFRFRAGKWKYIKV

SEQ ID NO: 14897 - protein, 464 aa, Thermoanaerobacter tengcongensis MB4
MSKEYRFPEGFWWGSATSAVQIEGAADEDGKGMNVWDYWYQKEPNRFFNGIGSQVTSDFYHRYKEDIKLMKELGHNSFRFSISWSRLIPGGTGKVNEKAVEFYNNVINELLENGIEPFATLFHFDMPIEMQNIGGFENRKVVEYFAEYAKTCFELFGDRVKRWITFNEPIVPVLGGYLYNFHYPDIVDFKRAVQFGYGTVLASARAIEEFKKLKINDAKIGIVLNLSPVYPRSNHPADLKAAELADLFHNRSFLDPSVKGEYPKELVEVLKAYNHLPEYKEEDLELIKDNTVQYLGVNYYQPLRVKAKENMPNPYGVFTPNWFYDEYIMPGRRMNPYRGWEIYEKGIYDLLKRIKDEYGNIECFISENGMGVEGEERFIKDGIIQDDYRIEFIKEHLKWVHKAIEEGCNVKGYHVWTFMDNWSWLNAYKNRYGLVAIDLKTQKRTIKKSGYWFKEVAENNGFVD

SEQ ID NO: 14898 - protein, 449 aa, Thermoanaerobacter tengcongensis MB4
MIELVKFPKDFTWGVATSSYQIEGAVNEDGRTPSIWDTFSKTEGKTYQGHTGDVACDHYHRYKEDVQIMKEIGVKAYRFSIAWPRIFPEEGKYNPKGMDFYKRLVDELLKREIIPVATIYHWDLPQWAYEKNGGWLNRESVKWYVEYASKLFEELGDVIPLWITHNEPWCSSILSYGIGEHAPGHKDWREALIAAHHILLSHGEAVKVFRDMNLKGAQIGITLNLTPAYPASEKEEDKLAVQYADGFANRWFLDPIFKGNYPEDMMELYSKIIGEFDFIREGDLETISVPIDFLGVNYYTRSIVKYNEDSMLKAENVPGPGKKTEMGWEISPESLYDLLKRLDREYTKLPMYITENGVAFKDEVTEDGRVHDYERIEYIKEHLKAIARFIEEGGNLKGYFVWSLLDNFEWAHGYSKRFGIVYVDYETQKRILKDSAFWYKGVIEKGVIE

SEQ ID NO: 14899 - protein, 240 aa, Thermoanaerobacter tengcongensis MB4
MIFVNDVYKNFGSLEVLKGVTLKVNKGEVVVIIGPSGSGKSTLLRCINLLEEPTKGEVFIDGVKINNGKVNINKVRQKVGMVFQHFNLFPHLTAIENITLAPVKVKKMNKKEAEELAVDLLAKVGLLDKKDQYPIKLSGGQKQRLAIARALAMQPEVMLFDEPTSALDPEMVKEVLNVMKQLANEGMTMVVVTHEMGFAREVGDRVIFMDDGVIVEEGTPEEIFYRAKNERTREFLSKIL

SEQ ID NO: 14900 - protein, 464 aa, Thermoanaerobacter tengcongensis MB4
MAVKDRVPMREQDPKVRIKNFDEVALGYTEEEAILEASRCLQCPNPTCVAGCPVHVRIPEFIKAITERKFEEAYKIITSTNSLPAVCGRVCPQEEQCEKNCILNRIGKPIAIGRLERFVADYALQNNIEEEVKPEKKNKKVAIIGSGPAGLTCAGDLLKMGYDVTIFEALHALGGVLTYGIPEFRLPKRIVEAEIERLKKLGAKVETNVVVGKTVTIDELMEEEGFEAVFIGTGAGLPRFMGIPGENLNGVYSANEFLTRINLMKAYKFPEYDTPIAVGKRVAVIGGGNVAMDAARSALRLEGVEEVIVVYRRSKEEMPARAEEIEHAIEEGIKFEFLANPIRINGTEDGWVKSMDVIRMKLGEPDSSGRRRPIEIPGSEFTMEVDTVIMALGTSPNRLIPSTTKDIQVQKWGGIITDEDGRTSRPGVFAGGDAVTGAATVILAMGAGKKAAKAIDEYLRSKGE

SEQ ID NO: 14901 - protein, 484 aa, Thermoanaerobacter tengcongensis MB4
MEDKFVKEGLTFDDVLLIPAKSDVLPKDVDLKTRLTKKITLNIPLMSAGMDTVTEARLAIAIAREGGIGVIHKNMSIERQAMEVDKVKRSEHGVITDPFSLSPDHTIRDAAELMARYKISGVPITVDSKLVGIITNRDIRFEDDLDKPIREVMTKENLVTAPPGTTLEEAKQILKKHKIEKLPLVDENNVLKGLITIKDIEKAVEFPNAAKDEKGRLLVAAAVGVGKDMMDRVKALIEAGVDAIVVDTAHGHSTRVLDAVAKIKEKYPDVQLIAGNVATAEATRDLIERGADAVKVGIGPGSICTTRVVAGVGVPQITAIYECAKEADKYGIPVIADGGIKYSGDIVKAIAAGASVVMIGSLFAGTEESPGEIEIYQGRSYKVYRGMGSLGAMKEGSSDRYFQEEAVKLVPEGVEGRVPYRGPLRETVYQLIGGLRAGMGYCGVKNIEELRTKTKFVRITQAGLIESHPHDIIITKEAPNYNLR

SEQ ID NO: 14902 - protein, 444 aa, Thermoanaerobacter tengcongensis MB4
MKNKSNMQNGLIERLFKLRERNTDFKTEVLAGATTFITLAYIIFVNPQILSEAGIPKEAAIAATIWSSAIATTLMALLANYPIAVAPGMGLNAFFTYTVVKQFGLHWTVALGAVFFSGVVFLVLTVTKIRSWIIEAVPPSLRSAIPVGIGFFIAFIGLINAGIVVKSDATLVAFGHILKPETLLSIFGLILAAVLISRGVRGALIISILTTTVVAMIFGVSPLPKGIGDVISLHIPSLAPTFGKLDIAGAFHYGLLNIIFTFTIVELFDNMGTLMGLLKKAGLLGEKGEPPALGRAFISDSVGTMISPVLGTCTVTSYIESAAGIAEGGKTGLTGITVAVFFLLALFIAPLVGLVPAFATAPALIIVGALMMTEIVHINFEDFTEAFPAFITVIGMPLTYSIATGLGLGFISYTLVKLLSGRAKEIHWMMYVIAAAFTINFVLR

SEQ ID NO: 14903 - protein, 508 aa, Thermoanaerobacter tengcongensis MB4
MSRRALISVSKKDGIVEFAKKLEDLGYEIISTGGTYNLLKESGVKVIKVSEVTGFPEIMGGRVKTLHPKIHGGILAVRDKKEHLKDLNDHGIVPIDLVAINLYPFKETISREKVALEEAIENIDIGGPAMIRAAAKNYKYVTVLVDPVDYEKVIEEIKLYGDTKEETRFYLAAKAFGHTAFYDSLIYEYFREKTNMEFPKVITFAYEKVQDLRYGENPHQKAAFYKNPVKSYGIAECLQLHGKELSFNNINDANAAIELVREFSEPVAVAIKHTNPCGVAVGNSIYEAYLKAYEADPVSIFGGIVAFNGKVDVDTAKELVKIFLEIVIAPDFEEEALEILMSKKNLRVLKLKEGYYREFDLKKVEGGVLVQQKDEIDLDESSIKVVTKRAPTGKEMKDLKFAWKVVKHVKSNAIVLAKDGVTVGIGVGQVNRIWPTEQAIKQAGERAKGSVLASDAFFPFPDVVEAAARGGITAIIQPGGSQNDQLSIEAADRAGIAMIFTGIRHFKH

SEQ ID NO: 14904 - protein, 466 aa, Thermoanaerobacter tengcongensis MB4
MPLNRSKKKTPMPTQKPEVRRRNFNEVALGYSEEEAVSEAQRCLQCKKPGCVEGCPVQVQIPQFIKRIAERDFEGAIKIIKETNSLPAICGRVCPQETQCEKNCVLGKVGEPVAIGRLERFAADWERAKGIRPPVIPKKLGKKVAIIGSGPAGLTCAGDLAKLGYDVTIFEALHKPGGVLVYGIPEFRLPKIIVEQEVKFIQQLGVEIKTNMVMGKVLTIDDLFEMGYEAVFISTGAGLPKFMGIPGENYLGVYSANEFLTRINLMKAYSFPNTDTPIKVGKKVAVIGGGNVAMDAARSALRMGADEVHIVYRRSEEEMPARKEEFENAKEEGIIFDFLTNPVRIIGNENGWVKGIECIRMELGEPDASGRRRPVPITGSEFIMDVDTIVIAIGTGPNPLLTKTTEGLELTKHGYIAVDEEGRTSREGVWAGGDIVTGSATVILAMGAGKKAARSIHEYLQNKKWR

SEQ ID NO: 14905 - protein, 221 aa, Thermoanaerobacter tengcongensis MB4
MRKVVTFEELKPLFKDGMTLMIGGFLANGTPEKLIDLLIELNVKDLTIIANDTSFPDRGIGRLVVAGLVKKVITSHIGTNPVTGKLMNEGKIEVELVPQGTLAERIRAYGAGLGGILTPTGVGTMVEEGKQKITVNGKEYLLELPLGADIALIRGSIVDEFGNIYYKGTTRNFNPIMALAAKTVIVEAEKIVKVGEIKPEDVMTPGVLVDYIVKGGEGDDN

SEQ ID NO: 14906 - protein, 221 aa, Thermoanaerobacter tengcongensis MB4
MITDQELAKQIIAKRIAKELKHGELVNLGIGLPTLVANYIPEGVHVIFQSENGITGMGPMPEPGKEDVNIINAGGQYVTVMPGAAFFDSAFSFALIRGGHVDVTVLGALEVDEEGNLANWIIPGKLVPGMGGAMDLATGAKRVIVAMQHTAKGQPKILKKCRLPLTAKGKVSLIVTELAVIEVTKEGLLLKEIHRDTSIEEVKSLTEANLIIPDDVKYMDV

SEQ ID NO: 14907 - protein, 459 aa, Thermoanaerobacter tengcongensis MB4
MNLFRKKSVDQLLEAAEKTGLNKKLTAIDLAALAIGSVVGTGIFVSTGEGALRAGPGVIISYIIGGITAALAAFIFAELVTMFPVAGSTYTYSYVAFGELIAWIIGWDLLLEYLVSASAVASGWSGTFVGLLKSFGITLPEAITKPPISGGIMDLPAILITAFVAWILYIGVRESATTNNIIVLVKIGVILLFLFLGFSHVKLSNLTPFAPYGWKGIMSAAAIIFFAYIGFDAVSTAAEETKNPTRDVPLGLVMAMVVILALYISVAVVLVGMVPYKTIIPDNALPGALMSIGINWGSALVATGAAVGMISTLLITLYGQIRIFMVMARDGLLPEVFSHIHPKYRTPHINTVITSLVAAIIAGFLPLDIIIELCNIGTLSVFVIVSIGILVLRVKMPNVERKFRVPAVWLVAPLTAAFSLYLMASLPWVTWLRFGIWMLVGLIIYFAYGRYHSVLNVQK

SEQ ID NO: 14908 - protein, 384 aa, Thermoanaerobacter tengcongensis MB4
MPKKDLYEILGVDRNASQEEIKKAYRRLAKKYHPDLNPGDKEAEQKFKEINEAYEILSDPQKRAQYDQFGHAAFEQGGSQQGGFGDFGEGGFDFDFGGFGDIFGDIFSDFFGTGRRKAEKGPKKGADIRYDLTLTFEEAAFGTEKEIEVERFEVCDVCHGTGVKPGSRPETCPVCHGTGEIRQTQNTPFGRIVNIRTCPRCHGEGKIITDPCQKCGGTGKIRKRRKIKVTIPAGIDEGQMLTLRGEGEPGLRGGPNGDLYIVIHVKPHEIFKREGYDVYVKIPISFADAALGGEIKIPTLDGMVSFTIPEGTQTGTKFKLRGKGIPHIGGRGRGDQIVEVYVEVPKRLSEKQKELLREFKRLEGENTAEHKSFFQRMRDAFGGS

SEQ ID NO: 14909 - protein, 283 aa, Thermoanaerobacter tengcongensis MB4
MIRGCRMKVGYLGPKGTFSEEAVFKYIEGMKECEAIEFATIQDVVKSVAEGTCDEGILPVENSIEGSVNVSLDLLINDAEGILVRGEVIISISQCLICDDFIDFKDVHCILSHPQALAQCREYILNNFPTAEVKTTESTVKALLGVNAKKGIVAIGPERAAWLYNLKILEKDVQDIKENYTRFLVIAKRDSDYTGEDKTSIVFSVPNVPGSLYRALGVFAEKNINMTKIESRPSRKKFGEYVFWVDIEGHRKEERIKEALEDLKIKADFLKVIGSYPKFKMGK

SEQ ID NO: 14910 - protein, 435 aa, Thermoanaerobacter tengcongensis MB4
MIKAKNRLGIVFFPAFDWAISPTHPEREERLLYTQDQIFEEGIEDIEGIKFYNPIIAEEKDINRVHFVVPDVKSVVTQSHLISAGGAIKALQAVMEKEVDKAFALVRPPGHHAQRVVYGDRGFCIINVEAVMLERIRQEYGNLRVAIVDTDCHHGDGTQDIYWNDKDTLFISLHQDGRTLYPGTGFIEEFGGPAAYGYNINIPLPPGTGEEGFLYVLDNVVIPILEEYKPDIIINSAGQDNHYTDPLTNMNFTAQGYAKLNERLNPDIAVLEGGYSIEGALPYVNLGIILAMAGIDYSRVREPDYDEEKLKQPKDITEYIKKLSEIVYNRWRNKDDLRLKEFKDVNYVKRPRRVYYDTDGILETQVQNFKICNKCSGVNTIESKSDRGYHIFAITIPRDACPNCIDEGYKLYKNASSHYTNVYLQDRVNDEYYSK

SEQ ID NO: 14911 - protein, 306 aa, Thermoanaerobacter tengcongensis MB4
MVANNILDLIGKTPVVKLNKVPDKNSAEVYLKLEFFNPAGSVKDRIALAMIEKAEKEGILKKGSVIVEPTSGNTGIGLAMVGAAKGYKVIIVMPDTMSMERRMLLAAYGAEVILTPGKLGMEGAIRKAEELVKQNKNYFMPQQFENLANPLIHEETTAKEIIEDFKEGLDAFVAGIGTGGTITGVGRVLKKVFPDIKIVGVEPYSAAVLSGREPGPHKIQGIGAGFIPKVLDREVLNEVIPVKDEDAFEMTRILAKKEGILAGISTGASLWAALNVAKKLGKGKKVLAIAPDSGERYLSTQIFREH

SEQ ID NO: 14912 - protein, 277 aa, Thermoanaerobacter tengcongensis MB4
MELWFTEHQDENLRFSIKVKETLVVEKTPYQHLAILDSYQFGRVLVLDGILQTTEKDEFVYHEMIVHVPLFTHKNPKDVLIIGGGDGGSVREVLKHSSVERVVLAEIDEAVIRNSKKYLPTISSALDDPRVEIMIGDGIKYVNEHKNEFDVVIVDSTDPIGPAVGLFTSDFYRAVYECLREDGIIVAQTESPFIYGKLINKISKMFKEIYPITKAYIATVPTYPGSLWTFTMGSKKYDPEEVDINSIPRIQTKYYTPEIHKAAFVLPKFVKDIFDEV

SEQ ID NO: 14913 - protein, 293 aa, Thermoanaerobacter tengcongensis MB4
MMRCKMGERVNFIDTGKFLTATKEYEEADIVLVGVPMDYSVSFKPGTRFGPSSIRQASYGLETYSVYLDRRLEDKKICDLGDLVLPYGNIEKSLRLIEEVAEKIVKDGKKGIFLGGEHLITYGILKSYIKKYGDKLAILHFDAHTDLREEFFDEPYSHATVLRKVWELSPKVKIYHFGIRSGEKEEFEFAEKNTNMFLYEVVEPLKNVMKEIKENFIYITFDIDVLDPAFAPGTGTPEPGGITAKEALEAIHLLKDFNVIGMDLVEVSPPYDVAGITSILAAKLVREAILSFF

SEQ ID NO: 14914 - protein, 216 aa, Thermoanaerobacter tengcongensis MB4
MKIAPSILSADFANLLQDVKEIEEDADLLHIDVMDGHFVPNITIGSVVVKALRQYTSLPFDVHLMIENPDLYIEDFVKAGADIITVHQEACVHLHRTIQRIKGHEVKAGVALNPATPLETLKYILEYVDLVLVMTVNPGFGGQKFIDSMLKKIKELDEMRKEMNLSFEIEVDGGINIKNIKQVVEAGADIIVAGSAIFESPDPSSTIKEFREAVGT

SEQ ID NO: 14915 - protein, 393 aa, Thermoanaerobacter tengcongensis MB4
MELHFKTKVVHIGNYVDEKIPPKPKTLPIYQTSVFTFDTLEEVYDYLDGNPSRYMYTRLGNPNQTAVEELIANLEGAEAGQACASGMAAISSALLAEVNSGDHIIAAKDIYGGTNSLFNLEFKRLGIEISLVDFSDLESVEKAIKPNTKVIYMEIMTNPLIRVFDIEEVVKIAKRHGLKLIVDNTFTTPYLIRPLEVGAYAVIHSATKYINGHSDVIGGLIAGNKEFIFRTRRIVHNFGGSMSPFDAWLTLRGAKTLFLRMREHCKNAMRLAEFLESHPKVKKVFYPGLPSHPDYSIAKKLFKDEFGGMLSFEIDGGEQSVNRFMQELKLIKFAPSLAGVQTMITHPKSTSHRALSKEELKALGISEGLIRVSVGIEEIEDVIRDFKQALDKV

SEQ ID NO: 14916 - protein, 262 aa, Thermoanaerobacter tengcongensis MB4
MNRIDRRFDDLKKEGKKALITFITAGDPDIDTTYDIVLALEEAGADIIELGIPYSDPLADGPTIQASSQRALAKGIKIKDIMDLVMRIREKSDIPIVYLVYYNSVFKYGIEKFLEDSKNAGVDGLIIPDLPLEERKEVLDVADKYEIYLIPLVAPTSKERIKGITENGKGFVYCVTLTGVTGAREEITTDLEEYMRLVSSYTSMPKALGFGISGPEMARKLKSLSDGIVVGSAIVERIAKGYNRCEMLKEVKEFVLSLREVL

SEQ ID NO: 14917 - protein, 451 aa, Thermoanaerobacter tengcongensis MB4
MNYDVIVVGGGPGGYTAAIRLSELGKKVALIEEDSLGGTCLNRGCIPTKVYAHAAELVTRIKEAKDFGITAEYTLDIAKLRQKKERVVKRLVGGVGYLMNLHHIDVINGKGTFIDKNTVEVNGAKYTAENFIIATGSKVFLPPIEGIDLEGVMTSDKALELEKIPEKIVIIGAGIIGLEFANIYASLGSKVIMIEMLPQLLPMLDRDVVGVMEKALKKQKIELHLNSKVEKIERGLRVIYTENGNQESVECDAVLVAVGRVPNVNGVDALNLEMNGRGIKVDSHMRTSIENIYAIGDVTGGIQLAHVASYQGIVAAHNIAGEEKEADLTAVPNCLYTNPEVAWVGLNESQAREKYGEVKIGTFPYTALGRAMTMGESDGFVKIIAEGKYGRVVGMEIIGAGATEIIHEGVLAIKEEFTLEELADSIHAHPTLSESIKEAAEDALGMPINKG

SEQ ID NO: 14918 - protein, 334 aa, Thermoanaerobacter tengcongensis MB4
MLAFLPKFLYNIMGLLIKFYGGRVVKGRLILIVDDDRFTRRILRDILEKEGYSIIEARDGEEAFRLYKEMLPDMVILDVVLPGMSGFDLLKILRKEEENLMLPILVLTAKGDFEEKIKGLELGADDYLVKPVNEKELVIKVNNLFQRIEHNRMANPLTGLRGNIDIKEEIKRRIKSKELFAVLYIDLDNFKSYNDYYGFLRGDEVIKLTAKILSDAVELVGNDKDFLGHIGGDDFVIITTPEKAEEMCKYIISRFDSEIKFLYDKKDRERGYIETTSRRGEKLKFPFVSVSIAIVTNEFRDFRSDLEISEVAAELKKKLKQMKGSCYLKDRRRG

SEQ ID NO: 14919 - protein, 429 aa, Thermoanaerobacter tengcongensis MB4 [sequence omitted]

SEQ ID NO: 14920 - protein, 248 aa, Thermoanaerobacter tengcongensis MB4
MRRPIIAGNWKMHKTPSEAVKLVEELIPLVKDAKAEVVVIPPFVDLTEVARVIKGTNILLGAQNMFWEEKGAYTGEISPVMLKEIGVTYVVIGHSERRQYFKETDEMVNKKVLSALSHDLKPIVCVGESLSQREEGKTYDVVLTQTREALKGVSEEDITKVVIAYEPVWAIGTGKNATPQDANEVIKAIRNTIAELYGKDKAEMVRIQYGGSVKPDNISGFMAESDIDGALVGGASLVAEDFAKIVNY

SEQ ID NO: 14921 - protein, 394 aa, Thermoanaerobacter tengcongensis MB4
MKKKTVRDIDVSGKRVLVRVDFNVPMDENKNITDDRRIREALPTIEYLINHNAKVILVSHLGRPKGKFNPDYSLKPVAKRLSELLKKPVIMAEDVIGEDAKVKAAALKEGEVLLLENVRFHAEEEKNDPEFAKELASLADIYVNDAFGTAHRAHASTAGVAKYLPAVAGFLIEKELSIMGEALENPKRPFVAILGGAKVSDKIGVITNLLEKVDSLLIGGGMAYTFIKAKGYEIGKSLLEEDKIELAKEIMEKAKQKGVNFMLPVDTVIAKELKSGVPYEVVDIDKMPEDQIGVDIGPKTIEEYSKVIKHAMTVVWNGPMGVFEIPEFAKGTKAIAKALSECKGTTIVGGGDSAAAIEQLGYADKVTHISTGGGASLEFLEGKVLPGIDILNDK

SEQ ID NO: 14922 - protein, 268 aa, Thermoanaerobacter tengcongensis MB4
MAIAFITGATDGIGREVAKRLAFHGYDVIIHGRNELKLEKVADEIRDLTGKSVFKIKADFSSLKDLKKLVKEIKDNFSKVDLLLNNAATFEKERKVTEEGFERTFMVNYLAPFYLTISLINEGVDIKYVLNVSSMAHASSIEFEDLQLEKGYDGYKAYSLSKLYITLFTYYLAEMLKGKIYVNCLHPGVINTKLLMENWGAIGASIEEGAKNVIDAIKYIEAHNVTGVYFDNGKPSKSKPITYDREVQRKLWEKTLKLLKINERDLKF

SEQ ID NO: 14923 - protein, 451 aa, Thermoanaerobacter tengcongensis MB4
MKKLISFDYSKALPFIHPHEIEYMEKHAKLSLEMVLKANAQGNGFLGWVNLPRDYDRAEFERIKKAAHKIQSDSDVLVVIGIGGSYLGARAAIEMLSHSFYNLLPKGKRNTPEIYFAGNSISSTYLKDLLELIADKEVSINVISKSGTTTEPAIAFRVFRDFMEKKYGKDKARSRIYVTTDREKGALKKLADSEGYETFVIPDDVGGRYSVLTAVGLLPIAVAGINIDEMMEGAYEASTVYTKEDLSENISMQYAILRNILYRKGKAIEILVNYEPRLHYFAEWWKQLFGESEGKDQKGIYPASVDFTTDLHSMGQFIQEGSRNIFETVLNVEKPAKDIIINEDRDNIDGLNFLAGKTIDFVNKKAFEGTLLAHTDGGVPNLVVNIPEITPFYFGNLVYFFEMACAISGYINGVNPFDQPGVEAYKKNMFALLGRPGFEKEREELERRLRG

SEQ ID NO: 14924 - protein, 449 aa, Thermoanaerobacter tengcongensis MB4
MSSKKEVKKILNLALPAVGEMLLYMVVWVLDTMMVGQYGGKDSVSAVGLASEIIYTFAAIFVTMGIAIGVTSYVARSIGAQEFEKAKRYASQGIFLGILGSFIISSLMFLLAEKILILAGASGNVLALGKVFMKIASVGIFFNMVMSTLNAILRATGNTKTPMTAAAIVVILNILLDWILIFGKLGFPALGVKGSAIATTIAHIVGFFFVLWYYIIQKTLNLTFRDVLQYHHKLAIEIIKLSIPASLQEAAFDISRLLSIFMIMHLGTVAFAANQIATTIESISFMPGWGFAVAATTMAGQMVGAKNYEGAIRYTRISATFAASIMGTMSLLFLTIPKLLMRAFINDPEVIAVGALCLMVASIEQPFMALGMVYGGGLKGSGNTKIPFIISTISSWLIRLPLMYVVIYILKWGVVAVWFVTALQWSFEGTAMYLFFKREINKLKRAVKG

SEQ ID NO: 14925 - protein, 381 aa, Thermoanaerobacter tengcongensis MB4
MKIVKVLTLAVTFLMLFTGWNNIAYADVSGVTFFTPYINIAVTPGETISYSIDVQNKSGQIKNIPLSVKAPEGWQTTLTAGGWKIEEISVKPNDSQTITLTVEVPLKVDKGSYKVVLLGSGVPVLTLTVNVTEQGTYQTELTTDQPNMEGTNKSTFSYELKLKNRTPDTQNYALIADVQPGWNVQFTVEGKEVTSVSVEPNSQKLIRVSITPPSQIKAGTYKIPIKAETKNTSASVTLEVVIRGTYGLKLTTPTGVLSTDIVAGGDKKVTLQVKNTGSAQLAKIKFYADTPVDWQVTFEPDTIDTLAPGETKEVTATIHADKKAIAGDYVVTMRASTPEASDEAVFRVTVKTSWGWGIVALLIIAATIGVLYYLIEKYGRR

SEQ ID NO: 14926 - protein, 446 aa, Thermoanaerobacter tengcongensis MB4
METDVLVIGGSAGGILAALSVKKTYKDKKVTVIRMAERVMVPCGIPYIFGTLKDTSKNVIPDSMLTNAGVELVIDEVVSIDRQNKKVSTRKNGDISYKKLILATGSLPIVPTFIPGYDLDNVFTIKKDEEYLKFVQQKINEAEDVVVVGGGFIGVEMAEQVQLLGKNVTIIEVADKLLWQAFDPEFSDMAEAKLKEHGIKVLTGTKVTKFIGEKEVKEVEIHTGERIKADVVIVAMGVKPNTKLAEEAGIKLNEKGAITVDEYMRTNDPDIFAVGDCAEKKCFFTRKNVPILLASIAANEAKIAGVNAFELRLVRENKGTISAFSTKIYNTAFAAAGLTETQARAEGFDIVIGEFNTIDKHPGTLPNTMNVKIKLIFSRYSGVILGAQLAGGDNVGEMINILSLAIQKGTTASELTTFQVATHPLLTSSPVSYPISSAALDALSKI

SEQ ID NO: 14927 - protein, 469 aa, Thermoanaerobacter tengcongensis MB4
MNEIGLIGLAVMGQNLALNIARKGYSVSVFNRTSEKTKEFLEERVKNEKIEGYHDIKSFVESLKKPRKIILMVKAGKPVDDVIQELLPYLEKGDLIIDGGNSYFKDTSRRIKELKEKGILYLGMGVSGGEAGALHGPSLMPGGSIEAYEMVKDVLLKIAAQTESGPCCTYVGNDSAGHFVKMVHNGIEYAIMQAISEVYDIMRKILKFSPEEIGDVFERWNNGELNSFLMEISFKIMRYKDEETGKHLVDLILDEAEQKGTGKWTSQTALDLGIPTPSLSLAVEARSLSFFKEDRVKLSGKVKKTYPDVKLDKEKVIKDLENALLFSVFTSFSQGLWLIHEASKTFEYNIDLPEVLRIWKGGCIIRAKILDFLREILNENKENVNLLDSDKSISFLMDKLDSIRYVTNLAKEFYIPTLVLSSSLDYFLSMVEGNLPANLIQAQRDFFGAHTYRRIDKEGIFHTEWEPID

SEQ ID NO: 14928 - protein, 324 aa, Thermoanaerobacter tengcongensis MB4
MFKVFVTRAIPEEGLELLRKYCEVEVSPYDRMLTKEELLEKIKDKDAVITQLTDKVDKEFFEAAKNVKIVANYAVGFDNIDLEEATKRGVYITNTPDVLTNATAELAWALLFAAARRVVEADKFMRAGKFQGWAPMLFLGKGVTGKTLGVIGAGRIGQAFAKMAKGFEMKILYNARTPKPEFEKETGAKYVDLDTLLKESDFVSIHLPLTPETRHLIGERELKLMKNSAILINTGRGPVVDEKALVKALKEKWIYAAGLDVYEREPEFEKELAELDNVVMLPHIGSATEEARRDMSVLVAQNIIDVIEGRVPRTLVNKDILNKR

SEQ ID NO: 14929 - protein, 495 aa, Thermoanaerobacter tengcongensis MB4
MRIFEVHKKSGVSDSHIAIKFKGRVYTYGEVDALIDKYASYFQSIGVKKGDRVALSFPNCPEYIFSFMGASKAGAIVVPLNMMLTLEEIGYIIMESGTSVLVVHPAIAQKVDKSQLARLNLKNVVIMDENTVNEILKMKSPAPVDIESGEVCAFLYTSGTTGKPKGAMLTHDNFVSDVKMLYDVSRVIDLGPNDNFLTVLPLFHSFSWTVNVLLGLYLGSTITLKETFMPKDTLETLIQEDITVFCGVPSMFAVLMRMAEKGQFKALRLAISGGAPLAAEVQRGFEEKFNFPLVEGYGLSEAAPVALLNPLDPKALRKPGSIGFPLPGVEAKIVDENDNELPVGEIGELVLKGPNVMVGYHNMPEETAKTLRNGWLHTGDLAKKDEDGYFYIVDRLKDMIITGGFNVYPREIEEVLLTHPAVLEAAVVGVGDPLKGEEIKAFIVLKEGAEADRRELQSFLKDKIASYKIPKYFEFVKELPKTPTGKVNKKLLKQM

SEQ ID NO: 14930 - protein, 419 aa, Thermoanaerobacter tengcongensis MB4
MLNYDIVIIGGGPAGLGAAVEAYEKGVKNVVILERDKYLGGILQQCIHNGFGLQEFKEELTGPEYAQRFIDKVEEYGIDVMLDTMVLEITPDRIVKAVNSEKGVFQIKAKAIILAMGCRERPRGAIMIPGTRPAGIMTAGTAQRYVNMEGYMPGKEIVILGSGDVGLIMARRLTLEGAKVKAVVEIMPYSSGLTRNIVQCLEDFDIPLLLSHTVVEIHGKDRVEGVTIAKVDENREPIMETAQYISCDTLILSVGLIPENELSKQAGIELDPVTGGPVVNEMLETSVPGIFACGNVLQVHDLVDNVTAEARMAANSAIRFIREGGFKKSNISVKAGKGIRYVVPQRINVDNIDKRIKFRMRPTDVYNNAILAVKSGDRYLLRQKRIRLTPGEMIDVNLSKEILKNADEKEGIVFLVEEG

SEQ ID NO: 14931 - protein, 242 aa, Thermoanaerobacter tengcongensis MB4
MSDFAKYLAEFFGTMILIWLGDGVVANVVLNKSKGQNSGWIVITAGWGFAVMVGAYTVGWLSGAHLNPAVTIGLATIGKFSWSLVPGYIIAQVLGAFVGAIIVYLMYIDHFAATEDPTAKLGTFATIPAIRNLGKNFITEAFGTAMLLIGILGITNSNNPIGGMGPLLVGLLVWAIGLSLGGPTGYAINPARDFGPRLAHAILPIPGKRDSDWGYGLIVPIFGPIVGGIIGAWIYQLIMSVH

SEQ ID NO: 14932 - protein, 205 aa, Thermoanaerobacter tengcongensis MB4
MIDIKELKFDEKGLIPAIVQDYYTKQVLMLAYMNEESLKLTLEKGETYFFSRSRGKIWHKGETSGNTQKVKKIFYDCDEDALLIQVEAKGPACHTGNISCFYRSFDEETEDGIEILNKLYERIKGRKINPVEGSYTNYLFEKGIDKILKKVGEEATEVVIASKNDSKDEIVYEVSDLIYHLMVLLVEKNITLNDIYNELERRYKK

SEQ ID NO: 14933 - protein, 512 aa, Thermoanaerobacter tengcongensis MB4
MIVLTSQQMREVERIAIEKMGIPSICLMENAGKEVAWEVKRVMEENGLSSAVVIAGRGNNGGDGYVVARNLYNWGIDVKVFVIGSIGSISGDARVNLEAIRNLGIYVAEVTQKEHLKFLEKTLKDSDLVVDAIYGTGLRGEVTGLAKEVIELINQSEKFVVAVDIPSGLNADTGRVEGAAVKARITITMHFLKPGLLIYPGIEYAGEVKIADIGIPSRLAAEVRPSYHYVVSQDVALKSRNPDTHKGDYGKVLIVAGSRSMTGAAFMAAKSAVKTGSGLVRLAVPLSIQPVIQSALYEAIIYGLNEEGGVISYKSLSQIFELIEQSDAVAIGPGLTHEGEVSKLIEDVIRNTEKPLVLDADALNALVGRLEVVKGKRVILTPHYGEMARLTGLKVEDIKNNIFEVARSFVRRYEVTLVLKGARTVIATRDGSIYINSTGNAGMATGGSGDVLTGMIVSLLGQGFEEEKAAVYGVFYHGKAGDVAKKSKGEYGMTAVDILESIPEALSEGLKG

SEQ ID NO: 14934 - protein, 221 aa, Thermoanaerobacter tengcongensis MB4
MRVVLLGPPGAGKGTQALKIAKEFDIPHISTGDIFRQNLRDNTELGKLAKEYMDKGLLVPDEVTNRIVEDRLEKEDCKKGFLLDGYPRNIPQAEELDKFLEERGHSLTAVINIQVEREALIDRITGRRVCPVCGATYHIKTSPPKVDNVCDKCGSELIQRSDDKLESVVKRLEVYEKETKPLIDYYTKKGILVNIDGNKSIDEVFEDIKKALLGDRRDDIH

SEQ ID NO: 14935 - protein, 400 aa, Thermoanaerobacter tengcongensis MB4
MAKQKFERTKPHVNVGTIGHVDHGKTTLTAAITLILSKAGLAQAKGYDEIDKAPEEKARGITINTTHVEYETAKRHYAHVDCPGHADYVKNMITGAAQMDGAILVVSAADGPMPQTREHILLARQVGVPYIVVFLNKADMVDDPELIELVEMEVRDLLNQYEFPGDDTPIVVGSALKALECGCGKRECQWCGKIWELMDVVDEYIPTPERDIDKPFLMPVEDVFTITGRGTVATGRVERGKVKVGDEVEIIGLTTESRKTVVTGVEMFRKTLDEAQAGDNIGVLLRGIQRDEVERGQVLAKPGTIKPHTKFEAQVYVLTKEEGGRHTPFFNGYRPQFYFRTTDVTGTIQLPEGVEMVMPGDHVTLRVELITPIAMEEGLKFAIREGGRTVGAGVVSAIIE

SEQ ID NO: 14936 - protein, 136 aa, Thermoanaerobacter tengcongensis MB4
MEKDKMILVKEKGVLDLSPLVLAFIGDAVYSLYVRTKIVEKGNMKLAHLNEQTVKYVKASSQARSLERIYDLLTEEEKEIVRRGRNAKASTVPKGASVKEYKYATAFEALVGYLYLLERFDRLYFLLSLSMEYTEE

SEQ ID NO: 14937 - protein, 454 aa, Thermoanaerobacter tengcongensis MB4
MKDGGEMKKSTTKFVCRECGFESSKWLGRCPNCGSWNSFDEEIVGDFKEKKVKSRNSKNLYLLREVVSSEEERIKTGIEEFDRVLGGGIVRGSLVLIGGDPGIGKSTLLLQVAGNVSEKFTVLYVSGEESPQQIKLRADRILKERQDLYLLCETNIDVIEEKIEEIRPDFVIVDSIQTMYTEESETIPGSISQVRYASQKLMAIAKEKNISVFLIGHVTKEGAIAGPKVLEHMVDTVLYLEGDASHSFRVLRAVKNRFGATHEIGVFEMQDKGLEEIRNPSEFILMSRPKGVAGTAIVSSLQGTRPILMEVQALLSYTSFGMPRRMATGFDYNRFILLLAVMEKRLGLNFSNFDAYVNVTGGIKIQEPAADLGVIAASLSGYYNIPLPEDVCFVGEVGLAGEVRGVGNIDKRINEAKKMGFSKVFIPHMKAKEEGIEVIKVKDIKEVMEFVRGL

SEQ ID NO: 14938 - protein, 473 aa, Thermoanaerobacter tengcongensis MB4
MDEKVKIKEEIPEYITLEEALTLNKNQVKENYKEYINSVFVSMLSMLQFDKLFVRAKGVSVWDSEGNEYYDFLGGYGALNLGHNPDEVIEAVEKVKDMPNLLQASIGNLPGVLAHNLARVTPGNLKRSFFCNSGAEAVEGALKLAKIASGKKKIVYCENSFHGKSMGALSVTGRRKYQKYFEPLVPETVAVPFGDEKALEEALKEKDVAAFIVEPIQGEGGVIVPPEGYLRKARELCTKYEAYLIVDEIQTGFGRTGKMFACEHEEVVPDIMTLAKSLGGGVMPIGAYITTDEIWQKAYGTMEKALLHTSTFGGNTYACAAAIASIQAIIEKKLSEAAKEKGEYFLGRLKELKEKHPKLIKDVRGKGLLIGIEFNQPEGGLLDKLSGGAISKLSSEYIGSLIAAELQNKHRIITAYTLNNPNVIRLEPPLIVTKEQIDKVVDALDEILTRNSSFLGITVSGAKTVLGSLFKRQ

SEQ ID NO: 14939 - protein, 181 aa, Thermoanaerobacter tengcongensis MB4
MPSPMEDIEEILITEEQLKAKVKELGEMITRDYEGKDLVLIGVLKGAIMFMSDLSRAIDLPLSIDFMAVSSYGSSTKSSGIVKIIKDHDIDIEGKDVLIVEDIIDSGLTLAYLRETLLGRKPRSLKICTILDKPERREADVKVDYCGFKIPDKFVVGYGLDYAEKYRNLPFIGVLKPELYK

SEQ ID NO: 14940 - protein, 312 aa, Thermoanaerobacter tengcongensis MB4
MSGRENKIYEDITQLIGNTPMIRLNKVVPENSAEVIVKLESFNPGGSVKDRIALNMIKRAEEEGRLKPGGTIVEPTSGNTGIGLAMVSAVKGYKLILVMPDTMSIERRNLLLSYGAELVLTPGAEGMKGAIKKAQEILELNPDYIMLDQFKNPANPEIHELTTAKEILKDTNGIVDAFVAGVGTGGTISGVGKVLKQYNKDIKIFAVEPEESPVLSGGKPGPHKIQGIGAGFIPDTLNLDVIDEIIKVKERDAFEMSMKLAKQEGILCGISSGANVFAAVEVANRLGKGKRVVTVLPDTGERYLSMHKFFEY

SEQ ID NO: 14941 - protein, 249 aa, Thermoanaerobacter tengcongensis MB4
MYKVVLLRHGESIWNMENRFTGWTDVDLSPKGIEEAKQAGKILKEKGFTFDAAFTSVLKRAIRTLWIVLDELDLMWIPVYKSWRLNERHYGALQGLNKAETAKKYGEEQVKLWRRSAEVRPPALTKDDPRYPGNDPRYADLSEDEIPLTENLIDTINRVIPYWESTIAPTIKSGKRVIIAAHGNSLRGLVKYLDNLSNEEIMELNIPTGIPLVYELDENLKPIRHYYLADEEELKKKQQEVAEQGKARA

SEQ ID NO: 14942 - protein, 393 aa, Thermoanaerobacter tengcongensis MB4
MITYEKKYLMDTYNRYPIMLVKGEGTRVWDSEGNAYLDFVAGIAVNSLGHCHPALVEAIKKQAETLIHCSNLYWNEKQIELARMISENSFGGKVFFANSGAEANEGAIKLARKYASLKYGGKRYKIITAKNSFHGRTFGALTATGQEKYHKGFGPLLAGFKYVPLNDIEALYEAVDDEVCAIMLEVIQGEGGIHEATPEYVKAVRKICDENDLLFILDEVQTGIGRTGKLFGYEHYGVVPDIMTLAKGLGGGFPIGAIVAKEDKAVFKPGDHASTFGGNPLACAAGIAVLNEVTKDGFLEGVDKKGKYFREGLETLQKKHKVVKEIRGKGLMVGCEVDLEDASEIVLKALEKGLLINSVSHNVLRFVPPLIVTEEEIDEALQILDDVLSEIRF

SEQ ID NO: 14943 - protein, 475 aa, Thermoanaerobacter tengcongensis MB4
MANSTSSYLWRKKTLEMVLSETEAEQFKLKKTLTAIDLIALGIGAIIGTGIFVITGVAAAEKAGPAIVLSFILAGLACAFAAISYAELASMFPIAGSTYNYAYIAMGEFLAWIIGWDLILEYVFALPAISLGWSGYFTNLLGSIGINIPAWAANSAWQAPGTGGLINLPAIGILLAIAILNYIGVRETATVNNIGVAFKVFVVLFFIFTAVWYVKPANWSPFLPYGWAGVFHGAAIIFFAYIGFDAVSTAAEETKNPAKDMPIGILGSLGISTLLYIAVSAILTGVVSYTELNDPAPVAKALNLIGLNWARGLVSLGAIVGITTVLLVMFYGSTRIIFAMSRDGLLPPIFSKVHPKYRTPTLAIYLITIATTLVAGFFPIGVIAELVNIGTMLAFVLTSIATIVLRYTQPDLPRKFRAPGMPWTGILAIAFVLSLMVSLPWETWVRLIVWFVIGLFIYFGYGRHNSILAKQQTQH

SEQ ID NO: 14944 - protein, 451 aa, Thermoanaerobacter tengcongensis MB4
MPKRYVIIGGDAAGMSAASQIRRMDKEGEVLVFEKEGVISYAQCGLPYWVGGVVSEKKKLIARTAEEFLNRYNIDVKLYHEVVKIDPSKKEIKVFRREEKDEIAVPYDVLLIGTGSTAIVPPWEGRNLPGVFTLKTMGDAEKLLDWLSSHTPTKAVVIGGGYIGLETAEALHSRGFKVTVLDLAPQLIPTFDKEIAEIAQDALTRHGVEVHLNEEVVGLEGDEKGVKAVVTKNGKFEADLVIISIGVRPVSELAKEAGIELGPKNAILVNERLETSIPDIYAAGDCATHFNRIKNAPDYIPLGTTANKQGRIAGINMAGGDAKFAGVVGTAIVKVFDRTIARSGLGERDCEALGIPYQVVLIKARPVSHYYPWEDEILTIKLCYHKDNRKLLGGQIAGGLGGVDKRIDVLATALFHEMTIDELQALDLAYAPPYNSVWDPLQQASTVAQRG

SEQ ID NO: 14945 - protein, 180 aa, Pisum sativum
MASMISSSAVTTVSRASTVQSAAVAPFGGLKSMTGFPVKKVNTDITSITSNGGRVKCMQVWPPIGKKKFETLSYLPPLTRDQLLKEVEYLLRKGWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 14946 - protein, 365 aa, Arabidopsis thaliana
MLVKPSIISGLVRLTSHSPSSSSSVLRRQEFLVRTLCGSPIIRAMSSTSEADAESVLRTVTPSLDLKRHKGQAGKIAVIGGCREYTGAPYFAAISALKIGADLSHVFCTKDAAPVIKSYSPELIVHPVLEESYSISQLSEEDKREVQDKVLGEVGKWMERFDCLVIGPGLGRDPFLLECVSIIMLLAKKSNVPFVIDGDGLFLVTNSIDLVHSYPLAVLTPNVNEYKRLVQKVLNCEVDEQNAEDQLRSLAKQIGGVTILRKGKSDLISNGETVKSVSIYGSPRRCGGQGDILSGGVAVFLSWAQQLKSDPESPSENPAILGCIAASGLLRKAASLAFTKHKRSTLTSDIIECLGESLEDICPAS

SEQ ID NO: 14947 - protein, 435 aa, Schizosaccharomyces pombe
MTTIQKIYSRSIYDSRGNPTVEVELTTELGTFRSMVPSGASTGEWEAKELRDNDKNKWGGKGVTIAVHNVNNIIGPALVKSDIKITDQRGIDEFMIKLDGTNDKSKLGANSIVGVSMAVARAAAAFLKIPLYEYIGKLAGSKTTECIPVPSFNVLNGGRHAGGDLAFQEFMIMPIKAPTFSEGLRWGSEVYHTLKALAKKKYGASAGNVGDEGGIAPDLTTAEEALDLVNEAIKEAGYDGKVKIGFDVAASELYNGKLYDLDFKSEHPKPENKLDYKKLYEKYSALIEKYPIVFIEDPFSEEDWGAFSYMSSKTKVEVIADDLTVTNVKRLSKAIELKCANALLVKINQIGSLSETIDAANMAKKAGWGLMVSHRSGETDDSFIAHLAVGLEAGQMKSGAPCRSERLAKYNELLRIEDNLGDSAIYAGTRAADYI

SEQ ID NO: 14948 - protein, 341 aa, Candida albicans
QAVPVTLHNEQVTYAADITVGSNNQKLNVIVDTGSSDLWVPDVNIDCQVTYSDQTADFCKQKGTYDPSGSSASQDLNTPFSIGYGDGSSSQGTLYKDTVGFGGVSIKNQVLADVDSTSIDQGILGVGYKTNEAGGSYDNVPVTLKKQGVIAKNAYSLYLNSPDSATGQIIFGGVDNAKYSGSLIALPVTSDRELRISLGSVEVSGKTINTDNVDVLLDSGTTITYLQQDLADQIIKAFNGKLTQDSNGNSYEVDCNLSGDVVFNFSKNAKISVPASDFAASTQGDDGQPYDKCQLLFDVNKANILGDNFLRSAYIVYDLDDNEISIAQVKYTSASSTSALT

SEQ ID NO: 14949 - protein, 324 aa, Cicer arietinum
KNGISVAVKRSEPGSGQGLPEFQTEIMVLSKIRHRHLVSLIGYCDERYEMILVYEYMEKGTLRDNLYNSTNMPCLTWKQRLEICIGAARGLHYLHKGATGGIIHRDVKSTNILLDENLVAKVADFGLSRTGPLHQHSYVITGVKGTFGYLDPEYFRSHSSTEKSDVYSFGVVLLEVLWSRPAIDPSLPRKQVNLAEWGLLCKDKGMLEDIIDNSIKGQIDPNSLRKFSETVEKCLQDDGCDSHKMGDVLWDLEYALQLQRGAIHREPHEDSSSSASVSIQLPNIRRLPSLSTLSEVDDMSIGRLDESDSAADSVFSQLKIDDAR

SEQ ID NO: 14950 - protein, 238 aa, Cicer arietinum
FDKGARTALAFVTLRADGEREFMFYRNPSADMLLTPEDLNLELIRSAKVFHYGSISLIVEPCRSAHLKAMEVAKDAGCLLSYDPNLRLPLWPSPEEARNQILSIWDKADLIKVSDVELEFLTGSDKIDDASALSLWHPNLKLLLVTLGENGSRYYTKNFHGSVDAFHVNTVDTTGAGDSFVGALLGKIVDDQSILEDEARLREVLKFANACGAITTTKKGAIPALPTEADVLSLIKGE

SEQ ID NO: 14951 - protein, 278 aa, Nostoc sp. PCC 7120
MTNQAPIPVIVNGAAGKMGREVVKAVAQAPDLNLLGAIDSSPEHQGKDAGELAGLSEPLEVPITNQLEPMLGYVAGERQGPPGVIVDFTHPDSVYDNVRSAIAYGIRPVVGTTGLSPAQIQNLADFAEKASTGCLIIPNFSIGMVLLQQAAVTASQYFDHVEIIELHHNQKADAPSGTAIQTAELLAELGKTFNSAIVEETEKIPGARGSLAEEGIRIHSVRLPGLIAHQEVIFGAPGQIYTLRHDTSDRACYMPGVLLAIRKVLQLKSLVYGLEKIL

SEQ ID NO: 14952 - protein, 262 aa, Salmonella typhimurium
MERYENLFAQLNDRREGAFVPFVTLGDPGIEQSLKIIDTLIDAGADALELGVPFSDPLADGPTIQNANLRAFAAGVTPAQCFEMLALIREKHPTIPIGLLMYANLVFNNGIDAFYARCEQVGVDSVLVADVPVEESAPFRQAALRHNIAPIFICPPNADDDLLRQVASYGRGYTYLLSRSGVTGAENHHLIEKLKEYHAAPALQGFGISSPEQVSAAVRAGAAGAISGSAIVKIIEKNLASPKQMLAELRSFVSAMKAASRA

SEQ ID NO: 14953 - protein, 427 aa, Marinococcus halophilus
MMQNDLSVFNEYESEVRSYVRGFPTVFHQAKGYKLWDLDGKEYVDFFSGAGALNYGHNDENMKQKLLTYIQEDGVTHSLDMATKAKGEFIDAFQNIILKPRNMDYKIMFPGPTGANSVESALKLARKVTGRTNVVSFTNGFHGMTIGALSVTGNKFKRNGAGMPLSNTSTLPYDQFLKESNNSIEYIENFLDNGGSGLDKPAAFIVETVQGEGGLNAASSEWLRSIEKICRERDIKLILDDVQAGVGRTGTFFSFEPAGIKPDFVCLSKSIGGNGSPLAITLVAPEYDKFAPGEHNGTFRGNNFAFVTGTEALNYWKDDRLEKNVQEKSERITSFLDDMIKKHPEMKGVRKGRGFMQGIMSPIEDLADNIAGRCFEHGLIMETAGAEDEVFKLFPPITIDDEGLERGLSILQQAIEEVTAESNLVAK

SEQ ID NO: 14954 - protein, 347 aa, Lycopersicon esculentum
MAGESISGNLKDLSLNRNGAVSKKSHLVVCFGEMLIDFIPTVAGVSLAEAPAFEKAPGGAPANVAVCISKLGGSSAFIGKVGDDEFGRMLADILKQNNVDNSGMRFDHDARTALAFITLTAEGEREFVFFRNPSADMLLRESELDVDLIKKATIFHYGSISLIDEPCRSTHLAAMDIAKRSGSILSYDPNLRLPLWPSEDAARSGIMSVWNLADIIKISEDEISFLTGADDPNDDEVVLKRLFHPNLKLLLVTEGSAGCRYYTKEFKGRVNSIKVKAVDTTGAGDAFTGGVLKCLASDASLYQDEKRLREAIFFANVCAALTVTGRGGIPSLPTQDAVRQTLAEVTA

SEQ ID NO: 14955 - protein, 314 aa, Malus x domestica
ESESVCVTGASGFIGSWLVMRLLEHGYTVRATVRDPTNQKKVKHLLDLPKAETHLTLWKADLADEGSFDEAIQGCSGVFHVATPMDFESKDPENEVIKPTINGLLDILKACQKAKTVRKLVFTSSAGTVNVEEHQKPVYDESNWSDVEFCRSVKMTGWMYFVSKTLAEQAAWKYAKENNIDFITIIPTLVIGPFLMPSMPPSLITGLSPILRNESHYGIIKQGQYVHLDDLCLSHIYLYEHPKAEGRYICSSHDATIHELVKMLREKYPEYNIPTKFKGIDDNLEPVHFSSKKLREIGFEFKYSLEDMFVGAVD

SEQ ID NO: 14956 - protein, 461 aa, Serratia marcescens
MEYQFADGFWWGSATSAPQSEGAAARDGKSRNIFDYWYEIAPERFHERVGPTEASTFYDHFRTDIGLLKTLGHNTFRTSISWSRLIPDGDGEVNPQAVAFYNAMIDVQLAQGITPFINLYHFDMPLCMQQRGGWESRAVVEAYARYADTCFGLFGDRVTHWFTFNEPIVPVEAGYLNDLHYPCVVDFKRAVTVAYHSVLAHAMAVQRFRARRLPGSIGIILNLSPTYPRSDAPEDRQAAHDADLLLNRSFLDPVAKGRYPAALLHLLERHGLMPYCEPQDAQLIEGGVVDILGVNYYQPRRVQAKAGRRAEGPIASPEDLFSYYAMPGRKINPHRGWEIYEKGLYDILMDLKENYGNLPCYISENGMGVEGEEAFIRADGRVEDDYRIDFIREHLKSLHRALAERSQCKRYHLWTFIDCWSWLNAYKNRYALVRLDRADQRRTIKKSGYWFAEAARRNGFD

SEQ ID NO: 14957 - protein, 509 aa, Brassica rapa
MTSVNVKLLYHYVITNLFNLCFFPLTAIVAGKAYRFTIDDLHHLYYSYLQHNLITIASLFAFTVSGFGLYIARLPKPLYLVEYSCYLPPRHLKVSVSKIMDIFYQIKADTSSRNVACDDPSSLDFLRKIQERSGLGDETYSPEGLIHVPPRKSFAGSREETEKVIIGGIENLFENTKVKPKDIGILVVNSSKFNPTPSLSAMVVNTFKLRSNIKSFNLGGMGGSAGVIAIAIDLAKDLLHVHKNTYALVVSTEGITQGIYAEENRSMMFSNCLFRVGGAAILLSNKSGDRRRSKYELVHTVRTHTGADDKSFRCVQQGDDEDGKTGVCLSKDITNVAGTTLTKHIAICRPLILPLSEKFLFFATSVAMKLLKDKIKHYYVPDFKLAVDHFCIQPGGRAVIDELEKNLGLSPIDVEASRSTLHRFGNTSSSSIWYELAYIEPKERLKKGNKKGWQIALGLGFKGNSAVWVALNNVKASANSPWEHCIDRYPVKNDSDLSKSKHQVQNGRS

SEQ ID NO: 14958 - protein, 325 aa, Streptomyces sp. JP95
MRIVRHYEHGAPSVLRLEEVEKPQPGPGQVLIRAEAIGVTFAEVQRRQGIPIGGHAGLPGAPGGDVAGTVEALGEGVTGFAVGDRVVGDVDRDAYADYVVTGTDWLIKIPQDLDAAAATLLPSPAQTAYHAIKEAGRLRPGQSIVIDAASGGVGHLAVQIAKALGAGKVIATASTQAKLDFARELGADVTVNYTDEDWTDQVLAATDGRGADIVLETVGGDVLLKSLGITAQFGTLVFYGSASGDIPDLPTLALSRMKNVAGFSLYAMLYNKQDAVAEGQRHLLDLIASGEVKPVVHDRLPLDEAVKAHELLEARAQLGKIVLVP

SEQ ID NO: 14959 - protein, 326 aa, Arabidopsis thaliana
MSAVLTAGGGLTAGDRSIITAINTGASSLSFVGSAFIVLCYCLFKELRKFSFKLVFYLALSDMLCSFFLIVGDPSKGFICYAQGYTTHFFCVASFFWTTTIAFTLHRTVVKHKTDVEDLEAMFHLYVWGTSLVVTVIRSFGNNHSHLGPWCWTQTGLKGKAVHFLTFYAPLWGAILYNGFTYFQVIRMLRNARRMAVGMSDRVDQFDNRAELKVLNRWGYYPLILIGSWAFGTINRIHDFIEPGHKIFWLSVLDVGTAALMGLFNSIAYGFNSSVRRAIHERLELFLPERLYRWLPSNFRPKNHLILHQQQQQRSEMVSLKTEDQQ

SEQ ID NO: 14960 - protein, 293 aa, Schizosaccharomyces pombe
MPPKLYHPQPTHAIPVSNMRVNTRYEPTAGFSGTSVPSVQAANPSAYLPNSATAQMGFQLGKNAVNAGQEYVEQNFGKWLSTTRLHHYFTVTNSYVVAKLLLIIFPWRRRSWARKLRRSEINGSAEGYCPPAEDLNSPDMYIPLMAFTTHILLLCALAGLQDDFQPELFGLRASKACAVVLVEFLATRLGCYLLNISSQSQVLDLLAFSGYKFVGLILTSLSKLFEMPWVTRFVFLYMYLATAFFLLRSLKYAVLPESTMAINATITSHQRSRRIYFLFFIAASQILFMYVLS

SEQ ID NO: 14961 - protein, 370 aa, Vicia faba
MATTNPFDLLGDDVEDPSQLIITEQLKAAAAPTKKAAEKDQGKRAQTNKPAQLPSKPAPPAQAVRESRNEGGRGSRGGRGGGRGFGGERGGRGRGFGRDFSSNDENSFPASRAPDSQGAVEGEKFSERRGFGGPRPPYRGGRRGGFSNGEGGEEGRPRRAFERHSGTGRGSEFKRDGAGRGNWGTEADEVTQVTDEVVNEAEKNFGDEKPAAENDVAEGNKDTPANEAEEKEPEDKEMTLEEYEKLLEEKRKALQALKTEERKVDTKEFETMQALSCKKDNFEIFAKLGSDKDKRKEAFDKEEKAKKSVSINEFLKPAEGEGYYNQGGRGGRGRGRGTRGGFGGFRGNSTSNVPAPSIEDPGHFPTLGAK

SEQ ID NO: 14962 - protein, 289 aa, Vicia faba
HHSPLPQSPQHGYCCCRRSSLFSSSINTVKSSRSSNRMFASVVIPQSSVEPLCIGTTISSQKLWMPRFYVAVAQEEAVVAVDDEEKVVVEEEEKENEEGQGEKENGEEIVAEEDTRTKLYFGNLPYSVDSAKLAGLIEEYGSAELVEVLYDRDTGKSRGFAFATMTCVEDCKAVIENLDGKEFMGRTLRVNFSDKPKAKESLYPETEYKLFIGNLSWKVTSEILTEAFQEHGTVVGARVIYDGETGNSRGYGFVSYANKSEMEAALTIMNDVELEGRALRVSLAQGKRS

SEQ ID NO: 14963 - protein, 196 aa, Selaginella lepidophylla
MADTEFFTEYGEASRYKIQEVIGKGSYGVVCSAIDTHTGEKVAIKKINDIFEHVSDATRILREIKLLRLLRHPDIVEIKHIMLPPSRREFKDIYVVFELMESDLHQVIKANDDLTPEHYQFFLYQLLRALKYIHTGNVFHRDLKPKNILANAYCKLKICDFGLARVAFNDAPTAIFWTDYVATRWYRAPELCGSFF

SEQ ID NO: 14964 - protein, 138 aa, Cicer arietinum
ENGLTDEKNFFHRPGFGGGAGGVVDLVVVVEEGLGSGLGGGFGAGGGGGAGGGTGGGAGGGFGGGGGGGFGGGGGVGGGSGFGGGSGFGSGVGNGGGLGGGSGGGFGGGGGGGLGGGAGAGGGFGGGAGGGVGGGGFP

SEQ ID NO: 14965 - protein, 446 aa, Avicennia marina
MDVRGGEDVTGGSGAGRKVHSEDMAVEVPETAHQISNDSWLQAGFVLTTGVNSAYVLGYSGAVMVPLGWIGGVVGLILATLVSLHANALVAQLHEYGGKRHIRYRDLAGRIYGRRAYSVTWGMQYVNLFMINVGFVILAGNSLKAVYTLFRHDHVMKLPHFIAIAAIACGLFAISIPHLSAMRIWLAFSMFFSLVYIIVGFALSLKDGIEAPPRDYTLPEKGADKVFTIIGAAAELVFSFNTGMLPEIQATVRPPVIGNMMKALYFQFTVGVVPMYSIIFVGYWAYGSKTTSYLLNNVHGPIWLMTVANIAAFLQSVISLHIFASPMYEIWIPDLESKEVLWPIRNLSFRVVVRGGYVATTAFVSALLPFLGDFMSLTGAISTFPLTFILANHMYLVAKGNKLSPLHKTGLWLNIGFFGCLAVAAAVAALREIVVDSKTYHLFADI

SEQ ID NO: 14966 - protein, 447 aa, Avicennia marina
MESQGREDVVGCSGAGGRVHSDGHIDIEIPETAHQISNDSWFQAGFVLTTGINSAYVLGYPGAVMVPLGWIGGVIGLILATVVSLHANALVAKLHDFGGKRRIRYRDLAGSIYGGKAYSITWGMQYVNLVMINVGYIILAGNSLKAVYLLFRDDHVMKLPHFIAIAGLACGLFAISVPHLSALRNWLAFSTLFSMIYIVGGIALAIKDGFKAPPRDYSIPGTKTSRIFTTIGASANLVFSFNTGMLPEIQATVRPPVVENMMKGLYFQFTVGVVPMYAIIFAGYWAYGSTTSSYLLNNVHGPIWLKTTTNISAFLQSVIALHIFASPMYEFLDTKYGIKGSALAVRNLSFRILVRGGYVAMTSLVSALLPFLGDFMSLTGALSTFPLTFILANHMYLVANRNKMSLLQKNWHWLNVVLFSCMAVAAAVAALRLIAVDSRTYHVFADI

SEQ ID NO: 14967 - protein, 509 aa, Brassica juncea
MTSVNVKLLYHYVITNLFNLCFFPLTAIVAGKAYRFTIDDLHHLYYSYLQHNLITIASLFAFTVSGFGLYIATLPKPLYLVEYSCYLPPRHLKVSVSKIMDIFYQIKADTSSRNVACDDPSSLDFLRKIQERSGLGDETYSPEGLIHVPPRKSFAGSREETEKVIIGGIENLFENTKVKPKDIGILVVNSSKFNPTPSLSAMVVNTFKLRSNIKSFNLGGMGCSAGVIAIAIDLAKDLLHVHKNTYALVVSTEGITQGIYAEENRSMMFSNCLFRVGGAAILLSNKSGDRRRSKYELVHTVRTHTGADDKSFRCVQQGDDEDGKTGVCLSKDITNVAGTTLTKHIAICRPLILPLSEKFLFFATSVAMKLLKDKIKHYYVPDFKLAVDHFCIQPGGRAVIDELEKNLGLSPIDVEASRSTLHRFGNTSSSSIWYELAYIEPKERLKKGNKKGWQIALGLGFKGNSAVWVALNNVKASANSPWEHCIDRYPVKNDSDLSKSKTQVQNGRS

SEQ ID NO: 14968 - protein, 365 aa, Acinetobacter lwoffii
MNSAIKGTNVTALPQKIQTILDKGQGTAARALDKLPKIVQESLAKVLGYPYQYPDLDAFTKCLMAVQIKQGRIGFIGEDPIESRRQFDAQMLAILNKATQIESVEDIRLPLQSGTVFARHYHPAPNKKLPMILFYHGGGFVVGGLDTHDEVCRLIAKYAKVQVLSIDYPLAPEASPQLLIKSCEDALAWVYQNRRQLKIYKNRIAVAGDSAGGNISTVVAQHTAGKSYAPQAQLLIYPVVDFKSRHPSFYAYGEGLVLTSKDVDYVTQYYATQHNIALDNPLISPTYGNLRKLAPAYVITAGHDLLHDEGEIYSHKLRQSGVKVQYVDYPDQTHGFINLTPISSKAKRNTIEIAKNFRKFWDKHS

SEQ ID NO: 14969 - protein, 501 aa, Amaranthus hypochondriacus
MAIRVPSRQLFIDGEWREPIKKNRIPIINPSTEEIIGDIPAATAEDVELAVAAARRALKRNKGEDWASASGAHRAKYLRAIAAKITEKKDYFAKLEAMDCGKPLDEAARDIDDVAGCFEYYADQAEALDAKQKAPIALPMDTFKCHVLKQPIGVVGLISPWNYPLLMATWKVAPALAAGCSAVLKPSELASVTCLELAEVCREVGLPPGVLNILTGLGPEAGGPLACHPDVDKVAFTGSTATGSKVMSSAAQLVKPVTLELGGKSPIVIFEDVDLDKAAEWTAFGCFWTNGQICSATSRLLVHESIAAEFLDRLVKWCKNIKISDPFEEGCRLGPVVSKSQYEKVLKFISTAKSEGATILCGGSRPEHLKKGYYVEPTIISDVSTSMQIWREEVFGPVLCQKTFGSEDEAIELANDTQYGLGAAVLSKDLDRCERITKALEVGAVWVNCSQPCFTQAPWGGTKRSGFGRELGEWGIENYLNIKQVTRDTSTDEPWGWYKSP

SEQ ID NO: 14970 - protein, 241 aa, Actinobacillus actinomycetemcomitans
MLKMKKISVPVLILSAVVSSGVLAESKTDAKFTDDSSYAVGVLFGSDLQGLINAQKGMIDYNNAKVIAGISDVLNGKVKLEGNKEIASTLQGINAKLKAENEKRVAVMVKKAEEEGKKFTAEFAKKDGVKKTASGLLYRVEKEGSGDAIKAADVVKVHYTGKLPDGTVFDSSRERGTPAEFPLNQVIKGWTEGLQLVKKGGQIELVIPADLGYGEDGAGDKIPPHSTLYFDIEVLDVTPAK

SEQ ID NO: 14971 - protein, 352 aa, Xanthomonas axonopodis pv. citri str. 306
MSTAHAYAAQAADQPLAPFVFERRAPGPNDVQIDIAYCGVCHSDLHTARNEWHNTLYPSVPGHEIVGRVTAVGNAVTGFKVGDLAGVGCMVDSCRSCASCQEGEEQYCEAGFTGTYNGPMFGGGENTYGGYSDHIVVDQKYVLRITHSDNLAAVAPLLCAGITTYSPLAHWKVGPGQKVGVVGLGGLGHMAVKIAKAMGATVVLFTTSESKRADALRLGASEVVISKDEAQMAAQYNTLDFILNTVAAPHNLDPFLNALKRDGAIVLVGVPEQSHPSPAVFNLVMKRRTLAGSLIGGIRQTQEMLDFCAKHNIVSDIETIRADQINEAYERMLKSDVKYRFVIDMATLDQAA

SEQ ID NO: 14972 - protein, 493 aa, Xanthomonas axonopodis pv. citri str. 306
MSRKQAFQFLDLPRTMPTRIPVELRTSGDWGELYGRFDKADAQYQAGRCLDCGNPYCSWKCPVHNAIPQWLQLVQEDRIIEAAALCHSTNPLPEVCGRVCPQDRLCEGSCTLEEFGAVTIGAVEKYIVDTAFKMGWRPDLGNVQASGHRVAVIGAGPAGLACADRLARAGIEAVVYDRYEQIGGLLQFGIPSFKLDKSVIGKRREILEGMGVQFRLGVEVGRDVSIEQLLGEYDAVFLGTGAYRYTDGGLPGQDLKNVLPALPFLVQNSRIVSGNDPHGRPIAGWEDQLALPDLTGKRVVVLGGGDTGMDCVRSAIRLGAAKVTCAYRRDEASMPGSAREVANAREEGVRFLFNRQPLSIESGADDEAIGVTVVETKLGEPDASGRRNAVPVEGSESLLEADVVIIAFGFSPTLPDWLASQGVDAGSNGRIVAPSDGNGRLPYQTTNPRLFAGGDCVRGADLVVTAVAEGRDAAGSIVQLLGVKAQVKEPAAA

SEQ ID NO: 14973 - protein, 274 aa, Xanthomonas axonopodis pv. citri str. 306
MSRRGIVWLASYPKSGNTWVRCLIASLRSGAAAMQLEELAPALPNAASRAWLERHLDVDIGDLTPDELHLLRGTAYRRCAMQASSVLKVHDRYDAALFPAVATLGIVYIVRDPRDVAPSWADHAGIDLDAAIGQLGQSATTVSSTLSRYRPQARQRFGSWSEHVASWLHAPGPRLLLRYEDLLDNPLRETARLAGFLGLSTQPVQIAQAVAACRFEALRDSEERHGFAERQHGQARFFRQGRAGAWRSALSAAQAARVRAQHGPTMAWLGYRDA

SEQ ID NO: 14974 - protein, 509 aa, Xanthomonas axonopodis pv. citri str. 306
MNALASAKSLNNDPHSIFKPRYDNFIGGQWVAPHSGQYFDNTTPINGKVFTSIARSTAPDIEAALDAAHAAKDAWGKTSTTERSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMELIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDAFMEKALSRVAAIKQGNPLDPNTMVGAQASSEQLEKILSYIDIGKQEGAEVLIGGERNTLDGDLAEGFYVKPTVFKGHNKMRVFQEEIFGPVVSVTTFKDEADALAIANDTLYGLGAGVWSRDASRLYRMGRAIQAGRVWTNCYHAYPAHAAFGGYKQSGIGRENHKMMLDHYQQTKNLLVSYSPKALGFF

SEQ ID NO: 14975 - protein, 1116 aa, Xanthomonas axonopodis pv. citri str. 306
MNAVASLQADAEQSAVVADQRWYKDAIIYQVHVKSFFDSNDDGIGDFPGLISKLDYIAELGVDTIWLLPFYPSPRRDDGYDIAEYMAVHPDYGSIEDFEHLVAHAHARGIRIVTELVINHTSDQHPWFQRARNAPAGSPERDFYVWSDTDQEYEGTRIIFCDTEKSNWTWDPVAGQYFWHRFYSHQPDLNFDNPAVLDAVLEVMRFWLDRGVDGLRLDAVPYLIERAGTSNENLPETHAILRKIRATLDAEYPDRMLLAEANMWPEDTQQYFGQNADECHMAFHFPLMPRMYMAIAREDRFPITDIMRQTPEIPESCQWAIFLRNHDELTLEMVTDSERDYLWQTYAADRRARINLGIRRRLAPLLERDRRRIELMTSLLLTMPGTPVLYYGDEIGMGDNIHLGDRDGVRTPMQWSIDRNGGFSRADPAQLVLPPVMDPLYGFQAVNVEAQIRDQHSLLTWTRRVLSVRKRYQAFGRGSLRFLYPGNRRMLAYLRCYQDETVLCVANLSHTLQAVELDLSEFEGRVPVDIIGGGSFPPIGRLTYLLTVPPFGFYAFQLVSEGTLPDWHVPSPVPLPDYRTLVLRSDADESAALLPHLPTLEGEILPAWLSARRWFSAKDQVLRSVRIARRTPLPGDEPMTLLELEVALEDGRHERYMLPVGIVWEREQPSTLAEQLALARVRQGREVGYLTDAFALKPMVRGVIDALRSHAALDFCDGDDAAQQGQVCFEATPALATLDIPQDPEIRWLSAEQSNSSLVVADKAVFKLLRHVAVGANPEIEIGRRLTEMGYANAAPLLGSVSRIGGQGTVTTIALLQGFIRNQGDAWRWTLDHLARSFDEYATAQTDEARAEAVAGYDAFAAVVGKRLAELHEALSRGTDDADFAPQRIDLPTANDVVAGVGRQVEEMWETVNARLAGSEDSAEREALEAVLAQRPQLDALLAKAPSVLADSLLTRVHGDFHLGQILVAFDDVVLIDFEGEPAKPLAERRAKASPLRDVAGFLRSLDYASEVSARGEEGTAARAGVGVDTHLDQFLVQFRRRSTQAFLDAYHAVLDASAHPWIAPAAFNAATLLFLVEKACYEVRYEAANRPGWLMVPIEGLRRILQRARAGAGDT

SEQ ID NO: 14976 - protein, 336 aa, Xanthomonas axonopodis pv. citri str. 306
MKAFQIGNQTGLESLVAVEMPEPVAGAGEVIVAPRLVGLINRDLQILKGTYGGKLAPTRVPVAEGVGIVTCVGAGVGQVVPGDRVVSGHFPTWLDGRFRAEMFAHDLGVTHDGWLAEKVSLPASALIKVPASLEDADVAALASAAVTAWHALVEVARIKAGDLVLCLGTGGVSMAALQLAKLHGARVAITSSSDDKLELARRLGADITVNYRTHPDWAEAVMQLSGGGADVVIETGGQDTLGQSIKAAAANATIVVVGVTPGAASPIPDYVALIRKNVTIRGIANGSRAMFVDLLRAIEQHRIKTLHSKTFRFDEAPQALDYFARAQHVGKVLIRL

SEQ ID NO: 14977 - protein, 437 aa, Xanthomonas axonopodis pv. citri str. 306
MRWPGFALAANGSTVRTEMLAGATTFLTMAYIVFVNPDILATTGMDHGAVFVATCLAAALGSLLMGVLANYPIGMAPGMGLNAFFAFGVVGTLGYSWQQTLGLVFVSGCLFLLLTVTGARRWLVDGIPTTLRSAIAAGIGLFLALIGLQKAGLVVAHPQTLLTLGDLHRPEPLLALAGLLLIGVLEVRRVRGAMLLGILAVTWAALALGLVRYEGVLALPPSLAPTVLQLDIVGALRGHGGGGALAAVLHVVLVFVLVEMFDATGTLMGVAQRAGLLHTPAQRRQFDRALLADSTVILAGALLGTSSTTAYVESAAGVQVGGRTGLTALVVAALFLLALLFSPLAAMVPAYATAPALIYLASVMLRECTQIQWDDVGDALPAAICMLAMPLTYSIATGLAFGFITYAALRLGSGRWRGVHPATWTIAGLFVLRYALE

SEQ ID NO: 14978 - protein, 365 aa, Xanthomonas axonopodis pv. citri str. 306
MSQLFSPIAFGPLALANRIVIAPMCQYSAQNGRASDWHRIHLGTLSQSGAGLLILEAAAVVPEGRISYADLGLYDDATEQALAEVLQSVRRWSPMPIGIQLAHAGRKASTDLPWKGGEAIAPDHAHGWQTVSASALPFRQGQPAPQTLDEAGIDAVVDAFVASATRAERLGLELIELHAAHGYLMHQFLSPLSNQRSDAYGGSLENRMRLTLRIFDAVRAAVSEKIAVGVRISATDWVEGGWDVQQSIALSQALDARGAHYIHVSSGGLDPRQQIPLQAGYQIPFAQEIRAQVNTPVIGVGLITEPAQAEAILQEGQADAIALARGILYDPRWPWHAAAALGASVTPAPQYLRCEPRDARGVFAN

SEQ ID NO: 14979 - protein, 436 aa, Xanthomonas axonopodis pv. citri str. 306
MRQHTASFGHFVLERMTPFQWRAVAVCVLLTMLDGFDVMAMAFTAPHVSADWQLSGKLLGMLFSAGLIGMALGALGLAPLADRIGRRALTLACLAILTIGMGMSALASTAWQLGALRLLTGLGIGGMLACVAVTAGEFSSPRWRNTAIVLQVTGYPVGATLGGMIAELLMQQWSWPAVFVLGAVASLLCVPLVLAFLPESLEFLIMRRPPDALARFNAVLARMGLPPHDALPPLPPQSATQPQGYSALFDVAMRRHTLLIALGFFSLMFAFYFVISWTPKLLVTAGSSATEGVTGGVLLNLGGICGGLLFSGLASCVRLSRLTVGSLLLMGLAMLASGLCSTQLSWALAVALLTGAAMFAAVGGMYAIVPIVFNAAVRSTALGWAIGVGRFGAILSPFCAGALLDAGWSPAMLYLACSVPLLFAVVAVLGMRLPNR

SEQ ID NO: 14980 - protein, 493 aa, Xanthomonas axonopodis pv. citri str. 306
MNALTSATAAATDTPAWHGCIFNGDWVPGRGGSLPIHEPATGALLHEVGKADLSDLAAAIAQAKQAQRAWSATPPRERAAVFHRAAQAMQARSAEAALLIARETGGILPKAQREVDESVVFYQQAAAMPLQASGQMLPTSAGQLSLARRLPLGVIGVISPFNFPLILSLRSVAPALAMGNAVILKPDPRTPYTGGVIIAQVLEQAGLPKGLLHVLHGDAQLGQALVESPDVPMIAFTGSTAAGRCIGEIAGRHLKKVSLELGGNNAVIVLDDADLDKAASAVAFGAYMHQGQICMATGRVLVHRSVAQALTQQLAEKARHLPVGDPVSGTVALGPIIDQRQLQRVVDIVNDSVAAGAVVEAGATHEGLFYAPTVLSNVRPGMRAFDEEVFGPVINITVFDTDDEAAELANQGEYGLAAGILSASVSRALALGEKLHTGLLHINDQTVADEVVNPFGGTGASGNGTSVGGPADWEQYTHWQWLTIKNEVPQYPF

SEQ ID NO: 14981 - protein, 273 aa, Xanthomonas axonopodis pv. citri str. 306
MSRQLVGELISEAVAMFIIIALGDSVAAMYILYDPSPYQNAYWGVCIAWGLAVTLAIYVTGSVSGTHANPAVTLALALFRGFSWKKVLPYWVAQVIGAFLGAAIVYQLYGPVIDHFNQLHQLTREAGGAAGVFFTAPGLAVTPMHALVDQIIITAFLIFGIFAITEQFNEAAPTANSGALMIGLLVATLGASMGYLEAWAMNPARDFGPRLFAYFAGWGEAALPAKDNYWWIPIVGPLIGGPIGALAYQWLILPFLPARVRHLQGGPKPLDPL

SEQ ID NO: 14982 - protein, 322 aa, Xanthomonas axonopodis pv. citri str. 306
MSFDPDVVRLFAQLQEAAQPPMDTLPIEGARAMMRAVGAQFGFQRLEMAEVRDLQADAATGAVPLRVYRPTGLATGPAPTCLYVHGGGGLVGDLESHDDVCRQLAARAGCQVLAIHYRLAPEHPAPAGVEDVIATLHWLVAHPDTVGADVQRLAVCGDSIGGAMAAVAALAARDAGIALRCQLLVYPLTDARQDSGLYPSRSLNAGLPPLTAAAVEFFNRHLLPDMAVANDWRVSPMLAPDVAGVAPALVVVCDRDMLYDEGRAYAERLRAAGVEVTLHSFPGMIHGFINMGSVLRAAGETLDLAALTLRQRLLPAIERRAA

SEQ ID NO: 14983 - protein, 223 aa, Xanthomonas axonopodis pv. citri str. 306
MQPTAIAPSILSADFARLGEEVNNVLKAGADWVHFDVMDNHYVPNLTIGPMVCQALRKHGITAPIDVHLMVEPVDRIVPDFANAGATTISFHPEASRHVHRTIQLIKSHGCQAGLVLNPATPVDILDWVLPELDLVLVMSVNPGFGGQAFIPSALDKLRAIRSKIDATGKPIRLEIDGGVKADNIGAIAAAGADTFVAGSAIFNAPDYAQVIAQMRAAVDAVR

SEQ ID NO: 14984 - protein, 205 aa, Xanthomonas axonopodis pv. citri str. 306
MIDPDGFRPNVGIVLMRQDGQVFWARRVRRDGWQFPQGGMNTDETPVEAMYRELREETGLLPEHVELLGATPGWLRYRLPSRAVRRNERQVCIGQKQVWFLLQFTGDESHLKLDHTDTPEFDHWRWVDFWYPVEHVVMFKRGVYARALRHLAPLAQSLAGPAAVGAMPERALEAWLPGSSAAGHDSPRKRPRKRNGARAMRINND

SEQ ID NO: 14985 - protein, 306 aa, Xanthomonas axonopodis pv. citri str. 306
MSTTVPMAQRSYYEADARERIDGLLDVGSLREFVGPRRRLISPHLAQLETPGAFDDGIVVGEGTLRGRNVLIAAQQGAFMGGGVGEVHGAKLTGLLERAATTQPAAVLLLLDTGGVRLHEANAGLIAISEIMRATLSARAAGVPVLALIGSGNGAFGGMGIVARCCSAVIMSEEGRLSLSGPDVIETVRGVEEFDARDRALVWRVTGGKHRYLLGEAQTLVADRIDAFADAALATLDALTEATGEAALQALERAQQQLAARIDAYGDCRDGLEIWTRQGIVDAQRLPLLDTEAFLAATADRSLPWT

SEQ ID NO: 14986 - protein, 460 aa, Xanthomonas axonopodis pv. citri str. 306
MPMSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAILCVLLLLGLNLVTVKLFGEMEFWFALIKIIAIAALIVTGAGLVVWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPKGFAKLSRAAIPARGLLFSCLCLLLGAMLVYLIPNLVTAFTLVTTLSAVLFMFVWSLILCAYIAYRRKRPEQHAASAFKMPGGVLMCYVCLAFFAFVIVLLTLQDDTRQALLASPVWFLLLAIGYAVKRRGNRQR

SEQ ID NO: 14987 - protein, 368 aa, Xanthomonas axonopodis pv. citri str. 306
MKTRAAVAWGPHQPLTIEEVDLQPPRPGEVLVRLVATGICQGDAHALAHGHAGSFPAILGQEGAGVVEDVGIGVTSVRPGDHVIPLYMPECGVCKFCRSGRTNLCQAIRSSQERGLMPDGSSRFSLHGRPILHHMGTSTFSEYTVLPEIAVARIHPEAPLEQACLLGCTVTTGVGAVLNSTHVRPGDCVAVFGLGGIGLSVIQGALLAQAGRIIAVDIDPAKFALARTLGATDCLDPRDYGAPIQQVIVDLTDGGADHSFECVGDVGAMRAALECCHKGWGESVILGMADDTQEISTRPFQLVTGRVWRGSAFGGVKGRSELPGYVERYLHGDIQLAPLITRTLALDDINQALTDLRAARGIKSIVAY

SEQ ID NO: 14988 - protein, 313 aa, Xanthomonas axonopodis pv. citri str. 306
MELGMVGLGRMGANMAERLVNGGHRVHGYDPGANARTSAQAKGIVTADALAALVSALPSPRVVWLMVPAGKIVDDTLAQLLPLLQAGDIVIDGGNSYYKDSQRRAALLQASGIAFVDCGTSGGIWGLQEGYSLMVGGDEAAVTGLHPILATLAPAPDKGWGRVGPSGAGHFTKMVHNGIEYGMMQAYAEGFALMQHKADFALDLHQVAEIWRDGSVVRSWLLDLTADALTHNPTMAGIAPFVADSGEGRWTVAEAIDLEVSAPVITLSLMERLRSRDKDSFTDKLLAAMRNQFGGHAVMTTTSAAPTIGSKDA

SEQ ID NO: 14989 - protein, 490 aa, Xanthomonas axonopodis pv. citri str. 306
MPRFPDQLLYIGGRYVPARGGHTLEVVNPATGEVLANVHNAGVDDLDAAVDSAKAGQQRWAALTTVERSRILLRAVALLRERNDALAQLETLNTGKPLSETRSVDVVTGADVLEYYAGVAQALQGAQVPLREGSFFYTRHEPLGVVGAIGAWNYPIQIALWKAAPALAAGNAMIFKPSEVTPLTALKLAEIFTEAGLPDGVFNVLPGDGASVGTALTEHPQIEKISFTGGTATGRKVMASASSSSLKEVTMELGGKSPLIVCADADLDVAADIAMMANFYSSGQVCTNGTRVFVPRALRHAFEARLLARVQRIHIGDPLDERTTFGPLASAAHMQRVLEHIEQGKAEGARLLCGGERLQDGALVQGYYVAPTIFSDCTDVMTIVREEIFGPVLSLLTYDDEDEAVTRANATTYGLAAGVVTPDLARAHRLIHRLEAGICWVNTWGESPAPMPVGGYKQSGVGRENGLATLQAYTRTKSVQIELERYASVF

SEQ ID NO: 14990 - protein, 369 aa, Xanthomonas axonopodis pv. citri str. 306
MKSRAAVAFGPGKPLEIVEIDVAPPKAGEVLVRITHTGVCHTDAFTLSGDDPEGIFPSVLGHEGGGIVEQVGEGVTSVKIGDHVIPLYTAECRKCKFCLSGKTNLCQAVRATQGKGLMPDGTTRFSYNGEPIYHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGAIDLDPFITHTMPLEEINEAFHLMHEGKSIRTVIHF

SEQ ID NO: 14991 - protein, 325 aa, Xanthomonas axonopodis pv. citri str. 306
MSDTTMTAIAIRDGKGDADALYATEQPRPRPAPGQVLIRVHAAGINRPDLLQRAGHYPPPPGAPETLGLEIAGEIVEPAGRWKVGDRVCALLGGGGYAQYAAVDARHVLPIPAGMDLVHAAALPETIFTAYANLFEHGRLAAGQWLLLHGATSGIGVTAIQMAKAAGAHVLATARSAVKAAQARELGADVAIDSTTASFVEVAKAHGGVDVALDMVGAAVFADTLEALNPHGRIVYIASQAGATIEVPIPVLMRKQAVITGSTLRPRSADEKARLAAEVERVVWPWIEQGKLRVLLDKRFPLREAAAAHRYLEQGSHLGKVVLEM

SEQ ID NO: 14992 - protein, 303 aa, Xanthomonas axonopodis pv. citri str. 306
MLVFTHPACLGHDAGPEHPESPARLEAVVQALRGAFPDLDWREAPLAKLGDLCRVHEREQVDAVLETAFDGYRQLDVDTRMVPASRAAALRAAGAGIAAVDAVMQDQTRTAFCAVRPPGHHATAQVSMGFCLFNNIAVAAAHARDRHGLERITIVDFDVHHGNGTQAIFERDPAVQYLSTHQSGLYPHSGSVYERGVGNIHNLLLPPGSDGLRFRNVWEDEMLPLVDAFRPQLILISAGFDAHLRDPLADLMLDDDDFAWLTGALRTLADRHARGRVVSMLEGGYDLQALAECSIAHVRVLLQ

SEQ ID NO: 14993 - protein, 492 aa, Xanthomonas axonopodis pv. citri str. 306
MAMPTDSIALHARLSPQQFAARDLVLSLEWTYAELDALVGRLAALLRRRGCVDGERLAVLARNSVWQVALHFACGRVGAIYVPLNWRLSASELDALLQRAEPRVLLGDDVAAARTDMDALADFIASADALEPADTPSIPPDRVSLILFTSGTSGQPKGVMLSEQNLQHAAHNFGVTTRVDARSSFLCEAPMFHIIGLVTKVRSALAVGGSIQVSNGFEPKRSLGWLADPSLGITHYVGVPQMMQAFRNQPGFDAAALRHLTALVSGGAPHASDDLLGWLDDGIPMVCGFGMSEAGTVFGMSVNCDVIRNKLGAAGIATPSVQTRVVDDKGNDCPAGVPGELLLRGPNLSPGYWRDPQASAEVLDGQGWFRTGDIVQRDADGFFWVVDRKKDMFISGGENVYPAEIEALLADHPDIRECAVVGLADPQWGEVGYLAIVPAAAAPDLEEIRNYLTTRLAKYKVPKHLRLVDALPRTATGKLQKARLRDTLASDT

SEQ ID NO: 14994 - protein, 489 aa, Xanthomonas axonopodis pv. citri str. 306
MEALSETLRGIAARGPLGLFIDGQWRASTGDRTVDVIAPHTEERLLRYTEPSPSDTEAAIAAARSAFDNGPWPQLSPQERSVVLKRVADHLRARMPELAEAWTGQVGATLGFSKRASQQAPDLFDYYADLIATHAFVQPRVRPSGGRVHVVQEPVGVVAAITPWNAPLVLLCYKVAAALAAGCTVVAKPSPETPIDAYILAECISAAGVPDGVFNLLPAGREVGEQLIRHPHVDKISFTGSTQAGRSIGIACAERLARVGLELGGKSAAIVLEDADLAKMLPTLVPYSMPIAGQVCFSLTRVLVPTQRREEILQAYCTALSAVKLGDPFAADTGMGPLALGRQLERVQSYIAKGKAEGARLVMGGSRPAHLSRGFFVEPTVFAEVMPDMAIAREEIFGPVVSFIDYHDEADLIAKANASDYGLHGTIYSEDAERAYRIARRVRSGSHAINGMWVDISMPFGGFKHSGIGREGGIEGLHAFLETRTLYLS

SEQ ID NO: 14995 - protein, 396 aa, Xanthomonas axonopodis pv. citri str. 306
MAKAKFERTKPHVNVGTIGHVDHGKTTLTAALTKIGAERFGGEFKAYDAIDAAPEEKARGITISTAHVEYESPTRHYAHVDCPGHADYVKNMITGAAQMDGAILVCSAADGPMPQTREHILLSRQVGVPHIVVFLNKADMVDDAELLELVEMEVRELLSKYDFPGDDTPIIHGSARLALDGDQSDIGVPAILKLVEALDSFIPEPTRDVDRPFLMPVEDVFSISGRGTVVTGRIERGIIKVGDEIEIVGIRDTQKTTVTGVEMFRKLLDQGQAGDNAGLLLRGTKRDDVERGQVLCKPGSIKPHTEFEAEVYVLSKDEGGRHTPFFKGYRPQFYFRTTDITGACQLPEGVEMVMPGDNVKMVVTLINPVAMDEGLRFAIREGGRTVGAGVVAKIIK

SEQ ID NO: 14996 - protein, 340 aa, Xanthomonas axonopodis pv. citri str. 306
MKAVALTRHLPIDDPESLLDVELPAPAAPSGYDLLVRVEAISVNPVDTKVRAPKPQPLQAPKVLGYDAAGVIEAVGPEVTAFAVGDEVYYAGDIGRPGSNAQYQLVDARIAGCKPTSLSFAQAAALPLTTLTAWELLFQRMPYSFDGARNRGRHLLIVGGAGGVGSIAIQLARHAGFTVIATASRPESIEWVRQMGAHHVIDHHQPLQPQLQALGLETVDAALNLADTDRYWQPLGEVLAPQGHVGLIVEPRGPLSIGDPYKSKCIGIHWELMFTRARYATEDMVEQHRILNRAASLIDAGELRTTHTETLSPINAQQLREAHRRLESGSTIGKLVLAGW

SEQ ID NO: 14997 - protein, 345 aa, Xanthomonas axonopodis pv. citri str. 306
MTMGIRIHRLRKQFETFTALDNIDLEVRQGELLALLGPSGSGKTTLLRIMAGLEHADGGQVLFGDEDATRMSVQSRRVGFVFQHYALFKHMDVFENIAFGLRVRRGNARWAEARIRARVEELLALVQLQGLEQRYPTQLSGGQRQRVALARALAIEPRVLLLDEPFGALDAQVRRDLRRWLRELHERTGLTTVFVTHDQEEALELADRVAILNRGRIEQLDTPAMIYDKPASPFVYSFVGAVNRIPGVLAQGQIQVAGHALPLANAALAAGPVEVYVRPEDLVPDQAGWPATVAWSQRSGSRLRLRATLEPSGNEVEVELPASAGSFQPGQQVRLAARQYGIFPA

SEQ ID NO: 14998 - protein, 299 aa, Xanthomonas axonopodis pv. citri str. 306
MEFKDYYATLGVEPSAGDAEIKTAYRRLARKYHPDVSKEAGAEDKFKAINEAYEALRDPAKRKAYDQLKAQGFRPGDEFQAPPNYGGGQGFDFEEVFGNGGAGGGFSDFFESLFAGQRGGRPRGPGAGPGAGAGPQARGDTRAKLAVPLEAVYSGDSVRITINGKQLDVRVPKGVQPGQVIRLSGQGNGGGNLLLEIEYAAHPHFEVDGRNILYTLQVMPWQAALGTTISVPTLGGSVELKVPADSDAGRKLRLRGRGLPGTTPGDQIVELEILAPAPTDDAQKKAYRNLAKAFGETVS

SEQ ID NO: 14999 - protein, 289 aa, Xanthomonas axonopodis pv. citri str. 306
MAAARLRTLTAAALRAMPLPSPGGDKEQRGRVLVVGGSMRVPGAALLAGEAALRAGAGKLQIATAASVAPAMALAVPEALVLGLGQNGQGEITRGHRALDAALAACDAAVIGPGMASTTTATALVKLAAAKAVCPLVLDAGALSRSLRAPPGRPFVLTPHAGEMATLAGDDKAAVEAAPGEYALAFAQKMRSVVIVKGADSFIAGPDGALWVHRGGVPGLGTSGSGDTLAGLIAGFAARGSDALTAALWGVFVHAVAGKQLSRRIGTVGFLAREIPQEVPGILDRLSRK

SEQ ID NO: 15000 - protein, 463 aa, Xanthomonas axonopodis pv. citri str. 306
MAKAKTAYVCGECGAEYTKWQGQCTECGVWNTLSEIVLESATPGGKTSPAASRRSGWAGKAEAPKITALKDVQQSEQARVSTGIGEFDRVLGGGLVEGAVVLIGGDPGIGKSTLLLQALASMASTLPVLYVTGEESLAQVAGRAVRLDLPLEGLNALAETGIENILQHASVARPKLIVADSVQTLWTESLTAAPGSVSQVRESAARLVRYAKETGTAVFLVGHVTKEGGIAGPRVLEHMVDAVLYFEGESGSRFRLLRAFKNRFGAVNELGVFAMGEKGLKEVSNPSAIFLSGGSTQQPGSCVMVTREGTRPLMVEVQALVDASPLSNPRRVAVGLEQNRLAMLLAVLHRHGGIVVGDQDVFVNVVGGIRVQETAADLPVLLAVLSSLRDRPLSEKTIAFGEVGLSGEIRPVPNGEDRLKEAATHGFKRAIVPRANAPKTTSIKGMEIIAVERLSQALEAAAD

SEQ ID NO: 15001 - protein, 295 aa, Xanthomonas axonopodis pv. citri str. 306
MSKIAFIGLGNMGGPMAANLIKAGHQLRVFDLAPAALDAASAAGAHAASSVQDTLVDVEVVISMLPASRHVEGLYLGESGILAQIPDGALVIDCSTIAPLSARKVADAAKARGLTMLDAPVSGGTAGAAAGTLTFIVGGAADALERARPVLQAMGKNIFHVGDNGAGQVAKLCNNMALGVIMAATGEALALGVAQGLDPAVLSQMMAVSTGRSWATEVCNPWPGVLPNAPASRGYSGGFGNDLMLKDLGLVAESAVQAGVSIPLGELARNLYAMNSQAGNGALDFSSVVKLFAKL

SEQ ID NO: 15002 - protein, 366 aa, Xanthomonas axonopodis pv. citri str. 306
MLMSKSTQSPLFSPVRLGALDLANRVIMAPLTRNRAVAGQVPSPLAAEYYGQRATAGLIVAEGTQISPLGQGYLDTPGIHTRQQIEGWRAVTDEVHRRGGKIVLQLWHVGRVSHTSVLPPGEVPVAPSAIRAEGKTFTPNGFEDVSEPRALALDEIPGLIEDYRIAARNAIDAGFDGVEVHAANGYLLDQFLRDSSNKRTDAYGGDIENRTRLLAEVVQAIADEIGAERTGVRLSPVTPVYGAHDSDPQPLFERAVERLNLIGGLAFVHVIEGATGGPRDNIAFDYAALRAKFDGAWIANNGYDRGMSEHAISSGYADAIAYGRPFIANPDLVRRLRENAPLAELDQATMYGGGAKGYTDYPALPE

SEQ ID NO: 15003 - protein, 465 aa, Xanthomonas axonopodis pv. citri str. 306
MPEPSSATAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSLAWPWCLLFCALIFGLNTVSARWFAEGEFWFSLIKVITILVFIVLGGAAVIGLLPLADGSPAPGLRHLRANGWFAHGTLPILMTMVAVNFAFSGTELIGVAAGETAQPARAIPLAIRTTLVRLVVLFVGTVLVLAALLPARRAAVETSPFVRAFELLGIPYAADILNAVILTAILSAANSGLYAAARMLWSLANEGTLPSGLARLTGRGIPLRAVSLSMLGGLLALLTGVYAPETVFVAISAVSGFAVVVVWLSICAAHYRFRRQWLRDGAALETLAYRAPWYPWTPILGFSLCLLACIGLAFDPQQRIALWCGIPFVALCYGAYALTQWLAARRLYA

SEQ ID NO: 15004 - protein, 161 aa, Xanthomonas axonopodis pv. citri str. 306
MSDISTFAFTDLEGRTQSMRDYAGNVLLVVNVASKCGFTPQYAGLQALWQRYRERGLVVIGFPCDQFGHQEPGDAAQIRQFCSLDYAVDFPLAAKIDVNGNGAHPLWQWLKHEQRGVLGSEAIKWNFTKFLIGRDGRVLERYAPTTKPEALATEIERALDA

SEQ ID NO: 15005 - protein, 391 aa, Xanthomonas axonopodis pv. citri str. 306
MEANMPVHPDDLFDVRALLTDEERAVQDAVARFTDTRVVPAIGDAFDAGRFPREWIPELAELGLLGASLPVRDGGAGLGAVSYGLICQELERGDSGLRSFVSVQSSLCMYPIHAYGSDEQRQRWLPEMAAGRVIGCFGLSEAQGGSDPAAMTTRAVREGEGWRLNGAKMWITNGSIAGLAIIWAQTDDGVRGFLVQTDSAGFSAHDISHKMSLRASVTSGLFLDNVFVPEQMRLPQAAGLKAPLSCLNQARYGIAWGAIGAAVACLREALAYAGERILFGRPLAATQSAQIKLADMARRISTAQLLALQLGRLKEAGTLQPEQVSLAKWNNCRMALDVARECRDLLGAAGITTEHVAIRHALNLESVITYEGTETVHQLVVGRALTGLNAF

SEQ ID NO: 15006 - protein, 375 aa, Xanthomonas axonopodis pv. citri str. 306
MSKRDYYEVLGVARGASDEELKKAYRRCAMKHHPDRNPGDAAAEAAFKECKEAYEVLSDGNKRRAYDAHGHAAFEHGMGGGGGPGGPDMGDIFGDIFGNIFGGGAAGPRAARRGADVGYVLELDLEEAVAGIERRIEIPTLIECAPCHGSGSEDGKVETCGTCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLQQFEATFTGEDARKHSPKSATFIDGVKGFWDRMTS

SEQ ID NO: 15007 - protein, 478 aa, Xanthomonas axonopodis pv. citri str. 306
MSEQFDVVVIGAGPAGYHAAIRAAQLGMKVACIDAALGKDGKPALGGTCLRVGCIPSKALLDSSRQFWNMGHLFGDHGISFNDAKMDVPTMIGRKDKIVKQFTGGIAMLFKANKITPYYGFGQLQPGNIVKVTQHEGGEIELKGTNVILAAGSESIELPFAKFDGDTIVDNVGGLDFTAVPKRLAVIGAGVIGLELGSVWKRLGAEVTILEALPDFLALADAEVAKTALKEFKKQGLDIKLGAKVGKTEITGSDDAKQVVLSYTDATGEQTLTVDKLLVAVGRKAATKNLLADGTGVKVTDRGQIEVDGHCHTGVDGVWAIGDCVRGPMLAHKGFEEGIAVAELIAGLPGHVNFDTIPWVIYTEPEIAWVGKTEQQLKAEGVAYKAGSFPFAAIGRAVAMGEPAGFVKVIADAETDRVLGMHLVGVGVSELVHEGVLTMEFSGSADDLARICHAHPTLSEAIHDAAMAVSKRAIHKAN

SEQ ID NO: 15008 - protein, 185 aa, Xanthomonas axonopodis pv. citri str. 306
MLLNRLLALVLTGFFATPAFAAGTPVLDVEYRPLAGKTPINLNRTYGGKVVMVVNTASKCGFTPQYEGLEALNHRFGSRGFTVLGFPSNDFQGQEPGSEKQIQEFCTLTYGVKFPMFEKVHVLGAEATPLYQRLTQATGVAPGWNFHKYLIGRDGRVVAQFPSKIKPDDPSVLAAIERELKAPAR

SEQ ID NO: 15009 - protein, 352 aa, Xanthomonas axonopodis pv. citri str. 306
MLPVHRVLRYLGLAVARRTGGGTRMSASKHQVVCFGEALIDMLALPQARPDEARTFAQYAGGAPANVAVAVARLGGAAHFVGMLGRDMFGDFLLQSLQQSGVATDGIVRTDQAKTALAFVALDDAGERSFSFYRPPAADLLFRPEHFAADGFTQAAVLHVCSNSMTEPEIAQCTLDGMRRARADGAIVSLDLNLRPMLWPQDVEPAPLLWEALALADVVKLSREELEYLAGTLDSDASAVTQKLWQGRASWLLVTDGGGPVHWQTRTDSGQVPAFQVQVRDSTAAGDAFVGGLLYQLATRAASLEQLCGDPAVINEVIRFAAAVGALAVTRKGAFAAMPSIDEVHSLIQEQS

SEQ ID NO: 15010 - protein, 402 aa, Xanthomonas axonopodis pv. citri str. 306
MAPKSNKPTAATGGNKKPTKTATSASAGKPANTPAEKAAIKTAAPVLADVRAKIDEIDRNIQALIAERANFAHQVGKAKGKLAAAVDYYRPEREAQVLRMVVDRNEGPLSDEVLVHVYREIMSACLAQQEPLKIGYLGPEGTFSQQAVLKHFGRSAVGLPMATIEEVFQEVEAGNADFGVVPVENSGQGTIQVTLDMFLTSNLKICGEVELRVHQYLLSRNGRLEDIERIYAHSQSFAQTAGWLRSHLPKVEKIAVSSNAEGARRARNAEDAAAIGGESAAHVYGLKKVIMKSIEDDDDNTTRFLVIGRQIFPSSGHDRTSVLVFIHDKPGALFDVLSPFARHGISMNRIESRPSHQAKWEYGFFIDLIGHVEDDAMKQALAELKAHSAQIKVLGSYPVAIP

SEQ ID NO: 15011 - protein, 430 aa, Xanthomonas axonopodis pv. citri str. 306 [sequence omitted]

SEQ ID NO: 15012 - protein, 475 aa, Xanthomonas axonopodis pv. citri str. 306
MSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSAFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 15013 - protein, 504 aa, Xanthomonas axonopodis pv. citri str. 306
MTQTNGFDALHAHAQRLRGAAIPALLAAEPERPTQYARQVGPLYFNFARQKYDRAALDALFAIARERDLSGAFQRLFRGEQVNVTEQRAALHTALRGDLTDAPVASEAYATAEEVRQRMGSLIQQLEATDVTDIVSVGIGGSDLGPRLVADALRAPSGARFRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLEGAAQFDAHVLNTPLEENVAVLHGLTAVWNRNLLGSATHAVMTYDQRLALLPAYLQQLVMESLGKRVKLDGSAVDSDTVSVWWGGAGTDVQHSFFQALHQGTSVVPADFIGTVHNDDPYAENHTALMANVLAQTEALANGQDSSDPHRSYPGGRPSTVILLDALTPQALGALISMYEHSVYVQSVMWGINAFDQFGVELGKQLASQLLPALKGESVDVADPVTRELLNKLRG

SEQ ID NO: 15014 - protein, 206 aa, Xanthomonas axonopodis pv. citri str. 306
MGSNEVATGDPLATLDWNKGEGLLPVIVQDADNLRVLMLGYMNAQALAVTQQRGEVTFFSRSKQRLWTKGESSGNVLRVVSIQTDCDADTLLVQARPHGPTCHLGRTSCFPSAPGQFLGSLDALVAERERERPHGSYTTKLFEQGIRRIAQKVGEEGVETALAGVVQDDDALLGESADLLYHLIVLLRARGLGLGDAAALLESRHQ

SEQ ID NO: 15015 - protein, 493 aa, Xanthomonas axonopodis pv. citri str. 306
MYRMLKSLLRVKPIEPAGHVDAGEPVEGSLQGEATLQRTLTAKHLIMLGIGAVIGAGIFVLTGQAAANHAGPAVMLSFVFAGIACAFAGLCYAEFAAMMPVSGSAYSYSYATLGEGIAWFIGWCLVLEYLFAGSSVAVGWSAYLISFITGTLGLPFPAELAGAPLAWDGHGFVSSGNLVNLPAVLIVAAVSILCYVGVTQSAFANAIVVAIKVVVICLFVGFGIAYIDPANWHPFIPENTGPGQFGWDGVFRAASIVFFSYIGFDAVSTSAGETKDPQKNMPIGILVSLAICTIIYIIVCAVLTGLLPYTQLGTAKPVATALEAHPQLTWLKTAVEIGAIAGLSSVVLVMLMAQPRIFYTMAKDGLMPKLFGKVHPKFRTPYVGTLFVGVVAALLAGVIPLNVLGELVSMGTLLAFATVCAGVLVLRFTKPDLARPFRVPLAMVICPLGALACLFLFFQAFQEHWKVFVGWTVIGLAIYFGYGIHHSRLAKRA

SEQ ID NO: 15016 - protein, 485 aa, Xanthomonas axonopodis pv. citri str. 306
MLRIQAEALTYDDVSLVPAHSMVLPKDVSLETRLTRDLRLKLPILSAAMDTVTEHRLAVAMAQLGGIGIIHKNLTPQQQAGEVARVKKFESGVITEPFTVSPDTTIGEVLALTRARNISGVPVVDGSELVGIVTSRDMRFEKKLDDPVRHIMTKKDRLITVREGASDEEVLELLHRNRIEKVLVVNDSFELRGLITVKDIQKKTDNPNAAKDSAKRLLVGAAVGVGGDTEQRIELLAAAGVDVVIVDTAHGHSQGVIDRVAWVKKTYPQLQVIGGNIVTGDAALALMDAGADAVKVGVGPGSICTTRVVAGVGVPQITAVDMVAEALQDRIPLIADGGIRYSGDIGKALVAGASTVMVGGLLAGTEEAPGEVELFQGRSYKSYRGMGSLGAMEKGSKDRYFQDASDADKLVPEGIEGRVPYRGPVGGIIHQLIGGLRATMGYVGCATIEEMRSKPKFVKITGAGQRESHVHDVQITKEPPNYRAG

SEQ ID NO: 15017 - protein, 495 aa, Xanthomonas axonopodis pv. citri str. 306
MYAPLALYDTAAARTLDAQATTLLGGDGYTLMQRAGQAAWQWSLERWPQARRLVVVCGTGNNGGDGYVLARLAHRAGRQVRVVHLPEHGPGSDLAQRACTDYLAVGGAIELFPYPLGQADVIVDALFGIGLNRAPDDATAALIDAINAAGVPVFALDVPSGIDADHGVAFGAAVRAARTLQFIVPHLGLYTGDALEHAGEREVASLEVPVSAFDGLTPVAHSWNSDALAAQLRPRRRNTHKGESGRVLCVGGNLGSGGAIMLTAEAALRSGAGLVQVATRAEHVTPLLARCPEAMARAVQADDDIATLAEAADAVALGPGLGQDDWAQALWRAALGAATAVVLDADGLNLLAANDVPVHGPRVLTPHPGEAGRLLGLSTRQIQRDRPAAAAALATRYDAVVVLKGAGTVVASPSNLPRIIDAGNPGMAVGGMGDLLTGVIAALLAQGFSPFDAASLGALLHACAGDAAAHAGERGLLPTDLLPELRRLANAGAIA

SEQ ID NO: 15018 - protein, 455 aa, Xanthomonas axonopodis pv. citri str. 306
MDPSVLKALQQLDAAHHLHPFNDNAALAQKGTRILTRGEGVYVWDADGNQLLDAFGGLWCVNVGYGRKELAQAAARQMEQLAYYNSFFQCTTEPTIQLAAKLAELAPGDLNHAFFANSGSEANDTILRLVRHFWAVQGQPQKRIFIGRHDGYHGTTMAGASLGGMRGMHQQGGLPIADIHHVAPPYHFGDGGEMDPEEYGLLAARRLEDKILELGPDNVAAFIGEPIMGATGVYIPPRSYWPEIERICRRYDVLLVADEVICGFGRTGEWFGAEYFGFQPDVMTLAKGITSGYIPLAAAMFNDRVAGVLKTQGGELAHGGTYAGHPVCAAVALENLRLLQDEGIVETARTQVAPYLAQRWAALGEHRLVGEARIAGLVGALELVPDKQRRGAYFPRRGRVGAMCRDFALRRGLILRATYDAMLLSPPLIITPAQVDELFDKAWAALDDTAQALGR

SEQ ID NO: 15019 - protein, 459 aa, Xanthomonas axonopodis pv. citri str. 306
MASETSVASLPAADAHTLSRIAGCESVDLLLPDTNGVLRGKRVTADALSKVYRDGVCLPMSLIATDITGNTVEETGLGYAIGDADRICRPIEGSLRLVPWAPRPMAQLLLAMHTPEGGLFEVAPRAVLQRVLQGFGALGLTPVIAVELEFYLFDAVADAQGRPQTPRDPITGERSDSTQVYSLQDLDDQRGFTDAVTVACRQQGIPADTAVAEYAPGQFEINLQHRADAVAACDEAVLLKRTIKAIAQQRGKLASFMAKPFPGQAGSGLHVHVSLLDAAGHNVLASAADAPAQSLRHAIAGLQRHADASLLMFAPHANSYRRFVSNAFVPLDASWGFNNRTVALRIPHSDAHNTRIEHRIAGADANPYLAAAAVLAAMLDGLRQPAEPTAPVTGNAYAQSVFAPRSWQGAVDAFLGSDFIGEQFGTQFQHVFGQQKQRELLDYQAQVPDLDYARYLRTV

SEQ ID NO: 15020 - protein, 450 aa, Xanthomonas axonopodis pv. citri str. 306
MPDHLPSDAADALQAPTQLDAFWMPFTANRQFKARPRLLASAQGMYYRDVQGRQILDGTAGLWCCNAGHSRERIVAAIRDQAGTLDFAPTFQMGSPLPFVLAQRLAAIAPPGLGHVFFTNSGSEAVDSAMKIVLAYHRLRGEGQRTRFIGREKAYHGVGFGGMSIGGLPNNRKWFGPLLAGTDHLPHTLDLQHNAYARGLPVHGAELADDLERLITLHDASTIAAVFVEPVSGSAGVILPPEGYLQRLRAICDRHGIVLVFDEVITGFGRVGDAFAAQRFGVIPDIITAAKGLTSGTVPMGAVLVADAIHDAFMHGPQNAIELFHGYTYSGHPLACAAAIATLDTYAEEELFTRAITLGPQWEDALHGLRGSPHVIDIRNIGLIGAIELAPRDGAPGARGYDVFERCFHEGGLLVRVTGDVIALSPPLIVTPEQIGQMVETLGKILRQVD

SEQ ID NO: 15021 - protein, 251 aa, Xanthomonas axonopodis pv. citri str. 306
MRRKIVAGNWKLHGSRAFATELVAKVAAHMPLEGVEVVILPPLPYLGDLIEDFEAHHLSFGAQDVSSNEKGAYTGEVSASMLVDVGAGYGLVGHSERRQYHQESSELVARKFAAALHAGLIPVLCVGESLEQREAGQTEAILRAQLDPVLALVGSAGFAGAVLAYEPIWAIGTGRTATPEQAQAVHAFLRGEVAKADARIADSLPILYGGSVKPDNAGELFAQPDVDGGLVGGASLVAEDFLAIARAAAAC

SEQ ID NO: 15022 - protein, 268 aa, Xanthomonas axonopodis pv. citri str. 306
MRRIDSCFAELRANGRKALIPFITAGDPSLEATVPVMHALVRAGADVIELGVPFSDPMADGPTIQRSSERALARGAGLAYVLEAVHEFRREDATTPVVLMGYLNPIEIHGTRRFAEAAVAAGVDGVLLVDLPPEEAGETRTIFTEVGLALIALASPTTSEQRLDMLCSTAQGYLYYVSFAGVTGASNLLDTHAASDRLRQLRRRAGAPVVAGFGIKDAASAAAMAVDADGVVVGSALVAALAEVNDVRSARERAEAFLAPLRQALDQG

SEQ ID NO: 15023 - protein, 357 aa, Xanthomonas axonopodis pv. citri str. 306
MSDGRRARVWVSQPLFDDVVAQLGEHFELTTTQRVSAYSPAELAAQLAPLDGALITLNERIGAAEIAAAPQLRAIANVGVGYNNLDLDALSAAGILASNTPDVLTETTADLGFALLMATARRITESERWLRDGQWGQWSFKTMLGADIHGSTLGILGMGRIGQGIARRGAHGFGMRVLYHNRSQLPAATEQALGARYVDFDTLLAQSDHLVLVLPYTKDSHHIVDAAALGKMRATATLVNIARGGIVDELALADALANGRLAGAGLDVYEGEPRVRPELLALNNVVLTPHIGSASLATRRAMVQLAVDNLIAALGKGPRAGHPPSALNAAAVAAAKRGGTGADAKKAGVTGTISTKR

SEQ ID NO: 15024 - protein, 456 aa, Xanthomonas axonopodis pv. citri str. 306
MSARYDYDVVILGGGSGGLAAGFRAAKHGARVAIMEPDELGGTCVNLGCVPKKAMWLAADLAGKIELASALGFDVPRPTLVWQELVTHRQGYIANIHASYRRRLNEDGVVLIPQRGVLQDRHTVMGSDGVPVTAGHIVIATGAHALRPDVEGAEHGEVSDDFFNLCHAPEQVAIIGGGYIAVEIAGLLQALGSRVHLFVQGERLLERFDAELTLQLADNLRHLGVRLHFGFTTTALERDMHGALRVHGHSVHPREQGNDVFDKVFFAVGRRANTAGLGLDTVGVALGDKGEVVVDDRQTTNVPNIHAIGDVGGKVGLTPVAIAAGRKLMDRLFGHQPDARMDYENVPSVVFSHPPLGNVGLTEEQARARYNGAVRVYRSNFRPMLHALADAPQRSLFKLVCVGEEERVVGVHLLGESADEMLQGFAVAVKMGATKRDFDETVAIHPTSSEEIVLMH

SEQ ID NO: 15025 - protein, 166 aa, Xanthomonas axonopodis pv. citri str. 306
MTWTTPDLCDRYPDAMIAEPLFRHFGGRTAFAGPLATVRCFEDNSRVRELAATPGDGRVLVVDGQGSLKHALLGDQIAANAVANGWAGVLIHGCVRDVEILATLPLGVLALAACPRRTERRDLGDVDVPVNFAGVPFVPGHWLYADANGVLVAPQPLALDGAGGSI

SEQ ID NO: 15026 - protein, 249 aa, Xanthomonas axonopodis pv. citri str. 306
MTRKLVLLRHGQSQWNLDNRFTGWVDVELTDQGRQEAVAAGRLMKDEGLQFDVAHTSVLKRAIHTLQGALKELDQDWLPVSKSWRLNERHYGGLQGLDKAETAAKHGEEQVKIWRRSYDIPPPAMDVNDPGHPCHDRRYATLDRNALPGTESLATTLVRVLPYWHDAIAPQLKAGQTVLVTAHGNSLRALYKYLNDVSNEQILELNIPTGIPLLFELDDSLQVRSFRYLGDPEAAKRAAEAVANQGKAK

SEQ ID NO: 15027 - protein, 335 aa, Xanthomonas axonopodis pv. citri str. 306
MQAIRLRHPAAIASLQSVALPDPGQPARGQIRVRLHASSLNFHDLGVVLGQMPTADGRIPMSDGAGVVEAVGPEVDEFAVGDQVVSTFFPQWLDGEPLHAGFATTPGDGVDGYARSAVVADARAFTHAPRGYSHAEAATLTTAGVTAWRALAVNGGLKAGDSVLVLGTGGVSIFALQLAKAMGARVIATSSSDEKLEKVRALGADHVINYRQHPEWSAQVLDITEGRGVDHVVEVGGPGTLTQSIRAARVGGHIALIGVLTGAGGPVPTAEMMGRQQRLQGLVVGSRKHQQDLVRALDSLPLRPVIDRSFALDEIGEAFALQKSGGHLGKIALEF

SEQ ID NO: 15028 - protein, 462 aa, Xanthomonas axonopodis pv. citri str. 306
MPLPTDSVAETAAPAAPALRHALKPRQLMMMGLGTAIGAGLFLGSGVGIHAAGPAVLISYLIAGALVIIVMNALGEMAAAKPASGAFSVYAADAMGPTAGATVGWLWWFQIVVVIAAEAVGAAGLLATVWPALPVPLLSLLFMATFTAINLLGVRNFGEFEFWFAILKVLAIVVFLLIGVALLAGWLPGVASPGLSNFTQNGGFAPKGLAGIGSALLVVVFAFGGTEIVAVAAAETADPGRSLARTIRTVAWRILVFYIGSISVIVAVVPWTSAALSSPFAAVLEVARIPGAATAITLVAVVALLSALNANLYGASRMIFSLAQRGEAPRLLARTSGEQVPLVAVIASVLFGFAAAALELLYPNKVLPMLLNIVGATCLLVWTISLVSQLILRARADRAGLALPFRMRGYPFLTVLALVILAVIFVLLASSADTRAQFLSMVALTAVIAAVSEIARRVRARM

SEQ ID NO: 15029 - protein, 472 aa, Xanthomonas axonopodis pv. citri str. 306
MHRHVHEPEILADPAAAQTAEHWRQRDLAVVWHPCTQMREHPHTLPLVPIVGGEGAWLVGHDGRRYLDAVSSWWTNLFGHTEPRIGAAIARQAGELEQVMLAGFTHTPAVQLAEQLLAIAPRQAGRAPLSKVFYADNGSAGVEVALKMAFHYFHNRGDHRRTRFIALENGYHGETIGALSVGDIPLYRRVYAPLLLEAMFTPSPDAYLAEPGQSAEDHALQAADALQALFEHSPGEICALILEPRVQCAGGMRMYHPAYLRRARELCDAHGAFLIADEIATGFGRTGTLFACEQAGVMPDLLCLSKGLTGGFLPLSAVLATQQLYDAFLDDSRERAFLHSHSYTGNPLACAAALATLKIFADDDVIARNQPIAARMRALAAQIGEHPSVADVRQAGMIVAFELTQGGNKRTPFASAARVGLKAYRAALEKGVVLRPLGDVLYWMPPYCVDEAQLALLADTTRHAITEAVACA

SEQ ID NO: 15030 - protein, 319 aa, Xanthomonas axonopodis pv. citri str. 306
MALYDNILDTIGRTPVVKLQRLAPDNVTLYVKVESFNPGGSVKDRLALAIILDAEQRGLLKPGDTIVEATSGNTGVALAMVAAARGYKFVATMVETFSIERRKLMRAYGAKVILTPAAERGSGMVRKAKELAEQHGWFLASQFANPANPAYHRNTTAAEILRDFAGHRLDHFVTGWGTGGTLTGVGEVLSVARPEVRITASEPAGAALLQGQDWKPHKIQGWTPDFIPEVLNREVAHEVLSVEDTDAITVARRLAAEEGIFTGISGGATVATALRVAEGAVPGAVILAMLPDTGERYFSTPLFADINEGSDDDWLAGLP

SEQ ID NO: 15031 - protein, 334 aa, Xanthomonas axonopodis pv. citri str. 306
MSIEQLAETAQAMVAPGKGIIAIDESTSTIAKRFASVGIENIEENRRAYRELLLTTPKLSDYISGAILFDETIRQKTKDGVPFAEYMTAHGIIPGIKVDKGAQPLAGMPGELVTEGLDGLRARLEEYYTLGARFAKWRAVINIGEDIPSGTCIEANSHALARYAALCQEQGLVPMVEPEVIMDGSHDIETCYEVTEATLRSLFGALYEQNVVLEGTILKASMVISGKSCEEQASIEEVAESTVMCLKSTVPAILPGIVFLSGGQTDEQSTAHLNEMHQLGNLPWPLSFSYGRAMQQAALKLWAKDMTGNFAKAQQVIYERAKENGLAALGKWKG

SEQ ID NO: 15032 - protein, 501 aa, Xanthomonas axonopodis pv. citri str. 306
MCVKFRGFYREAIMKERQRRTKILATLGPATDAPGVLDTLFKAGVNVVRLNFSHGDPSGQAKRAAEVRAAAARVGAEVGILADLPGPKIRIERFAEGKIKLTMGDRFDLVADANAPAGDQTQVGVSYLGLPQDVTAGDVLLLDDGLMQLQVTDVQGARIVTKVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRFLSRFRSNMPIYAFTRHDGARRQMAMMRGVFPISFDSRGLTPREAARAAIRLLVENERMGPGDRVVFTSGEHMETHGATNTLRLLEVGEDGRATGLGEL

SEQ ID NO: 15033 - protein, 391 aa, Xanthomonas axonopodis pv. citri str. 306
MSIVRMTDLDLSGKRVLIRQDLNVPIDNGQITSEQRITASVPTIKLALEKGAAVMVTSHLGRPKEGSWTEEDSLAPVATRLAALLGVDVPLVRDWVDGVEVAPGQVVLLENCRMNVGEGKDDETLARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHAVGKSLNEPDLIPTANRIVADAKARGAEIPLPTDVVVAKQFLPDAQASVKSLDAVDADDLILDIGPQTAQRYAELIASAGTVVWNGPVGVFEFESFSHGTETLARAIASSKAFSIAGGGDTLAAVDKYDIAQDVTYISTGGGAFLEFLEGKTLPAVAALQARGQ

SEQ ID NO: 15034 - protein, 429 aa, Xanthomonas axonopodis pv. citri str. 306
MNHSRSHALFAQAQTLLPGGVNSPVRAFKSVGGEPFFVARADGPYLFDVDDNRYIDYVGSWGPMIAGHNHPAVREAVEQSIRNGLSFGAPCAAEVAMAQTITRLVPSCEMVRMVNSGTEATLSAVRLARGATGRNRIIKFEGCYHGHGDSFLVKAGSGMLTLGVPTSPGVPAGLSELTATLSFNDFEGATALFDEIGAEVAAVIIEPVVGNANCIPPQAGYLQHLRTLCTRHGALLIFDEVMTGFRVALGGAQAHYGVTPDLTTFGKIIGGGMPVGAYGGRRDLMEQVAPAGPIYQAGTLSGNPVAMAAGLAMLELVQEPGFHTRLSEATSMLCEGLEDAARAAGIAVTTNQVGGMFGLFFTDDIVESYAQATACDITTFNRFFHAMLQQGVYLAPSAYEAGFMSSAHDEAVIDATLAAAREAFAEVAR

SEQ ID NO: 15035 - protein, 408 aa, Xanthomonas axonopodis pv. citri str. 306
MSTAADSPLSLAHYYLPVYRPRQVVLERGQGSRVWDDAGREYLDLSSGIAVSGLGHNDPDLVAALTEQAGKLWHTSNVFFSAPPLKLAEELVSASRFAHKVFLCNSGTEANEAAIKLVRKWASSQGRPADKRVIVTFRGSFHGRTLASVTATAQPKYQEGYEPLPGGFRYVDFNDVAALEAAMAGGDVAAVMVEPIQGEGGVMPAAPGFLSRVRALCDQHDALLVLDEIQCGMGRTGTLFAHWQEQVTPDIVTLAKALGGGFPIGAMLAGPKVAQTMQFGAHGTTFGGNPLAAAVARVALRKLASPQIADNVVRQSAALRAGLEALNAEFGLFAQIRGRGLMLGAVLAPEHAGQAGAILDLAAKHGLLLLQAGPDVLRFVPALNLTDAELADGLARLRLATAEYVAQP

SEQ ID NO: 15036 - protein, 187 aa, Xanthomonas axonopodis pv. citri str. 306 [sequence omitted]

SEQ ID NO: 15037 - protein, 377 aa, Xanthomonas axonopodis pv. citri str. 306
MKPKFSTAAAASLFVGSLLLTGVAYADAALEVATTGWATQNGGTKGGSKAAAANIYVVKNAAELKAALSASVGSNGRIIKVSGIIDISEGKPYTKTSDMKTRARLDVPTKTTLIGITSNAEIREGYFYVKANDVIIRNITIENPWDPEPVWDPDDGSAGNWNAEYDGLTVEGASNVWVDHVTFTDGRRTDDQNGTANGRPKQHHDGAMDIKKGANFVTVSYSAFKSHEKNNLIGSSDSASSTDSGKLKVTIHNTLFENISARAPRVRFGQVHLYNNYHVGSTSNAVYPFSYAHGVGKESKIFSERNVFEISGVSSCDKIAADYGGSVYRDQGSLLNGKALSCSWNTNIGWTPPYTYNLLSADKVAADVKAKAGAGKL

SEQ ID NO: 15038 - protein, 280 aa, Xanthomonas axonopodis pv. citri str. 306
MTNPESPRPDPGPQADVDDEQLAISVRGLTNRFGSQTVHEDLDLDVRRGEILGVVGGSGTGKSVLMRSILGLREPDAGSIQVLGADARSGRFADRQHITRNTGVLFQDGALFSSMTVGENVQVPLKEHHGEFPERWYFELALLKIKLAGLPADALDKLPSQLSGGMRKRAGLARALALDPPLLFLDEPTAGLDPIGAAAFDRLIRTLQQALGLTVFLITHDLDTLYAICDRIAVLADRKVIANAPLAEVEQIDHPWIQDYFHGPRARAARAAKTDSTETA

SEQ ID NO: 15039 - protein, 243 aa, Xanthomonas axonopodis pv. citri str. 306
MRSEGRGAASGKRYADAKAALGGVLANGQTLAVGGFGLCGIPEALIAAVRDSGVGGLTVISNNAGVDGFGLGQLLATRQIRKMISSYVGENKEFERQYLAGELELEFNPQGTLAERLRAGGAGIPAFYTATGYGTIVAEGKETREFDGKHYVLETALQADVALVKAWRADTAGNLVFRKTARNFNPACAMAGRVCIAEVEDIVELGVIDPDQVHLPGIYVDRLVLNATPEKRIEQRTVREGQQ

SEQ ID NO: 15040 - protein, 467 aa, Xanthomonas axonopodis pv. citri str. 306
MSDVLPIILSGGSGTRLWPLSRESYPKQFLPLVGDKSMLQSTWLRAAPVAGHAPIVVANEEHRFMAAEQLQQLGVKPSAILLEPKGRNTAPAIAVAALEATRDGADPLLLVLPSDHVIQNEAAFQAAVTLAATAAEQGKLVTFGIKPTAPETGYGYIKASAGAGASAVERFVEKPDLATAQSYLASGEYYWNSGMFLFRASRYLEELRKFHPAIADACQKAWENGKRDADFTRLDKDAFAASPSDSIDYAVMEKTADAVVVPLDAGWNDVGSWSSLLDVSNQDAQGNAHHGDVIQLDCQNTYAYGSRLIAMVGLEDVVVVETPDAVLVGHRDRIQEVKDVVSQIKTAGRSEATWHRKVYRPWGAYDSIDMGQRHQVKRITVKPGAVLSLQMHHHRAEHWIVVSGTAEVTRGEEVLLLTENQSTYIPLGVTHRLRNPGKLPLELIEVQSGSYLGEDDIVRFEDTYGRA

SEQ ID NO: 15041 - protein, 456 aa, Xanthomonas axonopodis pv. citri str. 306
MAIHSSVLELIGNTPIVKAQRLDTGVCELFLKLEANNPGGSIKDRIGLSMIEAAERRGDLKPGATLVEGTAGNTGLGLALVAQQKGYQLILVVPDKMSREKIFNLKAMGANVVLTRSDVAKGHPEYYQDLAARIAAETPGAYFINQFGNPDNPAAHEFGTGPEILAQMDGQLDAIVFGCGSSGTMTGLSRAFASASPHTELVLADPVGSILTQYIEEGTVSEKSGSWLVEGIGEDFLPDISDFSRVKKAYSISDAESFHTARELLAKEGILGGSSTGTLLAAALKYCREQTTPKRVLVFVCDTGNKYLSKMYNDYWMLDNGFLERPQHGDLRDLILRPYNKRDTVVVGSKDLLTTAYQRMKLYDVSQLPVIDDGELVGIVDESDVLLHVYGDEARFRDPISTAMVSKLDRLDVASPIEALLPVFDRGQVAIVMDGTQFLGLITRIDLLNYLRRRVQ

SEQ ID NO: 15042 - protein, 373 aa, Xanthomonas axonopodis pv. citri str. 306
MQPSPAMSQRQWVAAAIQKIEADFNRSADTHLIPMELPGYPGIDLYFKDESSHPTGSLKHRLARSLFLYALTNGWLRAGRPVIEASSGSTAISEAYFARLLGVPFIAVMPASTSPEKIAAIEFQGGRCHLVERACDLDSASHQLARETGGHFMDQFTYAERATDWRANNNIAESIFKQLAEEPHPIPDWIVCSPGTGGTSATLGRYVRYRRHATRILCADPEVSVFFDGYCRAVDGQCPKELAITGGSRIEGIGRPRVESSFIASCVDVMIKVPDALSLAAMRHVSATLGRRVGGSTGTNFVGVLHAARRMRDEGRQGSIVTILCDAGERYAHSYYDPAWYEARAIDVSDSDAAIALAVNGGDLPALPCAALE

SEQ ID NO: 15043 - protein, 331 aa, Xanthomonas axonopodis pv. citri str. 306
MQTRTLGRSGPTVSALGLGCMGMSAFYGDRSDEAASIAVIHRALDRGISSLDTADMYGPHTNEVLVGKAIAARRHEVFLATKFGIKLDPNDPSVRGIDGSPAYVQSACEASLRRLGVEHIDLYYQHRVDPNVPIEDTVGAMARLVEQGKVRFLGLSEAAAATIRRAHAVHPITAVQTEYSLWSREPEDNGEFAAVRELGIGFVPYSPLGRGFLTGAFSSPDDFDADDYRRHSPRFQGENFTRNLQLVEQVKAIAADKGITPGQLALAWVLAQGQDLVPIPGTKRLAYLEENIAALDVALMPDELARIDAIFPPQAAAGTRYPEAMMGAVNR

SEQ ID NO: 15044 - protein, 458 aa, Xanthomonas axonopodis pv. citri str. 306
MSVSSAPPSATPGFASEVRTTGLLALPLVLGHVSTGLIGFVDNVIAGHHGTATLAAVTIGTSLLWLPMLVPIGTLISLTASVSQLLGAGREREIGPLFRQALWLSLGLSALMFVFLSVVPPLLPTFGIAPDIVPGATAFLHAVRWGVPALTFYFCMRYLSEGMHWTLPTMLLGFGGLLVLAPVGYALTYGKFGFAEHGAEGLGMASAITMWVQASVFALYLWRARRFAHLQLFAHLEGPRWRAIGELLRTGLPIGITVLMEGGLFIVTALLIGRLGSTEAAAHQIAINVAQLCFMIPMGVAEATTVRVGHAVGRGDPQAMRRAAWAGYAIVLGTQALSASALLLGHDAIVGVYTDDVAVAALASVLLLFAATFQFPDGIQVLSAGALRGLKDTRVPMFLAMFSYWGVGMPIGAGLGLGLGWGPKGMWVGLILGLTVASILMGLRFRQTSRRLTATVTP

SEQ ID NO: 15045 - protein, 1066 aa, Xanthomonas axonopodis pv. citri str. 306
MNAQLDPLASTSVARPLLAPELPAAPGALRAAITAAWLKDETEHVRELLDQARLPVAEQANVQAIAADLVTRVRARSQDQGAIEAFMRQYDLGSEEGVLLMCVAEALLRIPDQDTADKLIRDKLGDADWKKHMGGSDSVLVNASTWGLMLTGQLVQLNDLTRADVPGAFKRLIGRVGEPVIRLAVRQAMKIMGHQFVMGRTIGEALSRSRKGDNANYRYSFDMLGEGALTMKDAQRYLQAYRDAIHAIGRSGSFVGTDVFAAPSISIKLSALYPRYEHAKRARVMAELVPGVLELAQLAKSYGIGYTVDAEEADRLELSLDIIEATFSDPSLDGWEGYGLAVQAYQKRTPYTIDFLADLARRVGRRIPVRLVKGAYWDAEIKRAQIEGHPGYPVFTRKQNTDVSYLACARRMFAHSDALYPMFATHNAQTIAAVRAIAAGKTYEHQKLHGMGDDLYAEVIPADRLDLPCRVYAPVGSHEDLLPYLVRRLLENGANSSFVNRITDEDVAIEDLIRDPVEAVTSFTSIPHPKIPLPADLLRSQNQNRKNSMGANLANDNDLRQLAEQLNAAIKPWKATPLVPGALISTPSQAVLNPADRRETVGQWHPADPDTVQKSLASAVAAQPAWNRTPAASRATILEHAADLLETRMSEFMAICVKEAGKTLPDAVAEVREAVDFLRYYAGQARAQFGAPERLPGPTGESNELQLHGRGVFVCISPWNFPLAIFLGQVAAALAAGNTVIAKPAEQTNLIGFAAVKLLHEAGVPEAAVQFLPGDGATVGAALTNDPRVAGVAFTGSTETARIINRTLAARDAAIGVLIAETGGQNAFIADSSSLPEAVVKDAISSAFISAGQRCSAARVLFVQDDIADKVMTMLAGAMGELKIGDPGLPSTDVGPVIDADALKILDDHAARMDRQARLIGSTALDGSTAHGSFFAPRAYELTSLSQLQREIFGPVLHVIRWKADQLDAVIEQINATGYGLTLGVHSRIDETIDRITSRVAVGNVYVNRNQIGAVVGVQPFGGQGLSGTGPKAGGPHYLLRFATEKVVTVNTTAAGGNASLLTLGD

SEQ ID NO: 15046 - protein, 285 aa, Xanthomonas axonopodis pv. citri str. 306
MSANDNWYIEHFQPTGSAIGFRISGKLDEVQSPFQKIEIYQTTDWGKLMLIDGAVMLTSRDNFFYHEMISHPALFTHPAPKRVVIIGGGDCGTLREVLKHPGVESATQCDIDEQVTRMSEKYFPELCDSNHDARAELLFDDGVAYMANCQAGSVDIVIVDSTDPVGPAEGLFNKAFYESCFKALKDDGILVQQSESPLALLDLINEMRTEMGKAGFQSFKTLPFPQPCYPTGWWSVTMASKQAKADFAFRQDAAQAKGFDTLYYTAHLHTGVLVAPPFVAKALGE

SEQ ID NO: 15047 - protein, 307 aa, Xanthomonas axonopodis pv. citri str. 306
MATQYVPVSLIGVPTDIGAGHRGARMGPEALRIAGLQEALVGRGVEVRDLGNLDGPRNPWQAPQAGYRHLDEVVAWNQALMDASYAELRAGRMPIMLGGDHCLGIGSITAVAKYCREQGRPLRVLWLDAHSDFNTSEVTPSGNVHGMPVACLCGLGPEALTHLGGSAPALLPEQVRQIGIRSVDPEEKRLIKQHRIDVYDMRYIDEAGMKRTMEAALQDMSADTHLHVSFDVDFLDPSIAPGVGTTVPGGPNYREAQLVMEMIADTGRMGSLDIVELNPVLDNRNATAELAVDLVESLFGKSTLMRD

SEQ ID NO: 15048 - protein, 336 aa, Xanthomonas axonopodis pv. citri str. 306
MSGVARQRLGGTDVQLSALGFGAAPIGNLYTEVDEADALAAVAGAFEAGIRHFDTAPYYGYGLSEARLGRGLAGVPRADYTLSTKVGRCVYDDAHAAAGRDGFAVAGRRAEFDYSADGVRRAFASSLGRLGTDYIDVLLLHDIGALTHGDNHANVLRQALEEALPAMAELKAAGACGAIGLGVNEQDVALEVLPRFPLDCVMLAGRYTLLEQHGARALLQQAQQRNVAILSAGPYSSGLLSDARGPGATYNYAPVDTATLQHAQRLYAACAAFGVDIGAAALQFPLAHPAVTTVVAGMRSVAEVRSAATRLAAPVPSALWQRLRDEGLLAAELPTP

SEQ ID NO: 15049 - protein, 481 aa, Xanthomonas axonopodis pv. citri str. 306
MRVMHADLDVCAEDIAAVFAAQQPVAAAWRSSTAAQRRERLRALRSALLARRQALYAAFAGDFGKPALEVELSELLPVVDEIAAAIAGLPRWMRPRKVSPTLLTLGTHAQIGYQPKGRCLIIGPWNYPVATVLGPLVSALAAGNTATLKPSEFTPQVNAVLRELLAEAFDPSEVAMVQGGVATAQRLLACPFDHVFFTGSPAVGRQVMAAAAAQLASVTLELGGKSPAIVDRSANLERAAQVLVWGKLVNAGQTCIAPDTLFVHREVRTALLQRCRELLAQRYGGSAAAVAASPDLARMIHVGHAARLAALIDEARAAGAELVAGGEHDVGQRFIAPTVLADVPEHARIAQEEIFGPVLPVVTFDHLDTVLAGLDAAAKPLALYLWSNDAAQVARVLARSSSGSVVVNHCLQQFMHTGLPFGGIGQSGIGSAHGVHGFKAFSHERAVLRGGRLLTARAFFPPYRGWQHRVATALTAWLARR

SEQ ID NO: 15050 - protein, 290 aa, Xanthomonas axonopodis pv. citri str. 306
MVYGLRLPGTGRMEAIGIPRGATAQTQECLPNDLDALRRKLQFNRLRGGTAAVLLEPLGPESGTRPVHADYNRQVRALCDEFGALLIFDEVVTGFRLGPGGAQGYFGVAPDITVLGKCLAGGYPMAGAIGGRREVMMSLVGGIGTTARRAFVGGTLSANPLSCVAGYYALLEAQQNDAAGRAGRAGDRLRAGLEAIIQRRGLPYVVYNMGSIVHLQTSGVLLLDTGNLYKLWRVRNDAKARKHMMEEMGAAYSAHGLITLAGSRIYTSMADTDAVIDEALNRFDDVFALV

SEQ ID NO: 15051 - protein, 264 aa, Xanthomonas axonopodis pv. citri str. 306
MTASASPVVQLSGVRIDRGGRTILRDVSLEVPRGSITAVLGPSGSGKSTMLAALTGELRPVAGAVTLFGNPIPTGSRALLEMRRNVGVLLQGNGLLTDLSVAENVALPLRTHTRLPAAVLQRLVQMKLHAVGLLAAADAWPRELSGGMARRVALARALALDPPLMIYDEPLTGLDPIASGVIMSLIQRLNDSLGLTSIIVSHHVHETLPICEQAVVIANGGIVFAGTPAQLQDSTDPLVQQFLHGQPDGPIAFDAAPRRDRSAA

SEQ ID NO: 15052 - protein, 183 aa, Xanthomonas axonopodis pv. citri str. 306
MSQTLYDIPVTRIDGQPTTLADYRGKVLLVVNVASKCGLTPQYEGLEALYRDKRAQGLEVLAFPANDFNGQEPGSEAEIAQFCQLTYDVTFPMFAKIAVAGDQAHPLYGALTSTHPHTTGEGPMREKLAGYGIAPNPAPGVVWNFEKFLIGRDGKIIDRFAPDIPADDARLRAAIDAALATRS

SEQ ID NO: 15053 - protein, 335 aa, Xanthomonas axonopodis pv. citri str. 306
MKAIAYLQHGLPIDDARALVELELPLPTPGPRDLRVRIHAVSVNPVDTKVRSNAAVDAPRVLGWDASGVVDAVGEAVSLFRPGDAVYYAGALTRPGTNAEFHLVDERLVGRKPATLDDAAAAALPLTAITAWELLFDRLGVAEGGGEGQALLVVGAAGGVGSMLVQLARTLTKLTVIGTASRPETQDWVHALGAHHVIDHSQPLSEGLQRIGIAQVQHVASLTHTDQHFAQLVEVLAPQGQLALIDDPATLDALPLKRKSLSLHWELMFTRSLFETEDMIAQHHLLNRVAELVDTGVLRTTLGEHYGRITADNLRRAHAALESHRTRGKLVLEGF

SEQ ID NO: 15054 - protein, 347 aa, Pichia stipitis
MSIPTTQKAVIFETNGGPLLYKDIPVPKPKPNELLINVKYGVCHTDLHAWKGDWPLDTKLPLVGGHEGAGVVVALGENVTGWEIGDYAGIKWINGSCLQCEYCVTAHESNCPDADLSGYTHDGSFQQYATADAIQAARIPKGTDLALIAPILCAGITVYKALKTAQLQAGQWVAVSGAAGGLGSLAIQYAKAMGYRVVGIDGGADKGEFAKSLGAEVFVDFLSSKDVVADVLKATNGGAHGVINVSVSERAMQQSVDYVRPTGTVVLVGLPAGAKVSASVFSSVVRTIQIKGSYVGNRADSAEAIDFFTRGLIKCPIKIVGLSELASVYELMEQGKILGRYVVDTSK

SEQ ID NO: 15055 - protein, 285 aa, Nicotiana excelsior
MENKEEDVRLGANKYSERQAIGTAAQSDKDYTEPPPAPLFEAGELTSWSFYRAGIAEFMATFLFLYITILTVMGVSKSESKCSTVGIQGIAWAFGGMIFALVYCTAGISGGHINPAVTFGLFLARKLSLTRAVFYMVMQCLGAICGAGVVKGFGKTLYQTKGGGANVVNHGYTKGSGLGAEIVGTFVLVYTVFSATDAKRSARDSHVPILAPLPIGFAVFLVHLATIPITGTGINPARSLGAAIIYNQDHAWDDHWIFWVGPFIGAALAALYQQVVIRAIPFKSK

SEQ ID NO: 15056 - protein, 287 aa, Nicotiana excelsior
MAENKEEDVKLGANKFRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAIFYMVMQCLGAICGAGVVKGFMVGPYQRLGGGANVVNPGYTKGDGLGAEIIGTFVLVYTVFSATDAKRNARDSHVPILAPLPIGFAVFLVHLATIPITGTGINPARSLGAAIIYNDEHAWDDHWIFWVGPFIGAALAAVYHQIIIRAIPFHKSS

SEQ ID NO: 15057 - protein, 287 aa, Nicotiana excelsior
MAENKEEDVKLGANKYRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRALFYMVMQCLGAICGAGVVKGFMVGPYQRLGGGANVVQPGYTKGDGLGAEIIGTFVLVYTVFSATDAKRNARDSHVPILAPLPIGFAVFLVHLATIPITGTGINPARSLGAAIIFNHDQAWDDHWIFWVGPFIGAALAAVYHQIIIRAIPFKTKS

SEQ ID NO: 15058 - protein, 379 aa, Solanum tuberosum
MANQTGGASSTGSRDIRGVLIHGGQYVRYNVYGSLFEVSSKYVPPIRPIGRGAYGLVCAAVNSETREEVAIKKIGNAFDNRIDAKRTLREIKLLRHLDHENIVAIKDLIRPPKKEAFNDVYIVSELMDTDLHQIIRSEQPLTNDHCQYFMYQLLRGLKYVHSANVLHRDLKPSNLFLNANCDLKIGDFGLARTTSETDFMTEYVVTRWYRAPELLLNCSEYTGAIDVWSVGCILGEIMTREPLFPGKDYVQQLRLITELLGSPDDASLQFLRSDNARRYVRQLPQYPKQQFSARFPSMSPLAVDLLEKMLVFDPTRRITVDEALCHPFLSSLHDLNDEPICPSPFSLDFDEPSITEEKIKELIWRESVKFYPDFVDQNI

SEQ ID NO: 15059 - protein, 462 aa, Bacillus subtilis
MMSSLFRKKPLETLSAQSKSKSLARTLSAFDLTLLGIGCVIGTGIFVITGTVAATGAGPALIISFILAGLACALAAFCYAEFSSSIPISGSVYSYSYVTLGELLAFLIGWDLMLEYVIALSAVATGWSSYFQSLLAGFNLHIPAALTGAPGSMAGAVFNLPAAVIILLITAIVSRGVKESTRFNNVIVLMKIAIILLFIIVGIGYVKPDNWSPFMPFGMKGVILSAATVFFAYLGFDAVSNASEEVKNPQKNMPVGIISALAVCTVLYIAVSLVLTGMMPYAKLNVGDPVSFALKFVGQDAVAGIISVGAIIGITTVMLALLYAQVRLTFAMSRDGLLPGLFAKVHPSFKTPFRNTWLTGIVAAGIAGFINLGTLAHLVNMGTLAAFTVISIAVIVLRKKHPEIKASFRVPFVPVVPIISAGICLWFMYSLPGVTWLSFVIWIAVGTLVYFLYSRKHSLLNK

SEQ ID NO: 15060 - protein, 446 aa, Aspergillus niger
MPALPILALALAPLLVNGQLSGSVGPLTSAHSKAATKTCNVLDYGAVADNSTDIGSALSEAWDACSDGGLIYIPPGDYAMDTWVSLSGGKATAIILDGTIYRTGTDGGNMILVENSSDFELYSNSSSGAVQGFGYVYHREGDLDGPRILRLQDVSNFAVHDIILVDAPAFHFVMDDCSDGEVYNMAIRGGNSGGLDGIDVWGSNIWVHDVEVTNKDECVTVKGPANNILVESIYCNWSGGCAMGSLGADTDITDILYRNVYTWSSNQMYMIKSNGGSGTVNNTLLENFIGRGNRYSLDVDSYWSSMTAVDGDGVQLSNITFKNWKGTEADGAERGPIKVVCSDTAPCTDITIEDFAMWTESGDEQTYTCESAYGDGFCLEDSDSTTSYTTTQTVTTAPSGYSATTMAADLTTDFGTTASIPIPTIPTSFYPGLTAISPLASAATTA

SEQ ID NO: 15061 - protein, 366 aa, Escherichia coli
GILDGNSAITVLHGEARFKDDQSLIVSLNEGGERVVMFDRCLVATGASPAVPPIPGLKESPYWTSTEALASDTIPERLAVIGSSVVALELAQAFARLGSKVTALARNTLFFREDPAIGEAVTAAFRAEGIEVLEHTQASQVAHMDGEFVLTTTHGELRADKLLVATGRTPNTRSLALEAAGVAVNAQGAIVIDKGMRTSSPNIYAAGDCTDQPQFVYVAAAAGTRAAINMTGGDAALDLTAMPAVVFTDPQVATVGYSEAEAHHDGIETDSRLLTLDNVPRALANFDTRGFIKLVIEEGSGRLIGVQAVAPEAGELIQTAVLAIRNRMTVQELADQLFPYLTMVEGLKLAAQTFSKDVKQLSCCAG

SEQ ID NO: 15062 - protein, 468 aa, Escherichia coli
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGNYLVDVILDEAANKGTGKWTSQSSLDLGEPLSLITESVFARYISSLKDQRVAASKVLSGPQATPAGDKAEFIEKVRRALYLGKIVSYAQGFSQLRAASDEYNWDLNYGEIAKIFRAGCIIRAQFLQKITDAYSQNAGIANLLLAPYFKQIADDYQQALRDVVAYAVQNGIPVPTFSAAIAYYDSYRSAVLPANLIQAQRDYFGAHTYKRTDKEGVFHTEWLD

SEQ ID NO: 15063 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGKTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 15064 - protein, 468 aa, Escherichia coli
MLKQQIGVVGMAVMGRNLALNIESRGYTVSIYNRSREKTEEVIAENPGKKLVPYYTVKEFVESLETPRRILLMVKAGAGTDAAIDSLKPYLDKGDIIIDGGNTFFQDTIRRNRELSSEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 15065 - protein, 468 aa, Escherichia coli
MSKQQIGVVGMAVMGRNLALNIESRGYTVSIFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELATTFTEWNEGELSSYLIDITKDIFTKKDEDGNYLVDVILDEAANKGTGKWTSQSSLDLGEPLSLITESVFARYISSLKDQRVAASKVLSGPQAKLAGDKAEFVEKVRRALYLGKIVSYAQGFSQLRAASDEYNWDLNYGEIAKIFRAGCIIRAQFLQKITDAYAENKGIANLLLAPYFKNIADDYQQALRDVVAYAVQNGIPVPTFSAAVAYYDSYRAAVLPANLIQAQRDYFGAHTYKRTDKEGAFHTEWLD

SEQ ID NO: 15066 - protein, 443 aa, Citrobacter freundii
IGVVGMAVMGRNLALNIESRGYTVSIFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKVPSIMPGGQKEAYELVAPILTKIAAVGKDGEPCVTYIGADGAGHYVKMVHNGIEYGDIQLIAEAYPLLKGGLNFSNEELATTFTEWNEVRLSSYLIDITKDIFTKKDEEGKYLVDVILDEAANKGTGKWTSQSSLDLGEPLSLITESVFARYISSLKDQRVAASKVLSGPRLKLAGDKAEFVEKVRRALYLGKTVLYAQGFSQARAASDEYHWDLNYGEIAKIFRTGCIIRAQFLQKITDAYAEKKGIANLLLAPYFKNIADEYQQALRDVVAYAVQNGIPVPTFSAAVAYYDSYRFAVLPANLIQAQRDYF

SEQ ID NO: 15067 - protein, 488 aa, Geobacillus stearothermophilus
MKVQTEIKTYFNYINGNWVSSVSNNVEPSINPANRHDIVGYVQRSTLEDVNEAVTAANEAQTSWWKRSGVERGEYLYKAAHILEQCLQDIAETMTREMGKTLAEAKAETMRGVHILRYYAGEGARKIGDVIPSSDSEGLLFTTRVPLGVVGVISPWNFPVAIPIWKMAPALVYGNTVVLKPASETAVTAAKVIECFHEAGFPKGVVNMVCGSGSVVGQGIANHPDIDGVTFTGSNTVGKQVGRAAFERGAKYQLEMGGKNPVIVAKDADLDLAVEGTISGGLRSTGQKCTATSRVFIEREVYEPFKAKLLERVKQLKIGNGLDAETWMGPCASESQFHTVLSYIEKGKSEGAKLIYGGNRCLEGELANGFFVEPTIFEDVDLQMTIAREEIFGPVLALIQVDSIEEAIKLANDTEYGLSASIYTKNIGNALEFIKDIEAGLIKVNAETAGVEFQAPFGGMKQSSSHSREQGQAAIEFFTSIKTVFVKA

SEQ ID NO: 15068 - protein, 294 aa, Vigna unguiculata
  misc_feature (266)..(266): Xaa can be any naturally occurring amino acid
MEQYEKVEKIGEGTYGVVYKARDRVTDETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCLFAEMVNRRPLFPGDSEIDELFKIFRILGTPNEETWPGVTALPDFKSTFPKWPPKDLATMVPNLDAAGLNLLSXMLSLDPSKRITARIAVEHEYFKDIKFVP

SEQ ID NO: 15069 - protein, 412 aa, Cupriavidus necator
MMSLSHASVPHTNPTAPHTLAALLAAGGLAGKRVFIRADLNVPQDAAGDITDDTRIRASVPAIAACLQAGAAVMVTSHLGRPQEGAPDPRHSLAPVGRRLSELLGRQVPLLSGWTEGGFQVPPGQVVLLENCRMNTGEKKNSDELAQKMAALCDVYVNDAFGTAHRAEATTHGIARYAPVACAGPLLAAEIDALGKALGQPARPLWAIVAGSKVSTKLTILKSLADKVDNLVVGGGIANTFMLAAGLKIGKSLAEPDLLADARAIIDIMAARGASVPIPVDVVCAKEFSATAAAAVKDVRDVADDDMILDIGPKTAAMLADQLKAAGTIVWNGPVGVFEFDQFGNGTRVLAQAIAESKAFSIAGGGDTLAAIAKYGIADRVGYISTGGGAFLEFLEGKKLPALDVLEQRAAS

SEQ ID NO: 15070 - protein, 438 aa, Aspergillus oryzae
MPITKIHARSVYDSRGNPTVEVDVVTETGLHRAIVPSGASTGQHEAHELRDGDKTHWGGKGVLKAVENVNKTIAPAVIEENLDVKDQSKVDEFLKKLDGSANKSNLGANAILGVSLAIAKAGAAEKGVPLYAHISDLAGTKKPYVLPVPFQNVLNGGSHAGGRLAFQEFMIVPSAAPSFSEALRQGAEVYQKLKTLAKKKYGQSAGNVGDEGGVAPDIQTAEEALDLITEAIEQAGYTGKMKIAMDVASSEFYKADVKKYDLDFKNPDSDSSKWLTYEQLADLYKTLASKYPIVSIEDPFAEDDWEAWSYFYKTSDFQIVGDDLTVTNPLRIKKAIETKACNALLLKVNQIGTLTESIQAAKDSYADNWGVMVSHRSGETEDVTIADIAVGLRSGQIKTGAPARSERLAKLNQILRIEEELGNNAIYAGEKFRTSVNL

SEQ ID NO: 15071 - protein, 247 aa, Gracilaria gracilis
CNLSKADIAELVSAFNAAPPIDAAHVQVVVAPPAVYLDSTRQALRADFDTSAQNAWISKGGAFTGELDAAMVKDVGAEWVILGHSERRHIAQLKESDHTIAMKAAYALQHASLGVIYCIGELLEERESGQTIAVCERQLQALSDAISDWSDVVIAYEPVWAIGTGKVATPEQAEQVHEAVRAWLANNVSPQVAASTRILYGGSVSPANCESLAKQPNIDGFLVGGASMKPTFLEIVDSYKATLAEAV

SEQ ID NO: 15072 - protein, 148 aa, Nicotiana sylvestris
MAEVEYSCFVGGLAWATTDRTLADAFGTYGEVLDSKIINDRETGRSRGFGFVTFKDEKCMRDAIEGMNGQELDGRSITVNEAQARGSGGGGGGYGGGRREGGGGGYGGGGGGYGGGRREGGGGGYGGGRREGGGGGYGGGGYGGGGRY

SEQ ID NO: 15073 - protein, 222 aa, Secale cereale
SHAAEVTAGYYNLHDRDDYRPIARMLTRHHASLNFTCAEMRDSEQSSQAMSAPEELVQQVWSAGWREGLNIACENALPRYDPTAYNTILRNARPHGINHSSPTEHKLFGFTYLRLSNQLLEGQNYVNFKTFVDRMHANLPHDPSVDPVAPLQRSGPEIPIEVILQAAQPKLDPFPFEDHTDLPVQCLGGIGGGEVECPAGGIGGEVQQDPTGGMGGELPPAV

SEQ ID NO: 15074 - protein, 184 aa, Helianthus annuus
MATTTYDRHHVTTTQPQYRHDQHTGDRLTHPQRHEQGPSTGKIMVIMALLPITGILFGLAGITLVGTVIGLPLATPLFVIFSPVIVPAMIAIGLAVTGFLTSGTFGLTGLSSLSYLFNMVRRSTMSVPDQMDYVKGKLQDVGEYTGQKTKDLGQKIQHTAHEMGDQGQGQGQGGGKEGRKEGGK

SEQ ID NO: 15075 - protein, 270 aa, Staphylococcus aureus subsp. aureus MW2
METLNSINIPKRKEDSHKGDYGKILLIGGSANLGGAIMLAARACVFSGSGLITVATHPTNHSALHSRCPEAMVIDINDTKMLTKMIEMTDSILIGPGLGVDFKGNNAITFLLQNIQPHQNLIVDGDAITIFSKLKPQLPTCRVIFTPHLKEWERLSGIPIEEQTYERNREAVDRLGATVVLKKHGTEIFFKDEDFKLTIGSPAMATGGMGDTLAGMITSFVGQFDNLKEAVMSATYTHSFIGENLAKDMYVVPPSRLINEIPYAMKQLES

SEQ ID NO: 15076 - protein, 403 aa, Staphylococcus aureus subsp. aureus MW2
MTFEKETVLKTLFPEDVLSIAKGLTDGEVEFLQQVDSLLESEYRENINQHWIDATVPEDYFKDLGELNYFNNPLLYKDRPNAKMPSQLFQFFMSYLLARFDISLATLLGVHQGLGHNTFYFGGSKEQIAKYVPKLQSHELRTCFALTEPEHGSDVAGGLETVAERQGDTWVINGEKKWIGGAHVSDVIPVFAVNKETGKPHCFVVRPEQDGVDIEVIDNKIALRIVPNALIKLTNVKVDEADRLQNITSFKDIAKILYSTRAGVAYMATGGMAGALRATLDYVTERKQFGKPISKYQLIQEKLAMMQGNLAQAMATCAQLANMQAHGEYDEVATSTAKMMNALRLRETVAMGRGITGGNGILADDYDIARFFSDAEAIYTYEGTHEINALVIGRALTGDSAFV

SEQ ID NO: 15077 - protein, 341 aa, Staphylococcus aureus subsp. aureus MW2
MNNKVLVTGGTGFVGMRIISRLLEQGYEVQTTIRDLSKADKVIKTMQDNGISTERLMFVEADLSQDEHWDEAMKDCKYVLSVASPVFFGKTDDAEVMAKPAIEGIQRILRAAEHAGVKRVVMTANFGAVGFSNKDKNSITNESHWTNEDEPGLSVYEKSKLLAEKAAWDFVENENTTVEFATINPVAIFGPSLDAHVSGSFHLLENLLNGSMKRVPQIPLNVVDVRDVAELHILAMTNEQANGKRFIATADGQINLLEIAKLIKEKRPEIAQKVSTKKLPDFVLSLGAKFNHQAKEGKLLLDMNRNVSNERAKILLGWEPIATQKEAILAAVDSMAKYHLI

SEQ ID NO: 15078 - protein, 440 aa, Staphylococcus aureus subsp. aureus MW2
MKTYDLIVIGFGEAGKTLAKYAASTGQHVAVIEQSPKMYGGTCINIGCIASKTLVHDGLEGKSFEASYNRKNDVVNALNNKNYHLLADDNNIDVLDFKAQFKSNTEVNLLDQHDDIADSITAPHIIINTGATSVIPNIKGLDQAKHVFDSTGLLNINYQPKHLVIVGGGYIALEFASMFANLGSKVTVLERGESFMPREDQDVVAHAITDLENKGITLHTNVETTELSSDNHHTTVHTNVGNFEADAVLLAIGRKPNTDLALENTDIELGDRGEIKVNAHLQTTVPHIYAAGDVKGGLQFTYISLDDYRIIKSALYGNQSRTTDNRGSVPFTVFIDPPLSRVGLTSKEAAAQHYDYTEHQLLVSAIPRHKINNDPRGLFKVVINNENNMILGATLYGKQSEELINIIKLAIDQNIPYTVLRDNIYTHPTMAESFNDLFNF

SEQ ID NO: 15079 - protein, 302 aa, Staphylococcus aureus subsp. aureus MW2
MEQIMINHYVHFSRLVQGFWRANEWKMTAKELNYFINELVERGITTMDHADIYGDYQCESLFGNALDLSPELRNKIQIVTKCGIILPSKQFDFTNGHRYDLSSKHIVKSVEQSLINLNVDYLDSLLIHRSSPLMDPEQVADALTKLVKQGKLKSFGVSNFNHSQYQLLNQYIMKERLHISINQLELSPYHVDSLQDGTMDSMYQNHVQIMAWSPFAGGKIFDKEDIKAQRIMKVVQSIADKYGVSDTAVMIAWLVKIPHRIMPILGTSQLKRIDQAIEGLQLNLDDQSWFDIYTAIIGQDIP

SEQ ID NO: 15080 - protein, 493 aa, Staphylococcus aureus subsp. aureus MW2
MMKKAILSVSNKTGIVEFAKALTQLNYELYSTGGTKRILDEANVPVRSVSDLTHFPEIMDGRVKTLHPAVHGGILADRNKPQHLNELSEQHIDLIDMVVVNLYPFQQTVANPDVTMDEAIENIDIGGPTMLRAAAKNYKHVTTIVHPADYQEVLTRLRNDSLDESYRQSLMIKVFEHTAEYDEAIVRFFKGDKETLRYGENPQQSAYFVRTSNAKHTIAGAKQLHGKQLSYNNIKDADATLALVKKFDTPATVAVKHMNPCGVGIGDTIEQAFQHAYEADSQSIFGGIVALNRAVTPELAEQLHSIFLEVIIAPKFTDEALDILKQKKNVRLLEIDMTIDSNEEEFVSVSGGYLVQDKDNYVVPKEEMKVVTEVAPTDEQWEAMLLGWKVVPSVKSNAIILSNNKQTVGIGAGQMNRVGAAKIALERAIEINDHVALVSDGFFPMGDTVELAAQHGIKAIIQPGGSIKDQDSIDMANKHGIAMVVTGTRHFKH

SEQ ID NO: 15081 - protein, 489 aa, Staphylococcus aureus subsp. aureus MW2
MYQLEDDSLMLHNDLYQINMAESYWNDNIHEKMAVFDLYFRKMPFNSGYAVFNGLKRVIDFIEHFGFSESDLEYLKSIGYKDDFLSYLKDLKFTGSIRSMQEGELCFGNEPLLRVEAPLIQAQLIETILLNIVNFHTLITTKASRIRQIASIDKLMEFGTRRAQEIDAALWGARAAYIGGFDSTSNVRAGKLFGIPVSGTHAHAFVQTYGDEYVAFKKYAERHKNCVFLVDTFHTLKSGVPNAIKVAKELGDKINFVGIRLDSGDIAYLSKEARRMLDEAGFTETKIIASNDLDEETITSLKAQGAKVDSWGVGTKLITGYDQPALGAVYKLVAIENEDGSYSDRIKLSNNAEKVTTPGKKNVYRIINKKTGKAEGDYITLENENPYDEQPLKLFHPVHTYKMKFIKSFEAIDLHHNIYENGKLVYQMPTEDESREYLALGLQSIWDENKRFLNPQEYPVDLSKACWDNKHKRIFEVAEHVKEMEEDNE

SEQ ID NO: 15082 - protein, 351 aa, Staphylococcus aureus subsp. aureus MW2
MYIIFNFTHLLFNLLKARFLIMTKIMFFGTRDYEKEMALNWGKKNNVEVTTSKELLSSATVDQLKDYDGVTTMQFGKLEDDVYPKLESYGIKQIAQRTAGFDMYDLDLAKKHNIVISNVPSYSPETIAEYSVSIALQLVRRFPDIERRVQAHDFTWQAEIMSKPVKNMTVAIIGTGRIGAATAKIYAGFGATITAYDAYPNKDLDFLTYKDSVKEAIKDADIISLHVPANKESYHLFDKAMFDHVKKGAILVNAARGAVINTPDLIAAVNDGTLLGAAIDTYENEAAYFTNDWTNKDIDDKTLLELIEHERILVTPHIAFFSDEAVQNLVEGGLNAALSVINTSTCETRLN

SEQ ID NO: 15083 - protein, 332 aa, Staphylococcus aureus subsp. aureus MW2
MTKIKIMSVRDEDMPYIKAWAEKHHVEVDITKEALTDDNVEGVAGYDGLSLSQQIPLSEHVYKRLNELGIKQIAQRSAGFDTYDLELANKYNLIVSNVPSYSPNSIAEFAVNQAINVVRHFNQIQTKVREHDFRWEPTILSKSIKDLKVAVIGTGRIGRVVADIFANGYQSDVVAYDPFPNAKIATYVDYKDTIEEAVEGADIVTLHVPATKYNHYLFNAELFKHFKKGAVFVNCARGSLVDTKALLDALDNGVIKGAALDTYEFERKLFPSDQRGKTLNDPLLESLIDREDVILTPHIAFYTEAAVKNLIVDALDATLDVLQTGDTRLRVN

SEQ ID NO: 15084 - protein, 457 aa, Staphylococcus aureus subsp. aureus MW2
MHINTVNGRGMYMSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCEITPGDFEKRVTFDLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALEKICREHGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKKLKTRDGSAALKICNYCFEHGVVIIAVAGNVLRFQPPLVITYEQLDTALNTIEDALTALEAGNLDQYDISGQGW

SEQ ID NO: 15085 - protein, 369 aa, Acholeplasma laidlawii
MAKRDYYDVLGISKSASQDEIKKAYRSLAKKYHPDVSKEKDAETKFKEVQEAYDVLNDSNKKAQYDRFGHAGTGQDPFGGAGGGFGGFGGFDDIISQFFGGGQTRRTRQTSNVGEDLNMRMTIDFMEAVLGTTKNVSVDITQDCGHCHGSGAESSKDVHTCSKCHGQGFINVDQRTMFGTMRSQQVCPQCQGEGQTIDNKCHVCSGAGRVKAKKTVDVKVPAGVDNEMTLRVPGYGNGGRKGAESGDLYITFRVKPHKIFKRRGSDIILDVPITFTQAALGDKIDIPTIYGEVELTIPAGIQSGTELKLKNKGTKDPRTGKTGDQHVIVNIETPKNLSSEEKKLFEQLSKLDSPRKKSGWDKFKSFFTN

SEQ ID NO: 15086 - protein, 471 aa, Escherichia coli
MLLPVIMAGGTGSRLWPMSRELYPKQFLRLFGQNSMLQETITRLSGLEVHEPMVICNEEHRFLVAEQLRQLNKLSSNIILEPVGRNTAPAIALAALQATRHGDDPLMLVLAADHIINNQPVFHDAIRVAEQYADEGHLVTFGIVPNAPETGYGYIQRGVAVTDSAHTPYQVARFVEKPDRERAGAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDGQGNVLSGDAWVHNSENCYINSDEKLVAAIGVENLVIVSTKDAVLVMNRERSQDVKKAVEFLKQNQRTEYKRHREIYRPWGRCDVVVQTPRFNVNRITVKPGGAFSMQMHHHRAEHWVILAGTGQVTVNGKQFLLSENQSTFIPIGAEHCLENPGCIPLEVLEIQSGSYLGEDDIIRIKDQYGRC

SEQ ID NO: 15087 - protein, 348 aa, Acremonium chrysogenum
MRLSFFSAKPYDKKSFGLAHAARDPPSPVTITYHDIPLNEDTVSTVRDADAVCAFVNDSLSAHVIETLARQGVKAILLRCAGFNHVDLAAAARHGIMVANVPSYSPEAVAEFAVALIQTLNRNTHRAYNRVREGNFALHGLLGKTLHGKTVGLVGVGKIGLATARIMKGFGCRVLASDPFPSPAFEEYGEYKDLDTLLSESDIVSLHCALMDNTRHIINGDTIAKMKKGVLLINTSRGGLVDTRAVIKALKTKHIGGVALDVYEAEGSLFYDDHSGEIIHDDVLMRLMTFPNVIVTGHQAFFTEEALEEIAQCTLRNLEEFIKEGTCKNSLTKEPELRSKVPDPVRNV

SEQ ID NO: 15088 - protein, 307 aa, Pseudomonas putida
MTGMPQVLALGEAMIEFNQSTKGAPNYLQGFGGDVSNFLIAASRQGASSGFVSAVGNDHFGQLLLDLWRAENVDTSTVRVDANAPTGVYFVSHGESGHRFDYLRAGSAASRYAVSDLPLDAIAAAQVVHLSGISLAIGVPACDASLAAIDHAKRHGVKVSFDTNLRLKLWPLARARAVMLEAIRATDICLPSWDDVTELTGLADKDAIVDFLLALGPKVVALKLGKEGAYVATPAERRVVAGRVVKAVDATGAGDCFGGAFIARIVAGDDPFAAARYANVAAALSTQGFGAVAPIPDRATVEKALAE

SEQ ID NO: 15089 - protein, 475 aa, Methanosarcina mazei Go1
MEGERFLNHRTPEELEKWKNTGKTEGSEDSMKELETEFNSFEQEVGLLDTVGPKAREIIGQDCNMVSACVSRPYPLVVDRAKGSVVRDIDGKEYIDFVAGIAVMNAGYSNPEVQAAISAQLEKMVHCGYGDFFAEPPLKLAKKLRDLSGYSKVFYCNSGAESIEAAMKLSLWKTKRQNFISFYNAFHGRTLGALSLTCSKVRHKEHFPTIRTVHTDYAYCYRCPLNLDYPSCGIECAKQIENLVFRRELSPEDTAAVFVEPIQGEGGYIVPPVEFHKEVRRICTDNDVLLVADEVQTGCFRTGPFLAMENFEVRADITCLAKALGSGLPIGAMLADNELMDWPPGVHSNTFGGNLLSSAAALASLEFLEKENTENHVREMGAHIRHRLRELQENFPCIGDVRGLGLMTGVEIVKPDKSIDPVRRDKIIREAFKDGVLLLPCGDSVIRFSPPLVMTDEEADLGLDKFEKALKKAVR

SEQ ID NO: 15090 - protein, 492 aa, Methanosarcina mazei Go1
MIREYKLLIGGKSVDSSTGETFDDINPATLENLATLQVAGIEDVDRAVEAAEAGFRVWSEVPAPGRAEVLFRAARIMQERKEGLARLMTEEMGKVLPETRGDVQEAIDITIYAAGEGRRMFGETTTSELRDKFCMTVLRPVGVVGMITPWNFPIAIPSWKIMPALIAGNAIVFKPASDTPLLTIKLVEILMEAGLPPGVINIVPGPGGSTGKAIVQHPRIRAISFTGSLDTGKWIMEECAKSMKRVSLELGGKNPVIVMDDANLELALEGVVWGAFGTTGQRCTATSRLILHEKIKDEFIKRLLAKTKSLRVGNGLLPETDVGPVINKAQLEKIEKYVRIGKEEGAAILVGGNRIDPGLPGYFFEPTIFTDVSPEMRIAQEEIFGPVLSIITVSDFDEAIEVANNIKYGLSSAIYTENVRTAFRAIEKLEAGITYVNAPTIGAEVHLPFGGIKGTGNGFREAGTEAIKEFTEVKAVYIDYSGRLQKAQIDTE

SEQ ID NO: 15091 - protein, 311 aa, Methanosarcina mazei Go1
MLKKFTSLFPLWAVLLSAVAYLYPEYFAPHNNLIVPFLSLIMLGMGVTLSVDSFLEVLKRPHVVLLGTLMQYTLMPLAAWAVSIALNLPADLMAGVILLGCCPGGTASNVICYLAKGDVALSIVLTSVSTMIAFLATPFLTWLFIGQTVEVDVTGMLVSVINIVVLPVALGLAINYFFESRIKAVRDVFPAISAAAIVIIIAIIIGTNSENLEQSGPLVLLAVILHNGLGLAGGYGAAKALKFSEKEARTIAIEVGMQNSGLSVALAIKHFTAAAALPGAIFSIWHNLSGAFLAGHWSKETEFDRDKHEIS

SEQ ID NO: 15092 - protein, 354 aa, Methanosarcina mazei Go1
MRLNHNSYEIFDFMRSRSAIGVLSKIIITIPPINLRMIIGVMGPEGSYSERAAKLWARKNGLRGAEFHYFADIEDAFLAAVGGKTDISVVPVENSIEGSVGVTLDLLLENEAVIIGEIVVKIEHCLLSKGEPEKIRVILSHPQGLAQCRHFLKTHFPEAELRSTGSTSHAARLAGEFEEMAAIASPEAAERYGLKILLSNVQDRKENHTRFIVVRGGEKVLSGKIKGKADSGEKLNTVFGRNAEHKLCSETETGTENSSSYAFKTSLIVYLEKDRPGALYEPLGFFAKRGINLTKIESRPSKKELGDYYFYIDLEGNISDVLIKDALEDIKSKASKKSRSSTLKVLGSYPAFKK

SEQ ID NO: 15093 - protein, 166 aa, Methanosarcina mazei Go1
MVLGSGCTDNGSGDGRAVKAGDTVQVDYVGKFENGTVFDTSIEEEAQEAGIYNAQREYVPLNLTAGSGQVIEGFDEGLIGMKEGEEKTLTIPPEKAYGEYNESWVQAVPLEELNMSEKPEVGQVYSSIYGGQFKVIAVNETHVTFDPNHELAGETLVFDVKLVSIE

SEQ ID NO: 15094 - protein, 163 aa, Methanosarcina mazei Go1
MIVMTEDIIENSNKVVEKGDAVSVHYVGKLDDGTVFDTSEKEEAMEAGIYNEMRDYEPLKFTVGAGQMIKGFDEGVVGMKAGEEKILKIPPEEAYGEYVEEYARELPRDAVDFVPEVGMQLATETGLRGTVTEVGEENFVIDFNHALAGKTLTFKVKVISVEE

SEQ ID NO: 15095 - protein, 416 aa, Methanosarcina mazei Go1
MLRVMTSRNFLTIDDFDIRGKTILLRVDMNSPMDTQGHILDDMRIRSHIATLKDLESAKVVVLAHQSRPGKKDFTTMKPHAHLLSRYLGRQVTYVDDIFGTFAKTQIASMEDGDVIMLENVRFYSEESLERTTAEQANTFMVKKLAPFVDIFLNDAFAVSHRSHLSVVGFTEVLPSGAGRVMEKELISLEKGVKSGERPSVFVLGGAKVDDSLRVTENVLTNGGADRVLLTGVVANVALAASGVNIGKANLDFIKSQGYEDQIERARGLLAKFEDKIGLPKDVALNDNKKRVEAPISELNSDSLPINDIGLETIVDYTNEIQNAKTVVLNGPAGVSEIEDFALGTHEIIKAAIKSDFSIIGGGHISVEVAHLGLEHRFSHISTGGGACIDFLAGEKLPGVEALKAAYNKYQEAKKL

SEQ ID NO: 15096 - protein, 495 aa, Methanosarcina mazei Go1
MRGMRIDAYIAEHARKNPDQLALEDGKKSISYSCLDEDINKVASSLDGFEHCKFAILAESGIQYVKILMAVYRSGNIAIPLPIEMQGRSLERILDTACINNIIATKKQYSRFGDGFFERFGTVIVVSDDTSVETLSRRMILERNDPRLRLVLYTSGTTGTPKGVMLSDKNLVSNARSITGILSIGSKDKAALVISPHHAFGNSIINSHLMAGSSIQIGTMNFIDPVFSLIESGVSIFYGVPSTYRILLKYPERFRKAFQNVRTAASAGGAMDRTVVRSIRELSPDTQILPMYGQTEATARLSYLPAEDVDEFIDTIGKAIPGVTLEVFDTENRPVEPGVTGELVARGDNILLGYLNDEAATEKKIIDGWLHTGDLAQKLRCGYIKLLGRKDDLIKIGDHRVNPREIEKEIEMNNEVSSVFVVPVSHELMGNAISLMVIPNERTEIDTIFSFCRKNLPGYLYPREILFIDHLPLSENGKISNRSIIEEYQHVKASM

SEQ ID NO: 15097 - protein, 435 aa, Methanosarcina mazei Go1
MYPKQFLKFGETSLFQETVLRCLEVSDISEVFVVTNEAQKFFVIGQIKEAGYSIPPENILIEPEGKNTLPAIFFGMKEIEKKFGDSIVGVFSSDHVLDRAAMATISSAENLASDYLVTFGVVPTFPHTGYGYIKASEACSPGYRVSEFREKPDFETAKKYIEEGCLWNSGMFLFETRLFFEEARKHAPSVYGCFEKEGDINQIYECVDNISIDYGIMEKSDKVAVVRLDHKWSDLGNFAAIYDELEKDSVGNVIHDCDPMLLNSDGNLVYSRCGKIVSLIDVKDMVVVDTSDALLICPKSSSQKVKEIVSELKGRKDERAFIGQTVYRPWGSYTLLDASPGHKIKNITVLSDHKLSLQLHYHRSEHWVVVKGMACVEVDGKQFFLGPGESTFIRAGQKHRLSNPGKLPLEIIEVQLGELVDEEDIVRFDDVYGRR

SEQ ID NO: 15098 - protein, 469 aa, Methanosarcina mazei Go1
MQELHGEKTGKAKKERTPMPEQPAGERRKNFNEVALGYTKEDALAEASRCLACKEPKCVEGCPVNVDIPGFIQLICEENFEGAIERIKATNALPAICGRVCPQESQCEAHCVLGKKGQPVAIGRLERFCADYEREKGVKSPQVMPPTGKRVAVVGSGPAGLTAAADLAKLGHKVTIFESLHKAGGVLSYGIPEFRLPKEIVRQEIEYIEKLGVEVRPNYIIGRIKTLDELCDDFDAVFLGTGAGLPSFMGIEGENLNGVYSANEFLTRVNLMKAYDPEYDTTVRRGKNVVVVGGGNVAMDAARSALRLGADEVSIVYRRGEDEMPARREEIEHAKEEGITFRLLTNPVRILGDEKFNVTGVECIRMELGEPDKSGRRSPVPVEGSEFLVPADVVVIAIGTSPNPIIFKGSEGLEQNKRGTVVADEETGATSKCGVFAGGDVVTGAATVISAMGAGKKAAKAIDEYLKEK

SEQ ID NO: 15099 - protein, 477 aa, Methanosarcina mazei Go1
MEIPDHKTKIVCTIGPASSSEEMIRKLMLAGMNVARINFSHGDFESHSRVVRIIRKVADELGRTIAILADLPGPKIRIGKLEKEPVMLHKGNPITLTIDDTPGNEERIPVSYKQLPESVTPGSLIYLSDGFIQLLCKEVTGKDVLCEVLIGGELYSHKGLNLPGAKIFLDAVTEKDFRILEFALEEDIDTFSISFVENAEDIRKVRNFAASRGKQVNIVSKIERRQAVENIGEILDETDALMVARGDLGVEIPIQEVPSVQKELIQRAKLLGVPVITATHMLASMTDNIRPTRAEATDVANAILDGTDAVMLSEETAVGNYPVEAVEMMAKIAKTTENWRSRTKWGLDTMIKSITAREMSVDEVITLQVYEALQKLPVAAVLTPTRSGATPRRISRFNPDPWILAFSRVPKTCRFLSLSYGVYPVAVNESIESWEKETTERTKELGFAKSKDLVIFTQGPASGKPGGTNMLKILTLD

SEQ ID NO: 15100 - protein, 479 aa, Methanosarcina mazei Go1
MVAMKMQINGKAAGSCGGECFDVRNPATCELLEQVPRGTEEDVALAVEAALSAFEGWASISPQQRGMVFYRAAGLVRQRKEELAALLTQEQGKPLAEARNELEGFSHVLEYYCGLAGSLRGDFIPVTGNGYSFTVKKPLGVCAAIIPWNMPALIMGWKIAPALISGNTFVLKPASSTPLTNLTLASILNEAGLPAGVLNVVTGSGEIAGESLVRSPDVRKISFTGESGTGKRISELAASGMKRVTLELGGSDPMIVCDDANLESAVAGAIRGRFYNCGQTCTAVKRLYVFESVAREFIRKLEEGVKRLKVGNGLDKDTDMGPLNNHSQFEYIKELVAGIEEKGEGRIIAGGKAPSFKGMGKGYFFEPTLVSDVPGDSRLLKEEVFGPLLPIVTVRNLDEAIEEANRSIYGLGASIWTKDLDRIRMGCEQLNAGIIWVNQHLKVAPEVPFGGVKESGFGRENGPDILSEYLETRTIMLKT

SEQ ID NO: 15101 - protein, 360 aa, Methanosarcina mazei Go1
MEKEYDIIIIGTGTAGRTLAGRAESSGMKFAIIDSREYGGTCPLRGCDPKKVLAGASEATDLNNRLIGKGAGTEEPLKIDWPSLIRFKRTFTEVYPREAEKMFADMGIDMYHGRARFKNENTVIVGNDELKGKFIFLATGSKPRKLKIPGEEYLTTSEEFMELMELPEKIIFAGGGYISFEFTHIARRAGAEVLILHRSERPLGTFDPDLVDMLVRASEESGIKILTNRPVVAVEKAGDGFLVRTEYKTETGSEVQVFNADMVVNGAGRVPDIEDLQLENAGVRAEKKGIIVDKHMRTSNPRVYAGGDCTAEGIQLTPVATLQGEVAAANIFDRNGAEADYTGIPSAVFTHPCACFRWNK

SEQ ID NO: 15102 - protein, 291 aa, Methanosarcina mazei Go1
MFLPNSFIDALADYESARYVIFGVPFDNTSSYRAGSRWAPDAMRQVSANFESYNPVFDIDLVDLPIYDAGNLETSASVDETLRDLYEEVKALLNNGKLPIMLGGEHSLTYSTVKACAEFAGDDFGVLILDAHFDLREEYRGFKHNHACVSRNILENITDNLVSIGIRSGPEEEWIFARENKLKYYTADDVESIGMVEVLKEAIESLDCSQLYLSLDMDAIDPAYAPGLGTPEPFGLSARDVRTAIRTLAPYSMAFDVVEIAPEYDSGQTAMLGAKLMREFIASHAKSCIKK

SEQ ID NO: 15103 - protein, 234 aa, Methanosarcina mazei Go1
MNINENSLPDDKSPIVEVSNVRKSYMLGKMEVPVLSNISLRIEKGEFLAIVGPSGSGKSTLMNLIGCLDRPTEGQVLIKGRDLDGMSDEELARLRGLEIGFVFQTFNLVPRLTAFENVLLPTFANSRSTDPQKRAKELLSIMGLKDRMRHRPGELSGGQSQRVSIARALINDPSILLADEPTGNLDSKTGFEILNIFMDLNKDGRTVVIVTHDPEIAKFADRVILVKDGTIQYN

SEQ ID NO: 15104 - protein, 469 aa, Methanosarcina mazei Go1
MSKNVQKIEKLLIVICMIFIVLPSPALAVTAEENAEAIEGLQTTLTFLWLLIASGLVFFMHAGFSLVETGLTRSKNTANILMKNFMTVVLGILVYWAVGWGVMYGADAAGLIGTDQFFLAGADNATWNSWFFQMVFAATGATIVSGAMAERTNFKAYLVYCVLMVAVIYPIYGHWVWSGADTALLSGADSPIVKAIGVAHHDFAGSGVVHSIGGYSALAGVLLVGARIGKFRDGKAIPIPGHNLTIAFLGTLILALGWLGFNGGSTLNANDPYMNLVVVNTFLAGAVGAVTTMAITWMKTGKPDPSLTANGLLGGLVAVTAPCGSISNWGAIAIGIIAGIIIYAGVMFNENKLKLDDPVGAIAVHGYCGTWGLISVGLFSIGIGNGILADASYAAAVPGLFYGGGVSLLLIQLVAVLITIVWGFGLSFIIFKILDAVIGLRVSEEEEIMGLDICEHGIRAYPEYLMREE

SEQ ID NO: 15105 - protein, 447 aa, Methanosarcina mazei Go1
MVQMKKCTTKEDVLEAVKERDVKFIRTQFTDTLGIIKSWAIPAEQLEEAFENGVMFDGSSIQGFTRIEESDMKLALDPSTFRILPWRPATGAVARILGDVYLPDGNPFKGDPRYVLKTAIKEAEKMGFSMNVGPELEFFLFKLDANGNPTTELTDQGGYFDFAPLDRAQDVRRDIDYALEHMGFQIEASHHEVAPSQHEIDFRFGDVLCTADNVVTFKYVVKSIAYHKGYYASFMPKPLFGVNGSGMHSNQSLFKDGKNVFYDPDTPTKLSQDAMYYIGGLLKHIREFTAVTNPVVNSYKRLVPGYEAPVYISWSAQNRSSLIRIPATRGNGTRIELRCPDPACNPYLAFALMLRAGLEGIKNKIDPGEPTNVNIFHLSDKEREERGIRSLPADLKEAIDEMKGSKFVKEALGEHVFSHYLCAKEMEWDEYKAVVHPWELSRYLSML

SEQ ID NO: 15106 - protein, 263 aa, Methanosarcina mazei Go1
MINAAVLGACGRMGSLIIENITCSTDMQLVAAFDIGNIGKDAGEFAHVGNLGIQISDVKDLETVLKKTQADVLIDFTAAGATIVNAPIAAGCGVNLIIGTTGITSEQRAVIEEAIRKNQVRAVISPNYSVGVNVFFKIVREAAKYLADYDIEIIEAHHNQKKDAPSGTALRAADVISEALGGKEYVYGREGIAPRGKEIGIHAVRGGDITGDHTVLFVGNSERVEIHHMAHSRQIFAKGAVRAAEWICGQEPGIYSMDDVLGL

SEQ ID NO: 15107 - protein, 409 aa, Methanosarcina mazei Go1
MEIAKEAVAGGADWIEIGTPLIKSEGMNAIRTMRKAFPDRTILADMKTVDTGAMEVEMAAKAGADVAIVLGSADDSTILDALRSAHKYGVRLMADLISAPDPVKRAVELEALGVDYINVHVGIDQQMIGKDPVSILMEISEKVGVQLAVAGGLDSESAAQAVRAGARIVIVGGNITRSDNVTEAAKKIRKSVDSPESVDIRDRGTVDQEIREIFKEVSTSNISDAMHRKGAMKGIHPLVRGKMVGPAVTVQCFPGDWAKTVEAIDLAKPGDVIVIYNESKDIACWGGLATLSSLNKGIAGVVIEGAVRDIDEVENLGLPIYTSNTVPNAGDPKGFGEINAEITCGSQAVKPGDYIIGDESGVVVVPKERAYELARRAKEVNKEEKRLFDEIRRGGTLSEILKLKKWEKI

SEQ ID NO: 15108 - protein, 493 aa, Methanosarcina mazei Go1
MKSMGSNSGAKGTEGGSSRTEGEIQENISENASSNSRTEKEFAKVVIIGGGACGMATATKIRRQSDFDITVLSWDSHTAYSHCGIPFVLGKEIESLKKLIVKPLAFFRENKINVKLNEKVTSIDLNGQVVITGEGTYPFDRLVIATGSLPFIPRESRANILPYGIFTLRSLADGMLFEKALETARTVCIIGGGTIGIECASALTKRGIRTTLITRGNDLLTRQFDSDMSAIVREHLESLGVEVITGESVILPENFWKQKTLILRDRQLPADLVLLATGVKPETWLSRETGITIGKAGGIIVNEMLQVKAGEKFLSHVYAGGECAEVIDLITGESRLSQLGTTARSMADVIGNNITGKHSTFGPLADPWVAVAGDLQFGGVGLTSGQAEKQGIKTVTGFSRGRTRASYYPGRKDLYIKLLFKNNCLAGAQLAGGEGIKERIDALSLAIRKEATIKDLLNLETCYAPPVSTLVDPLTPAVKAAARNMRKIKGKGN

SEQ ID NO: 15109 - protein, 395 aa, Methanosarcina mazei Go1
MTDKIINSGNLEAGYDSVIDKDSKYVMQTYGRQPLVLSKGKGAVVQDIYGKEYIDCVAGIAVNNVGHCHPTVVKAIQAQAEKLIHVSNLYYTEIQAEFAETLASITGMECVFFCNSGAEAVEAAMKLARVATGKSAFVAAEHSFHGRTIGALSVTHKSMYRDPFMPPVSSKTSFVPYSDADAIRKAISEDTAAVVLEPIQGEGGVNVPDPGYLKEVREICDETGTLLIFDEVQTGFGRTGTWFCKEQFGVEPDIMSMAKAIGGGFPMGAIAARSGLSFGRGQHASTFGGGPLACAAALASIQAIKEEKLLERSKEMGAYFTKKLSGMARDDIVEVRGKGLMIGVEIKYPCGKFVDFAREHGVLVNCTSDSVLRLVPPLVITKEQIDSVVDVLEQA

SEQ ID NO: 15110 - protein, 468 aa, Methanosarcina mazei Go1
MSEHNEAANLVKTLRPFHIWALGVGIVLVGEYMGWNFTVAKGGILGSLLAMLVAGTMYVIIALCASELGSATKLAGGPYDWARLFVGPGAAASVGLAVYMEYIALEAADAIVVAFIAQSIFPELQVFPVTLLVIALLTFINYRGVVAALTLNFVLTMIAFIAIVVFFFATAFGGVNIHPEYLFQGALPNGMIGLFAALQFGPWFYLGIEGAAMCAEECKHPSRAVPLGQQAGMITLLVGAAMTLYLCSVLIPTDLLGVSVYPLFEAAQNSGIFIFIALLGLGTFLTCVASANGCVCDSSRSWFALSRDKYVSSWFSAVHPRYNTPYRAVIFTMPVAIGFAFSGFLDQVITFSIVSGLLCYVLIPFSLIRFRNLFPQTTSKVRPFAGPLQPYIAYFAIAIAITILSTLFWGYKYNLIFAFVFYGIAYFYFSHRHKNSNIENNWAEMGWPLPNGSENGRIGKEAVGFGDE

SEQ ID NO: 15111 - protein, 353 aa, Methanosarcina mazei Go1
MHIVELEEIYKNYGKLEVLKNINLQIEKGTSTALVGPTGSGKTVMLRLIDLLEKPSSGTVYFEGADANESNNTRLEVRRQIGMVFQKPLAFKASVYDNIAYGLKIRGRKENMDGRIKELLEMIGLPGYENRNALKLSGGETQRLALARAMITEPRLLLLDEPTANLDPISKKKLEELILKINRESETTIIMTTHDLLQGQRLAENMVILYNGQILQSGTPDQIFRKPKNRFVADFVGIQNLMSGIIEDSSNGLAAIKTDSITVFAVTEKEGKVHFAIRPDEITISREKVQTSARNTIQGKVDEIIDTGSLIKLTVNTGELFTVFITRESLNELNISIGTSIWLYFKASAVHVF

SEQ ID NO: 15112 - protein, 336 aa, Methanosarcina mazei Go1
MKVNTWFGVLELDSNGKTLSSEVFPKDIRELALRSLSLRESRQNLPPEGFDLKTAALECGFTESLSEYYSLLHKVTLETVKLQVSQALTPDQRIIQAVEALDDINETTNSLSERLFEWYGGYFPESGLSGEELAVFISRYGSRENLPPEDPHYLKAKNSMGAKLEAADEVLLKGLAESVCSLYERRKQIEAYIESSMEILAPNLALLAGPMLGARLISIAGSLEKLAAFPSSTIQVIGASKALFKHLRSRAPSPKHGIIYSHPLINTSPWWVRGKVARALAAKLSLAARIDFYSAKRNPSLENELEEKIRKIRAENPRPPQKRQEIRAKPKKKRRK

SEQ ID NO: 15113 - protein, 227 aa, Methanosarcina mazei Go1
MPEIRQLSEGIFEVTKDKKQLSTLNLDPGKVVYGEKLISVEGDEYRTWDPRRSKLGAMVLKKFDIPLKRNSKVLYLGAASGTTVSHVSDIVSEGAVYSVEFAPRSMRDFIGLASRRKNIFPILADAGKPDSYAHIVEPVDVIFQDVAQPNQAEIAARNAVRFLKKDGYLLLSIKARSIDTAASPKEIFKEEVKKLEQAFEPGFEVLTARELMPYHEDHLGVMARLKK

SEQ ID NO: 15114 - protein, 424 aa, Methanosarcina mazei Go1
MVSEITLEKSRQMYEKAKTLIPGGVSSPVRAIKPYPFYTASANGSKIRDLDGNEYIDYCLAYGPAILGHNHPVIKEAIRQQLDRGWLYGTPTELEVTLAEKVASYYPSIDMLRFVSTGTEATMSALRLARGFTRRNKFIKIEGGFHGAHDAVLVKAGSGATTLGEPDSLGIPADFTKHTLQAPYNDIETMTSLVEKNRDDLAAVIIEPVLGNIGPVLPLPGYLEELRKLTEENDVLLIFDEVITGFRLAMGGAQEYFGVVPDMTTLGKIVGGGLPIGVFGGKREIMEMIAPSGAVYQAGTFSGSPCSVAAGIAMVDYLNEENIHAKLNSAGDYMRAALSEIVEDEGLDYHVCGIASMFKIFFGDEPHNYQEVLKCDKEGYLAFFHRMLASGVFLPPSQFETNFISAVHSDEDIEKTLEAYSENL

SEQ ID NO: 15115 - protein, 240 aa, Methanosarcina mazei Go1
MIEVNNLHKSFGNLKVLKGISEKIRESEVVCVIGPSGSGKSTFLRCLNLLETPTSGEIWIDGVKITDQGANINKIREEVGMVFQRFNLFPHMTALKNVALAPIKVRGLPEKEAYDRAYDLLKKVGLEDKADVYPGSLSGGQQQRVAIARALAMRPKVMLFDEPTSALDPEMVGEVLNVMKDLAKEGMTMIVVTHEMGFAREVGDRVLFMDDGIIVEKGTPQEIFFNAQNERTKSFLSKIL

SEQ ID NO: 15116 - protein, 375 aa, Methanosarcina mazei Go1
MLYRRLGRTDEKVSILGFGTMRLPVIGGDDTRVDEEKSIEMIRYAIDSGVNYIDTAYPYHGGMSESVLGKALEDGYRDKVYIATKLPSWLVASRKDMDRYLNEQLERLKTDSIDFYLAHALNSDFWDLVKKHGIFDFLDSALEDGRIKYTGFSFHDSPELFKEIVDSYPWTLCQIQYNFMDENFQAGKDGLMYAASKGLGIVIMEPMRGGYLVSGMPPEIQEIWDSADIQRSPVEWSLRYLWDYPEIAVVLSGMSEIKHVEDNVKFASGGLPDSLTERERELISRVKKIYMSKTRVNCTGCRYCMPCPSGVNIPENFKYLNNAEMFDNAEGEKALYSGLEGQASNCTECGQCEEKCPQKIPVSQMLKEVVKLFGK

SEQ ID NO: 15117 - protein, 120 aa, Methanosarcina mazei Go1
MIDFGNLKYENGLIIGIVQDRASKEVLMCAYMNREALEKTVETGIAHFWSRSRQKLWKKGETSGHLQKVKEIRIDCDMDSVLLLVEQVGGACHMGYRSCFYRNLDGEVVGEKVFEPEDVY

SEQ ID NO: 15118 - protein, 215 aa, Methanosarcina mazei Go1
MNIILFGPPGAGKGTQAKKLVDFYGIPQISTGDILRANVREGTELGLAAKAYMDKGELVPDNVLIGIIKNRLNEEDCKKGFILDGYPRTVPQADALETILDEIDKPIDVVLNLEVPDEVLVERISGRLMCKCGASYHTIANPPKKDNICDICGGEVYQRDDDKAEAVQNRLDVYKKQTQPLINYYEEKGILVTLDGTKDINVVFEDIKAVLAKFA

SEQ ID NO: 15119 - protein, 500 aa, Methanosarcina mazei Go1
MKYISSLRMKAIDRNCAYLGLLPLQLMENAGAAVARSVKEKLGNGKVLFVAGRGNNGGDAFVAARHLAGIPGYAVRVILLGKGSDIGSEEAFHNFSLLRFSRVKTLEIRDSNQLTASEWFSEADLLVDAVFGTGVKGKIKEPESTAIELINKEGKAGKTVIAVDIPSGLDPEGGDFDKAVYADLTVTFHRMKAGLLTEKAKEYTGTIKVEEIGVCADAEHYVGPGDLQMLRKRKFDAHKGNAGRILIIGGGPYSGAPALAALAALKTGADLVTAAVPESVARTVASYSPDLIVRKLSSNVLCPEDMSTLPDLINSHDVVVMGMGLGRATETLETVRKILPFCRKMVLDADALSALSGVLFETLAGNCEIIVTPHGGEFALLRGVETPEDHDAREKAVREFSEEKGVVTLLKGKTDIISDGKQTLLNRTGNPGMTVGGTGDVLAGITGALFSRNPAFLSAACAAFINGSAGDLAFEKSGNALLATDVLEKIPEIIREAGIG

SEQ ID NO: 15120 - protein, 365 aa, Methanosarcina mazei Go1
MIFDPTTVCNMELQNRFVRSATHEFMAEKDGTPTSRLGDLYEELARSEVGLIVTGYSCIHPCGWSDANQQGIYDDRFIEPYRRITERVHKYRSRIVLQIVHGGRQADVSQKNPVPIAPSAVKDGHSATVPKEMTEEEILIVIEAFTQAAVRAKKAGFDGVQLHCAHGFLLSNFISPYTNRRTDRWGGSVENRARIVTEIVRRIKEETGSNFPIFVKMNATDGFQPGTAKAELGLTISQAMETAKLLEKAGVCAIEVSGGISEAGGVTIKTAINSPSKEAYFKEYSKNIKSAVSIPVILVGGIRSLSVMEGLLENGFADLISMSRAFISEPDLILKLKSGEAEKARCVSCNLCFDPEGIRCNFEFD

SEQ ID NO: 15121 - protein, 237 aa, Methanosarcina mazei Go1
MENTVSIRKLSKVFGKNPVLKSLDLDLEKGEFAVIFGPNGAGKTTLLKLISTLTTPTEGSVFVSGFNVVEEPEKARREIGLLSHESYLYGELSAKENLRFFGQMYGIKGQKLEERISSILEDTGLVAKTDERVSTFSRGMKQRLSIARTLLHRPSILLLDEPYTGLDPGASLVFENLIKSPEFQKSTKLMVSHDLERGFKLSSRLLILNKGKFVYDGIKKDFSGYEDFKEKCSSMLA

SEQ ID NO: 15122 - protein, 389 aa, Methanosarcina mazei Go1
MTFPMYSDRINALPPYLFAAIDEARDELIAKGVDVIDLGVGDPDLPTHPHIVEAMQKAVCDPGTHQYPSYAGMPEFRKAAAEWCRKYKGIEIDPATEVLSLIGSKEAVAHIPLAFVNPGDVVLYTEPGYPVYKIGTLFAGGEPYPLPLKAENSFLPDLDSIPEDVLKKSRLFFFNYPNNPTAATADMAFFEKVVKFCKKHDIIAVHDNAYCQMAYDGYEAPSFLAAEGAMDIGMELYSHSKTYNMTGWRLGFAVGNKDLIKGLGKVKSNVDSGVFDAIQIAGIAALSSPQDCVNETNKIYEERRNALIEGLTAMGLEVKPPKATFYIWAPVPKGFTSISFAKLLLEEAGIVATPGVGFGDAGEGYIRFALTKPVERIKEAVERMKKLQL

SEQ ID NO: 15123 - protein, 271 aa, Methanosarcina mazei Go1
MKTELKAVLKRPKISEKFDELREKKEGALIGYVMAGDPTFEASSEVVKALAKGGADIIELGFPFSDPVADGPTIQVAGQRALAEGMDIERYFAFARALEVDVPLVCMTYYNPVFRYGVEKFVENAAEAGISGLIIPDIPVEEAADLKTGCDAHGLDLIFLVAPTTTEARIRKILQRGSGFIYLVSRLGVTGARDDVAGSTKELLSRVNTDIPKAVGFGISTGEQAAEVRKAGADGVIVGSAFVRIIEEGTDVNERLETLARELKSGMLEAN

SEQ ID NO: 15124 - protein, 428 aa, Methanosarcina mazei Go1
MSYIGLQQDSGEYKIQKIHAREILDSRGNPTVEVDVFTPKGFGRASVPSGASTGTNEALELRDADPNRYGGKGVLTAVKNVNTIIQKELLGLDVRNQREIDELMIELDETENKSNLGANAILGVSMAVAKAAADSLNIPLYRYFGGSNAFTLPVPTMNVLNGGKHAGNELAIQEFMIQPKGAETFYEALQIGAEIYQTLGKFLENKYGRSSTNVGYEGGYAPKMGESTEALDALVHAIEEAGYTESEVTIGLDAAATEFYEEEFYNIDGKKLAAPELLDYYVELVNSYPILSIEDPFYEEAFEDFEALTNELWDTIIVGDDLFVTNIERLSKGVDMGAANALLLKVNQIGSISEAFDAASMASRNGYTVIVSHRSAETEDTTISDLAVAIGAEMIKTGAPARGERTAKYNQLLRIEEDLGEVAHYVQL

SEQ ID NO: 15125 - protein, 446 aa, Methanosarcina mazei Go1
MLSPIAWSTPPKKYGPWEAMVSLLTEGLVKRGIDVTLFATADSHTSGKLHAVCPRPYEEDKNIHVKVYECLHISEVFERADEFDIIHNHFDYLPLTYSRLVDTPVVTTVHGISSRRILPVYKKYNNSTFYVSISDAYRCDELEYIATVHHGIDTGSFPFNESPEDYLLYISRIHRDKGTKEAIEVAKRTGMRLKIAGFIADPEYFENEVAPHIDSEQIIYEGHVSHQHKKDLLSHARALLHMINYEEAFGLGVVEALTCGTPVIAINKGAMPELIIDGETGFLVNGVEEAVDAVQKLGSISRKKCRESVEIRFSVERMVEDYIKVYETILEKYRREEKRPWGFYEILTEKPGYKVKRITVLPQEEISLQRHAHRQEHWYIVSGEGLVTKNTDQIRVFSGDSVDLGVKEIHRVKNTGGQNLVFIEIAQGDYLGEDDIERFEDKYGRA

SEQ ID NO: 15126 - protein, 241 aa, Methanosarcina mazei Go1
MIITGHLILVRHGEPGLKPGERLSGWIDIPLSRKGIEEALECAKALENIEIDIAFASDLVRTQETLFIILSGQKKTGVVVHEKTEDKVPPEKLDWYSYPEKLGEDLIPVYTTPALNERYYGKLQGRKKQKMEEKYGAEQVANWRWNFEPGPPEGESLKAVYERTVPYFRKKVMPALEGGKNVLICAHQSSLRALVKYIEDISDKDIREVRLSTGELAIYHFSEGKLVRENEELGPELKRNI

SEQ ID NO: 15127 - protein, 394 aa, Methanosarcina mazei Go1
MERKFKFATQCVHAGEKPDPVFGAHTTPIFQTSTFIFDSVEQGASRFAEEEDGYVYTRIPPNTPTHAVLSEKFAALEGGEAGQTFASGMAAITAVALTALKKGDHLVSTDVVYGCTYSLFSEILPGLGIDVTFVDTTDAENVRKVLRPETKMVFLETPANPTLNVCDIRMISGLAKAQGAICVVDNTFSTPYFQKPLLLGADISLSSCTKYIGGHADLLGGIIVCDKAFLKNLAKVAGYTGGTMGLHEAWLCIRGLKTLHIRMERHAENALKVANFLESHPAVEWVRYPGLSSHPQHEIAKKQMSGYGGMLSFGVKDGIDAGSKLMNSVRLCSLAVSLGATDTLIQHPASMTHACVPKEVRGKVGITDGLVRLSIGIEDPEDIIADLKQALEKI

SEQ ID NO: 15128 - protein, 314 aa, Methanosarcina mazei Go1
MKKEWKGEKGAIKPIRALTFGEALFDTIKGTAHLGGAPLNLAAHLAKLGARTAVLTAVGKDELGKILLSRAEEMGVDTSYILIDEKRPTGTVTVELKYEGIPVFSINEGVAWDVITPDEKQFEALAGDEWDVFCFGTLAQRSEENRKTLKRLFQEIKTKHFFYDVNLRAEYYTEEWILSSLEHCTILKMNEEEAEAISGMLFDTIYKFRTLCRLLTDRYPEMSVICITKGPDGAAVYHDGVYEEVSASPIEVADTVGAGDAFSAGFLYAYLSGNGASKALSIATTLGTYVASKPGAVPEYSEELIEELKRYNKT

SEQ ID NO: 15129 - protein, 377 aa, Methanosarcina mazei Go1
MLYRKLGKTGEMVSILGYGCMRLPVIDGNPESIDEKKAIRLVRYAIDHGVNYIDSAYSYHSGMNEVFLGKALKDGYREKVHLATKLSCKRVNCKEDMDRFLNEQLEKLRTDCIDFYLLHAVKQSYWEKMKKFGVIDFLERARAAGKIKYTGFSFHDEPDVFKEVVDAYPWDLCQIQFNYLDENFQAGIEGLKYAAEKGLAVVIMEPLRGGNLASKVPEEAKKVWDIAEVKRTPAEWAFRYLWDYPEISVVLSGMSEMEHLKENLRIAEQGQPNSLSAEEKSLISEVSEIYRSRIKVNCTNCKYCMPCPSGVNIPRNLSYLNDVFMLDDMENAKFQYGVLLLPEEKAGNCIECGECEEVCPQNIKIRKMLKEVREKFE

SEQ ID NO: 15130 - protein, 506 aa, Methanosarcina mazei Go1
MKTSSVELNPNRLVQYLKKPASEFTKDDIIKFVKDNGIKMLTFRYVGGDSRLKALSFIIRNEEHLDNVLSTGERVDGSSLFKYIEADSSDLYVVPKYRTAFVNPFEEIPTLDLLCSYFDKDGNPLASSAENIMKKAHAVLKEETGYELNAMAELEYYIISDKEMIDTDFPAVDQRGYHEAGPFTKFDQLRKDAMLAIAEAGGTIKYGHSEVGNFTDDKYYYEQNEIEFETTSLEDAADRLLIGKWILRMLAAQYGVSVSYAPKITVGKAGSGLHIHMKLLKDGKTATVENGGKLTDAAKKAIVGCLDIAGSITAFGNTIPTSYLRLVPHQEAPTNICWGDRNRSALIRVPLGWSGEASKMITIANPNYSEELKEHYYKQTYEFRAADGSADIYLLLAGLCVGTRHGLQMDNSLELADKLYINVNIFKEEHKDRLAQLEHLPASCYESAQALKKQKDIFMQYDVFTEGMLDGIISNLESYNDYQLSEKLYGKNEEIRKLVDNYIHIG

SEQ ID NO: 15131 - protein, 487 aa, Methanosarcina mazei Go1
MRGIRMKDYDLIVIGTGSGMNYVNSIIDSNPKMKIAVIDKDEPGGICLTRGCIPSKLLLYPAELVRDLETAPLFGIKLEIKDIEFRTIMERMRKRIGEDIEMIRQGLTENDYLDYYPETAEFISPYTLKAGDEILHSEMIFLCTGSKPAVPPVRGLEEAGYLTSDTVLGLNECPKSLAILGGSYIGAEYGHFFSAMGAEVTVIGRNQHFLPQEEPEVSELARIKMSEYMRILTNHEAIEVRKEKGGQKTVIAKDRDSGEETEVTADEILVATGRAPNNDILHPEKAGIKTDPHGWILVNEYLETSQPNIWAFGDANGKYLLKHVGNYESGIVYLNAIMQEKVKVDYHAVPHAVFSYPEIAGVGMSEKEAIEEFGEKRVIIGFKLFEDTAKGSAMETRDYFVKVILDGLEDKILGAHIIGPHASVLIHQIIPLMYTASRSAKPMMQMMDIHPALSEVVKRAFYSRLSPEHYHHVMKHLGLEDEDSVEG

SEQ ID NO: 15132 - protein, 352 aa, Xanthomonas campestris pv. campestris str. ATCC 33913
MSKAHAYAAQTADQPLAPFVFERRAPGPDDVQIDIAYCGVCHSDLHTARNEWHNTVYPSVPGHEIVGRVTAVGSAVTNFKVGDLAGVGCMVDSCRSCASCQEGEEQYCEQGFTGTYNGPMFGGGENTYGGYSDHIVVDQKYVLHISHSDNLAAVAPLLCAGITTYSPLAHWKVGPGQKVGVVGLGGLGHMAVKIAKAMGATVVLFTTSESKRADALRLGASEVVISKDEAQMAAQYNTLDFILNTVAAPHNLDPFLNALKRDGAMVLVGVPEHSHPSPAVFNLVMKRRTLAGSLIGGIRQTQEMLDFCAKHNIVSDIETIRADQINEAYERMLKGDVKYRFVIDMDTLAKAA

SEQ ID NO: 15133 - protein, 493 aa, Xanthomonas campestris pv. campestris str. ATCC 33913
MSRKQAFQFLDLPRTMPTRIPVELRTSGDWGELYGKFDKADAQYQSGRCLDCGNPYCSWKCPVHNAIPQWLQLVQEDRIIEAAALCHSTNPLPEVCGRVCPQDRLCEGSCTLEEFGAVTIGAVEKYIVDTAFSMGWRPDLGNVQPSGHRVAVVGAGPAGLSCADRLVRAGIEAVVYDRYEQIGGLLQFGIPSFKLDKSVIGKRREILEGMGVQFRLGVEIGKDVSIEQLLGEYDAVFLGTGAYRYTDGGLDGQDLKNVLPALPFLVQNSRIVSGNDPHGRPIAGWEDQIALPDLNGKRVVVLGGGDTGMDCVRSAIRLGAAKVTCAYRRDESSMPGSAREVANAREEGVRFLFNRQPLSIESGADDEAIGVTVVETKLGEPDASGRRNAVPVEGSESLLEADVVIIAFGFSPTVPEWLSSQGVEAGSNGRIVAPAEGNGRLPYQTSNPRLFAGGDCVRGADLVVTAVAEGRDAAGSIVQLLGVKAQVKEPAAA

SEQ ID NO: 15134 - protein, 509 aa, Xanthomonas campestris pv. campestris str. ATCC 33913
MNALPSAKSLNTDPQSIFKPRYDNFIGGAWVAPQGGQYFDNTTPITGKVFTSIARSTAPDIEAALDAAHAAKEAWGKTSTTDRSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMEVIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDTFMEKALKRVAAIKQGNPLDPNTMVGAQASSEQLEKILSYIDIGKQEGAEILIGGERNMLDGELSDGFYVKPTVFKGHNKMRVFQEEIFGPVVSVTTFKDEAEALAIANDTLYGLGAGVWSRDASRLYRMGRAIQAGRVWTNCYHAYPAHAAFGGYKQSGIGRENHKMMLDHYQQTKNLLVSYSPKALGFF

SEQ ID NO: 15135 - protein, 1116 aa, Xanthomonas campestris pv. campestris str. ATCC 33913
MNAVPALQADAEQSAVVADQLWYKDAIIYQVHVKSFFDSNDDGIGDFPGLISKLDYIAELGVDTIWLLPFYPSPRRDDGYDIAEYMAVHPDYGTIADFEQLVAQAHARGIRIVTELVINHTSDQHPWFQRARNAPAGSPERDFYVWSDTDQEYEGTRIIFCDTEKSNWTWDPVAGQYFWHRFYSHQPDLNFDNPAVLESVLEVMRFWLDRGVDGLRLDAVPYLIERSGTSNENLPETHAILRKIRATLDAEYPDRMLLAEANMWPEDTQQYFGQNADECHMAFHFPLMPRMYMAIAREDRFPITDIMRQTPEIPETCQWAIFLRNHDELTLEMVTDSERDYLWQTYASDRRARINLGIRRRLAPLLERDRRRIELMTSLLLTMPGTPVLYYGDEIGMGDNIHLGDRDGVRTPMQWSIDRNGGFSRADPAALVLPPVMDPLYGFQAVNVEAQIRDQHSLLTWTRRVLSVRKRYQAFGRGTLRFLYPGNRRMLAYLRCYQDETVLCVANLSHTLQAVELDLSEFEGRVPVDIIGGGSFPPIGRLTYLLTVPPFGFYAFQLVSEGTLPDWHVPSPVPLPDYRTLVLRSDTEESAALLPHLATLEGEILPAWLSARRWFSAKDQALKSVRISRRTPLPGDEPMSLLELDVELEDGHHECYMLPVGIVWEREHPSTLAEQLALARVRQGREVGYLTDAFALKPMVRGVIDALRHDAALDFHDGDDASQQGQVRFESTPALAALEIPDDPEIRWLSAEQSNSSLVVADKAVFKLLRHVATGANPEIEIGRRLTEMGYANAAPLLGSVSRVDAQGTITTIALLQGFIRNQGDAWRWTLDHLARSFDEYATAQTDEARNEAVAGYDAFAAVVGKRLAELHEALSRSTDDADFAPQRIDLPTANDVVGGVARQVEEMWETVHARLGATDDAAEREALESVLAERPQLDALLAKAPSVLAESLLTRVHGDFHLGQILVAFDDVVLIDFEGEPAKPLAERRAKASPLRDVAGFLRSLDYASEVSARGEEGTAARAGVGVDAHLDDFLVEFRRRSTQSFLDAYHAVLDASAHPWIAPAAFNAATLLFLVEKACYEVRYEAANRPGWLMVPIQGLRRILQRARAGAGDT

SEQ ID NO: 15136 - protein, 437 aa, Xanthomonas campestris pv. campestris str. ATCC 33913
MRWPNFALAANGSNVRTELLAGATTFLTMAYIVFVNPDILATTGMDHGAVFVATCLAAAFGSAVMGLLANYPIGMAPGMGLNAFFAFSVVGTLGYSWQQTLGLVFVSGCVFLLLTLTGARRWLVDGIPTTLRSAIAAGIGLFLAVIGLQKAGLVVAHPQTLITLGDLHRPEPLLALAGLLLIGVLELRRVRGAMLLGILAVTAAALALGLVQYRGVIALPPSLAPTLLKLDIAGALQGHAGEGALTAVLHVVLVFVLVEMFDATGTLMGVAQRAGLLRTTAQRRQFDRALLADSSAILAGSLLGTSSTTAYVESAAGVQVGGRTGLTALVVAALFLLALLFSPLAAMVPAYATAPALLYLAAVMLRECAHLQWDDVGEALPAAMCMLAMPFTYSIANGLALGFITYAVLRLGSGRWREVHPATWAIAGLFVLRYALE

SEQ ID NO: 15137 - protein, 365 aa, Xanthomonas campestris pv. campestris str. ATCC 33913
MSQLFTPINFGPLALANRIVIAPMCQYSAQDGRATDWHRIHLGTLSQSGAALLILEAAAVQPQGRISYADLGLYDDATEQALGEVLASVRRWSPMPIGIQLAHAGRKASTDLPWKGGEAIAPDHANGWQTVSASALPFRDGQPLPQALDAAGIDAVVEAFVTAAKRAERLELQLIELHAAHGYLMHQFLSPLSNQRSDAYGGSLDNRMRLTLRIFDAVRAAVSDQMAIGVRISATDWVDGGWDLPQSIALSKALDARGAHYIHVSSGGLDPRQQIPVQASYQIPFAEAIRAQVDTPVIGVGLITEPQQAEAILRDGQADAIALARGILYDPRWPWHAAAALGASVTPAPQYQRCEPREARGVFAS

SEQ ID NO: 15138 - protein, 503 aa, Xanthomonas campestris pv. campestris str. ATCC 33913
MDPQPAGGSTMHALPSIATPTTATPAWHGCIFNGDWVPGSGGTLQIHEPATGGLLHEVGKADLSDVEAAIAQAKHAQRAWAITSPRERAAVFHRAAQLMEAHRAEATLLIARETGGIMPKAEREVSEAIAYYQQAAGLPLQAMGQVLPTAAGQLSLARHLPLGIIAVISPFNFPLILSLRSVAPALAMGNAVILKPDPRTPYTGGVIIAQVLEEAGLPKGLLHVLHGGADIGQALVEAPDVPMIAFTGSTAAGRRIGELAGRHLKKVALELGGNNAVIVLDDADLERAASAIAFGAYLHQGQICMATGRVLVQRGVADALTKLLADKARHLPVGDPVSGTVALGPIIGQRQLQRVLDIVDDSIDAGAVVEAGATHDGLFYAATVLSNVRPGMRVFDEEVFGPVINITVFDTDEEAAVLANHGEYGLVAGIMSASVSRAMVLGEQLHTGLLHINDQTVADEVINPFGGTGASGNGTSVGGPADWEQYMHWQWLTIKHAVPQYPF

SEQ ID NO: 15139 - protein, 274 aa, Xanthomonas campestris pv. campestris str. ATCC 33913
MSRQLVGELISEAVAMFIIIALGDSVAAMYILYDPSPYQNAYWGVCIAWGLAVTLAIYVTGSVSGTHANPAVTLALALFRDFSWKKVLPYWGAQVVGAFLGAAIVYQLYGPVIDHYNQVQQLTREAGGAAGVFFTAPGLAVTPMHALVDQIIITAFLIFGIFAITERFNEAAPTANSGALMIGLLVATLGASMGYLEAWAMNPARDFGPRLFAYFAGWGEAALPAKDNYWWIPIVGPLIGGPLGALAYQWLILPFLPARVLHLQKAATPPLDPP

SEQ ID NO: 15140 - protein, 322 aa, Xanthomonas campestris pv. campestris str. ATCC 33913
MEFDPDVVRLFVQLQQAGQPPMEALPLQEARAMMRGMGVQLGFPRLPMAQVTDLQADTAAGTVPLRLYRPPGLNDTPAPTCLFVHGGGGVVGDLDSHDDVCRQLAARTPCQVLAVDYRLAPKHPAPAGVEDVIATLHWLAEHADAVGADPQRLAICGDSIGGGMAAVAAITAQQRGIALRCQLLLYPLTDARPDTGVHPSRGRNAEIPPLTRSAVQFFNRLLLPDMRLADHWHISVLLAPDVAGVAPALVVLADRDILHDEGLQYAERLRTAGVEVTQRTCVGMIHGFITMGGVIRAAEETIELAALMLRQRLLPVQPRFAA

SEQ ID NO: 15141 - protein, 233 aa, Xanthomonas campestris pv. campestris str. ATCC 33913
MGLLHFPELPMQPTAIAPSILSADFARLGEEVDNVLKAGADWVHFDVMDNHYVPNLTIGPMVCQALRKHGITAPIDVHLMVEPVDRLVPDFADAGATTISFHPEASRHVHRTIQLIRSHGCQAGLVLNPATPVDILDWVLPELDLVLVMSVNPGFGGQAFIPSALDKLRAIRSKIDALGKPIRLEIDGGVKADNIGAIAAAGADTFVAGSAIFNAPDYSQIIAQMRAAVDAAR

SEQ ID NO: 15142 - protein, 205 aa, Xanthomonas campestris pv. campestris str. ATCC 33913
MIDPDGFRPNVGIVLMREDGQVFWARRVRRDGWQFPQGGMNTDETPVEAMYRELREETGLLPEHVELLGATPGWLRYRLPSRAVRRNERQVCIGQKQVWFLLQFTGQESHLKLDHTDSPEFDHWRWVDFWYPVEHVVMFKRGVYARALRHLAPLAQTVAGPAAVGVMPQRALEAWLPGSSAAGHDRPRKRPRKRGGVLPVRINND

SEQ ID NO: 15143 - protein, 367 aa, Xanthomonas campestris pv. campestris str. ATCC 33913
MSQRQWVAAAIQKIEADFNRSADTHLIPMDLPGYPGIDLYFKDESSHPTGSLKHRLARSLFLYALANGWLREGRPVIEASSGSTAVSEAYFARLLGVPFIAVMPASTSPEKIAAIAFQGGRCHLVERACDLDSASHQLARETGGHFMDQFTYAERATDWRANNNIAESIFKQLSEEPHPIPEWIVCSPGTGGTSATLGRYVRYRRHDTRILCADPEVSVFFDGYCRAVDGQCPKELAITGGSRIEGIGRPRVESSFIASCVDVMIKVPDALSLAAMRHVSATLGKRVGGSTGTNFVGVLQAAQRMRDEGRQGSIVTILCDAGERYAHSYYDPAWYVAREIDVDASDAAIAAAVAGAALPALPCAALE

SEQ ID NO: 15144 - protein, 456 aa, Xanthomonas campestris pv. campestris str. ATCC 33913
MAIHSSVLELIGNTPIVKAQRLDTGVCELFLKLEASNPGGSIKDRIGLSMIEAAEQRGDLKPGATLVEGTAGNTGLGLALVAQQKGYRLILVVPDKMSREKIFNLKAMGADVVLTRSDVAKGHPEYYQDLAAKIASETPGAYFINQFGNPDNPAAHEFGTGPEILAQMDGQLDAIVFGCGSSGTMTGLSRAFATASPQTELVLADPVGSILTQYIEEGTVSEKSGSWLVEGIGEDFLPDISDFSRVKKAYSISDAESFHTARELLAKEGILGGSSTGTLLAAALKYCREQTTPKRVLVFVCDTGNKYLSKMYNDYWMLDNGFLEREQHGDLRDLILRPYNKRDTVVVGPKDLLTTAYQRMKLYDVSQLPVIDNGELVGIVDESDVLLHVYGDEARFRDPISTAMVSKLDRLDVASPIEALLPVFDRGQVAIVMDGNQFLGLITRIDLLNYLRRRVQ

SEQ ID NO: 15145 - protein, 467 aa, Xanthomonas campestris pv. campestris str. ATCC 33913; identical to SEQ ID NO: 734

SEQ ID NO: 15146 - protein, 242 aa, Xanthomonas campestris pv. campestris str. ATCC 33913
MNQVARGAGAKRYADAKAALAGVVADGQTLAVGGFGLCGIPEALIAALRDSAVSGLTVISNNAGVDGFGLGQLLATRQIRKMISSYVGENKEFERQYLAGELELEFNPQGTLAERLRAGGAGIPAFYTATGYGTIVAYGKETREFDGKHYVLETALQADVALIKAWRADTAGNLVFRKTARNFNPACAMAGRVCIAEVEEIVELGAIDPDQVHLPGIYIDRLVLNATPEKRIEQRTVRQGDK

SEQ ID NO: 15147 - protein, 276 aa, Xanthomonas campestris pv. campestris str. ATCC 33913
MTNPESQITTPETDDDQLAISVRGLTNRFGSQVVHEELDLDVRRGEILGVVGGSGTGKSVLMRSILGLREPDAGSIQVLGADARSGRFVDRQHITRNTGVLFQDGALFSSMTVGENVQVPLKEHHGEFPERWYFELALLKIKLAGLPADALDKLPSQLSGGMRKRAGLARALALDPPLLFLDEPTAGLDPIGAAAFDRLIRTLQQALGLTVFLITHDLDTLYAICDRIAVLADRKVIANAPLAEIEQVDHPWIQEYFHGPRARAARQAKTASTETA

SEQ ID NO: 15148 - protein, 377 aa, Xanthomonas campestris pv. campestris str. ATCC 33913
MKPKFSTAAAASLFVGSLLVIGVASADPALEVATTGWATQNGGTKGGSKAAAANIYTVKNAAELKAALKASVGSNGRIIKISGVIDVSEGKAYSTTADMKSRARLDIPTKTTLIGITSNAEIREGYMYVKANDVIIRNITIENPWDPQPVWDPDDGSAGNWNSEYDGLTVEGASNVWVDHVTFTDGRRTDDQNGTANGRPKQHHDGAMDVKKGANYVTISYSVFKLHEKNDLIGSSDSASSTDSGKLKVTIHNTMFQDIAARAPRVRFGQVHLYNNYHVGSTSNKVYPFSHAHGVGKESKIFSERNAFEISGVSSCDKIAADYGGSVYRDQGSLLNGKALSCSWNTNIGWTPPYTYNLLSADKVAADVKAKAGAGKL

SEQ ID NO: 15149 - protein, 405 aa, Xanthomonas campestris pv. campestris str. ATCC 33913
MQCCHGERVAHATCHCITHSREFNTMSTASTVVGRTVVGVVLGAALLSGTAYAADPALEVATTGWATQNGGTKGGSKAAAADIYTVTNAAQLKAALKAKAGSNGRIIKIKGVIDISEGKAYTKTSDMKSRGRLDVPTKTSLIGVGTNAEIREGFFYVKANDVIVRNLTIENPWDPEPVWDADDGDAGNWNSEYDGLTVEGASNVWVDHVTFTDGRRTDDQNGTANGRPKQHHDGAMDVKKGANYVTISYSVFKSHEKNSLIGSSDSASSTDSGKLKVTIHNTLFQDIAARAPRVRFGQVHLYNNYHLGSTSNKVYPFSHAHGVGKESKIFSENNAFDISGVSSCTKIAGDYKGSVYRDQGSLINGKALTCSWNSNIGWKPPYTYNILPANKVAADVKAKAGAGKL

SEQ ID NO: 15150 - protein, 325 aa, Xanthomonas campestris pv. campestris str. ATCC 33913
MSETTMTAIAIRNGKGDADALHAVEQARPQPAPGQVLIRVHAAGINRPDLLQRGGHYPPPPGAPETLGLEVAGEVVVAAGRWKVGDRVCALLGGGGYAQYAAVDARHVLPVPEGMTLVQAAALPETIFTAYANLFEHGRLAAGEWLLLHGATSGIGVTAIQLAKAAGAHVLATARSAGKAAQARELGADVAIDSTTESFVAAAKAHAGVDVALDMVGASVFADTLEALNPGGRIVYIASQAGATLEVPIPLLMRKQAIITGSTLRPRNADEKARLAAEVERVVWPWIAQGKVRVLIDQCFPLAEAAAAHRYLEQGSHLGKVVLEM

SEQ ID NO: 15151 - protein, 302 aa, Xanthomonas campestris pv. campestris str. ATCC 33913
MLVFTHPACLGHDAGPEHPESPARLTAVVEALRDAFTDLDWREAPLAKLGDLCRVHEREQVDAVLETNFQGYHQLDVDTLMSPGSRAAALRAAGAGIAAVDAVMQDGAGTAFCAVRPPGHHATGQVSMGFCLFNNIAVAAAHARDRHGLERITVVDFDVHHGNGTQAIFERDPTVQYLSTHQSGLYPHSGSVHERGIGNIHNLLLPPGSDGLRFRNVWEDEMLPLIDAFRPQLVLISAGFDAHLRDPLADLMLDADDFAWLTGALRALATRHARGRVVSMLEGGYDLQALRESSVAHVGALR

SEQ ID NO: 15152 - protein, 492 aa, Xanthomonas campestris pv. campestris str. ATCC 33913
MTMPTDSISFHARLTPQRLAARDLLLQQEWTYAELDDLIGRLAAVLQTRGCVDGERLAVLARNSVWQVALHFACARVGAIYVPLNWRLSGTELDALLQRAEPRLLLGDDVAAGRAQVEDFARFIDNAKQLAPAETPYIPPDRVSLILFTSGTSGQPKGVMLSEQNLQQVAHNFGVTTRVEAHSSFLCEAPMFHIIGLATNVRPVLAMGGSIQVSNGFEPKRTLGWLGNPALGITHYVGVPQMMQAFRSQPGFDPAALRHLTALVSGGAPHASEDLLGWLEDGIPMVCGFGMSEAGTVFGMSVDCEVIRSKLGAAGISSPTVQTRVVDNEGNDCEVGMPGELLLRGPNLSPGYWRDPQATAEMRDGAGWFRTGDIVRRDADGFFWVVDRKKDMFISGGENVYPAEIEAVLADHPEIRECAVVGMADAQWGEVGYLAIVPATETPDLERIRSYLSERLAKYKVPKHLRVVAALPRTATGKLQKARLKDALANEA

SEQ ID NO: 15153 - protein, 343 aa, Xanthomonas campestris pv. campestris str. ATCC 33913
MGIRISHLRKQFASFTALDDITLDVRQGELLALLGPSGSGKTTLLRIMAGLEHADGGQVLFGDEDATRMSVQSRRVGFVFQHYALFKHMDVFENIAFGLRVRRGKERWAEARIRARVEELLALVQLQGLEQRYPTQLSGGQRQRVALARALAIEPRVLLLDEPFGALDAQVRRDLRRWLRELHEQTGLTTVFVTHDQEEALELADRVAILNRGRIEQLDTPARVYDTPASPFVYSFVGAVNRIPGVLAHGQIQVAGHALPSANPALAAGPVEVYVRPEDLVPDADGWPATVAWAQRSGARLRVRAILDAAGNEVEVELPASAGTITAGQQLRLAARHYGVFPA

SEQ ID NO: 15154 - protein, 289 aa, Xanthomonas campestris pv. campestris str. ATCC 33913
MTGPRVRTVTAAALRAQPLPAPGGDKEQRGRVLIVGGSARVPGAVMLAGEAALRAGAGKLQLATAASVAPGMALAMPEALVLGLGENGQGEIVRGHRALDAAMSACDAAVIGPGMASTNTTAALVKRAIDQAVCTLVLDAGALSPRLRAPLGRPFVLTPHAGEMAALAGDDKAAVEAAPADYALAFAKKMRSVVIVKGADSFVAGPDGALWVHRGGVPGLGTSGSGDTLAGLIAGFAARGCDALTAALWGVFVHATAGKQLAKRIGTVGFLAREIPPEVPGILDRLPRG

SEQ ID NO: 15155 - protein, 463 aa, Xanthomonas campestris pv. campestris str. ATCC 33913
MAKAKTAYVCGECGAEYTKWQGQCTECGVWNTLSEIVLESATPAGKASPAASRRSGWAGKTEAPKITALKDVQQSEQARVSTGIGEFDRVLGGGLVEGAVVLIGGDPGIGKSTLLLQALASMASTLPVLYVTGEESLAQVAGRAVRLDLPLEGLNALAETGIENILQHASVARPKLIVADSVQTLWTESLTAAPGSVSQVRESAARLVRYAKETGTAVFLVGHVTKEGGIAGPRVLEHMVDAVLYFEGESGSRFRLLRAFKNRFGAVNELGVFAMGEKGLKEVSNPSAIFLSGGSTHQPGSCVMVTREGTRPLMVEVQALVDASPLSNPRRVAVGLEQNRLAMLLAVLHRHGGIVVGDQDVFVNVVGGIRVQETAADLPVLLAVLSSLRDRPLAEKTIAFGEVGLSGEIRPVPNGEDRLKEAATHGFKRAIVPKANAPKASSIKGMEIVAVERLSQALEAAAE

SEQ ID NO: 15156 - protein, 366 aa, Xanthomonas campestris pv. campestris str. ATCC 33913
MSSLFSPYQLKDVSLRNRIAIPPMCQYTATDGFTNDWHQVHYASMARGGAGLVIVEATGVSPEGRITPGCLGLWNDAQAEGLAGIAASISAAGAVPGIQIGHAGRKASANLPWEGDDHIADGDARGWDTLSPSAVAFGANLPKLPRAMDLDDIARVRGDFVAAAKRALAAGFKWLELHFAHGYLAQSFFSVHANQRQDAYGGSAENRARFLLETLQAVRAVWPEHLPLTARFGVIEFDGRDEETLQEAIALTRNFKRDGLDLLNVSMGFSTPNAVIPWGPALLAPIAERVSREAALPVASSWNIDDPLEADRVVAAGQMELVMVGRAHLANPHWPYHAALALGEERPSRVLPPSYAHWLARYGKRS

SEQ ID NO: 15157 - protein, 295 aa, Xanthomonas campestris pv. campestris str. ATCC 33913
MSKIAFIGLGNMGGPMVANLIKAGHELRVFDLVHSALDTAHAAGAQVASSASDTLHGAEVVISMLPASKHVEGLYLGDAGILAHIPAGALVIDCSTIAPAMARTVATAAHARGLDMLDAPVSGGTAGAAAGTLTFIVGGAAQALERARPVLQAMGKNLFHVGDNGAGQVAKLCNNMALGVIMAATGEAIALGVAQGLDPAVLSQMMAVSTGRSWATEVCNPWPGVLENAPASRGYSGGFGNDLMLKDLGLVAEAAVQAGASIPLGELARNLYAMNSRAGNGALDFSSVVKLVAKV

SEQ ID NO: 15158 - protein, 364 aa, Xanthomonas campestris pv. campestris str. ATCC 33913
MSTSTPSPLFSPVRLGALDLSNRVIMAPLTRNRAVAGAVPSPLAVEYYAQRATAGLIIAEGTQISPLGQGYLDTPGIHTPAQVEGWRAVTDAVHRQGGKIALQLWHVGRVSHTSLLPPGEVPVAPSAIRSTGKTFTAQGFSDVSEPRALALEEIPALIEDYRAAARNAIDAGFDGVEVHAANGYLIDQFLRDGSNQRTDAYGGDIENRTRLLAEVVQAIADEIGAERTGVRLSPVTPVYDMHDSDPQALFERAVERLNLIGGLAFVHVIEGATGGPRDNIAFDYTALRAKFDGAWISNNGYDKAMAEQAISRGDTDAVSFGRAYIANPDLVRRLREDAPLAEPNQATLYGGGAEGYTDYPALPA

SEQ ID NO: 15159 - protein, 478 aa, Xanthomonas campestris pv. campestris str. ATCC 33913
MRGRMGRHRSGPRMSEPSSTDAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCVLIFSLNMVSARWFAEGEFWFSLINVVTIVVFIVLGGAAVVGWLPLADGSPAPGVRHLRADGWFAHGTVPILMTMVAVNFAFSGTELIGIAAGETAQPARAIPLAIRTTLIRLVVLFVGTVLVLAALLPAHAAAVETSPFVRAFELLGIPYAAGLLNAVILTAILSAANSGLYAAARMLWSLANEGTLPARFARLTRRGIPLPALVLSMLGGLLALLTGVYAADTVFVAISAVSGFAVVVVWLSICASHYCFRRQLLRDGIALDSLAYRAPWYPWTPLIGGALCVLACAGLAFDPQQRIALWCGIPFVALCYGAHAVTQRLAARRVRP

SEQ ID NO: 15160 - protein, 161 aa, Xanthomonas campestris pv. campestris str. ATCC 33913
MTTLSTYQFTDLDGQPQSLAEYAGKVVLVVNVASKCGFTPQYAGLQALWQRYRDRGLVVIGFPCDQFGHQEPGDAADIRQFCSLDYAVDFPLAAKVEVNGSGAHPLWQWLKHEKRGVLGSEAIKWNFTKFLIGRDGSVLERYAPTTKPEALAADIERALGA

SEQ ID NO: 15161 - protein, 387 aa, Xanthomonas campestris pv. campestris str. ATCC 33913
MPVRPDDLFDVRAQLSDDERAVQDAVARFTDTRVLPGIGEAFDAARFPRELVPELASLGLLGASLPVSEGGAGLGAVAYGLICQELERGDSGLRSFVSVQSSLCMYPIHAYGSDAQRRQWLPEMAAGRVIGCFGLSEAQGGSDPAAMTTRAVRDGDGWRLRGAKMWITNGSIADLAIIWAHTDDGVRGFLVDTRSEGFRAQDIGHKMSLRASVTSAVFLDDVFVPEQQRLPDALGLKAPLGCLSQARFGIAWGAIGAAVACLREALAYSGERILFGRPLAATQSAQIKLADMARRIATAQLLALQLGRLKEAGTLRPEQISLAKWNNCRMALDVARECRDLLGAAGITTEHVAIRHALNLESVITYEGTETVHQLVVGRALTGLNAF

SEQ ID NO: 15162 - protein, 478 aa, Xanthomonas campestris pv. campestris str. ATCC 33913
MSEQFDVVVIGAGPAGYHAAIRAAQLGMKVACIDAAIGKDGKPALGGTCLRVGCIPSKALLDSSRQFWNMGHLFGDHGISFNDAKMDVPTMIGRKDKIVKQFTGGIAMLFKANKITPYYGFGQLQPGNIVKVTQHEGGEIELKGTNVILAAGSESIELPFAKFDGDTIVDNVGGLDFTAVPKRMAVIGAGVIGLELGSVWKRLGAEVTILEALPDFLALADAEVAKTALKEFKKQGLDIKLGAKVSKTEITGSGDAKQVVLSYTDAAGEQTLTVDKLLVAVGRKAATKNLLADGTGVKLTERGQIEVDGHCHTGVDGVWAIGDCVRGPMLAHKGFEEGIAVAELIAGLPGHVNFDTIPWVIYTEPEIAWVGKTEQQLKAEGVAYKAGSFPFAAIGRAVAMGEPAGFVKVIADAETDRVLGMHLVGVGVSELVHEGVLTMEFSGSADDLARICHAHPTLSEAIHDAAMAVSKRAIHKAN

SEQ ID NO: 15163 - protein, 185 aa, Xanthomonas campestris pv. campestris str. ATCC 33913
MSLNRLLVLVFAGLFSTAAVAAGTSVLDLDYRPLAGKAPINLNRSYGGKVVMVVNTASKCGFTPQYEGLEALNQRFGSRGFTVLGFPSNDFQGQEPGSEKQIQEFCTLTYGVKFPMFEKVHVLGAQATPLYQRLTRETGVAPGWNFHKYLIGRNGHVVAQFPSKVKPDDPQVLAAIERELKAPAR

SEQ ID NO: 15164 - protein, 352 aa, Xanthomonas campestris pv. campestris str. ATCC 33913
MLPVHRVLRHLGLASARRTGGGARMSAAKNQVVCFGEALIDMLALPPAGPDEARTFAQYAGGAPANVAVAVARLGGAAHFVGMLGRDMFGDFLLESLQQAGVVTDGIVRTDEAKTALAFVALDAAGERSFSFYRPPAADLLFRAEHFAADGFAQAAVLHVCSNSMTEPAIARCTLDGMRRARADGAIVSLDLNLRPMLWPQDVDPAPLLWEALALADVVKLSREELDYLAGTLDSDASAVTQKLWQGHARWLLVTDGGGPVHWQTRVDSGQVPAFHVQVRDSTAAGDAFVGGLLFQLAARASTLEQLCADPAAIAEVIRFAAAVGALAVTRKGAFAAMPSVDEVHSLIQEQS

SEQ ID NO: 15165 - protein, 406 aa, Xanthomonas campestris pv. campestris str. ATCC 33913
MKESPPMAPKPKNTNAAGGTAKSATKASSKKATKLAGKDSAKPLATAAPVLADVRAKIDEIDRGIQALIAERANFAHQVGKAKGKLAAAVDYYRPEREAQVLRMVVDRNEGPLSDEVLVHVFREIMSACLAQQEPLKIGYLGPEGTFSQQAVLKHFGRSAVGLPMATIEEVFQEVEAGNADFGVVPVENSGQGTIQVTLDMFLTSNLKICGEVELRVHQYLLSRNGRLEDIERIYAHSQSFAQTAGWLRSHLPKVEKIAVSSNAEGARRARNAEDAAAIGGESAAHVYGLKKVIMKSIEDDDDNTTRFLVIGRQIFPSSGHDRTSVLVFIHDKPGALFDVLSPFARHGISMNRIESRPSHQAKWEYGFFIDLAGHVEDESMKQALAELEAHSAQIKVLGSYPVAIP

SEQ ID NO: 15166 - protein, 468 aa, Xanthomonas campestris pv. campestris str. ATCC 33913
MTSSSTSAAATASSAQIAARIDRLPASATLWRLVGLLALGGFFELYDLFQTAYISPGLIRDGIFASGNDGAFGMSDQAAFAAATFLGLFVGAALLSPFADRFGRRLVFTVALVWYTAATVAMGLQSTATAVIVLRFVVGIGLGIELVTIDTYLSELVPRHMRGAAFAFAFFLQFLAVPSVALSAWLLVPHAPLGVSGWRWVVLLSGVFALAIWWLRSRLPESARWLAAQGRHAEAEAVMAQLEAACSRDLGRALPPPEPVQRVAAPDSRLSALWRPPYRGRIGMLVVFQIFQAIGFFGFGNWLPALINAQGAGVTKSLAYAFAISLAYPLAPLLLLRVAHRWENKWQISASALGAVVFGVLFALQHAPLGMIACGAMIAFCNAWMSFAYHGYQAELFPTALRARAVGFCYSFSRLSTAGSSVLIGWLLAQTGSHGVLAFIVISMTIVASVIAAFGPRTRNRALEDIAG

SEQ ID NO: 15167 - protein, 430 aa, Xanthomonas campestris pv. campestris str. ATCC 33913
MTTIAKILAREILDSRGNPTLEAEVTLADGSFGRAAVPSGASTGTKEAVELRDGDKTRYLGKGVRKAVENVNGTIAETLKDFDAADQQGLDRRLIDLDGTENKGRLGANALLGVSLAAAHAVAASRKQPLWQYLSTITESDVALPVPMMNIINGGAHADNNVDFQEFMVLPVGCSSFSEALRAGTEIFHSLKSVLKGHGLSTAVGDEGGFAPDFRSNVEALDTILEAIGKAGYTAGEDILLGLDVASSEFYDNGKYNLVGENKRLTSEQFVDFLADWVAQYPIISIEDGLAEDDWAGWKLLTDRVGKKVQLVGDDLFVTNPKIFKEGIDSGTANAILIKVNQIGTLTETLEAIAMAHAANYASIVSHRSGETEDTTIADIAVATTATQIKTGSLCRSDRVAKYNQLLRIEQALGSGARYAGRDAFVSLKR

SEQ ID NO: 15168 - protein, 481 aa, Xanthomonas campestris pv. campestris str. ATCC 33913
MFPGEPMSSVSIDGAPDAGENTRFIILISCVATIGGFLFGFDSGVINGTVDGLKQTFQSSAAETGFEVASMLLGCAIGAFFAGRLADRWGRRAVLIISAALFLLSAIGAGASHSSGFFIFARVMGGFAVGAASVISPAYIAEVASARYRGRLATMQQIAIISGLFCAFLSNYLLANAAGASTEPLWGGQAAWRWMFWMQAIPSLLFLLLLLVIPESPRYLVVKGRREQALVVLKRLYGNAAAQTKLGEISASMSADQHKPKFSDLISKTTGKIRPIVWIGVGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 15169 - protein, 504 aa, Xanthomonas campestris pv. campestris str. ATCC 33913
MTHTNGFDALHAHAQRLRGAAIPALLAAEPQRPTQYARQVGPLYFNFARQKYDRAALDALFAIARERDLAGAFQRLFRGEQVNVTEQRAALHTALRGDLTDAPVASDAYATAAEVRQRVGALIQQLEGTDVTDIVSVGIGGSDLGPRLVADALRAPSGARFRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLDGAAQFDAHVLNTPLEENVAVLHGLTAVWNRNLLGSATHAVMTYDQRLALLPAYLQQLVMESLGKRVKLDGAAVDSDTVAVWWGGAGTDVQHSFFQALHQGTSVVPADFIGTVHNDDPYAENHVALMANVLAQTEALANGQDSSDPHRSYPGGRPSTVILLDALTPQALGALISMYEHSVYVQSVMWGINAFDQFGVELGKQLASQLLPALKGEAADVADPVTRELLAKLRG

SEQ ID NO: 15170 - protein, 206 aa, Xanthomonas campestris pv. campestris str. ATCC 33913
MGSETTAAGDALDALDWNKGDGLLPVIVQDADNLRVLMLGYMNAEALAVTRARGEVTFFSRSKQRLWTKGESSGNVLRVVAIETDCDADTLLVQARPHGPTCHLGRTSCFPTAPSQFLGSLDALIAEREHERPHGSYTTKLFEQGIRRIAQKVGEEGVETALAGVVQGDAELLGESADLLYHLIVLLRARGLGLGDAVALLESRHK

SEQ ID NO: 15171 - protein, 493 aa, Xanthomonas campestris pv. campestris str. ATCC 33913
MYRMLKSLLRVKPIEPAGRVDAGEPVEGSLQGEATLQRTLTAKHLIMLGIGAVIGAGIFVMTGQAAANHAGPAVMLSFVFAGIACTFAGLCYAEFAAMMPVSGSAYSYSYATLGEGIAWFIGWCLVLEYLFAGSSVAVAWSAYLISFITGTLGLPFPTELTNAPLAWINGEFVASGNILNLPAVLIVAAVSGLCYVGITQSAFINAIVVAIKIAVICLFVGFGAAYIDPANWHPFIPENTAPGVFGWSGVFRAASIVFFAYIGFDAVSTSAGETKDPQRNMPIGILGSLAVCTIIYIIVCAVLTGLMPYTQLGTAKPVATALEAHPQLTWLKTAVEIGAIAGLSSVVLVMLMAQPRIFYTMAKDGLMPKLFGKVHPKFHTPYVGTVIVGVVAASLAGLIPLSVLGELVSMGTLLAFATVCAGVMVLRFTKPELERPFRVPLAMIVCPLGTLACLALFFQAFQEHWKVFVGWTVIGLVIYFGYGIHHSRLARKA

SEQ ID NO: 15172 - protein, 411 aa, Xanthomonas campestris pv. campestris str. ATCC 33913
MAIAFGDASMQRSFWRSGHTPTLFASFLYFDLSFMVWYLLGPLQVPIAQALGLDTQQRALMVAVPILCGAVLRLVLGMLADRIGAKRAGVVAQLAVIASLFGAWQLGVHSMGQVLLLGVLLGIAGASFAVALPLASRWYPPEHQGTAMGIAGAGNSGTVLAALFAPMLALAFGYQNVFGLACIPLVLTLLVFVLIAREAPIPVARKRWADYGRVLVGNRDAWRFMFFYSVTFGGFSGFASALPGYFHDQFGFDARTAGWATAACVLAGSVMRPLGGVIADRVGGTRALLAVYLLVATLVGIAGFGAGGATITLGLFVLTLLCLGAGNGAVFQLVPQRFGQDIGVMTGLIGMAGGVGGFALAAGLGVLKQHTGSYAIGMWLFAAFALGGWALLAGVKTQWRSEWSTAGAARV

SEQ ID NO: 15173 - protein, 386 aa, Xanthomonas campestris pv. campestris str. ATCC 33913
MSPSLFLGWGDDYFVVLWIHGRAVRLGRRQGVGRVIRVSLAMLILLALTFSPIVHATCVQTEPSTSANNGSWACSDQGEAFAKASSMGVPADLSVCRMKSIRAVSSGPGVFSQRMTYPGDTCGIGYDLDIGTGNATYPDTATCAKRPSQSGWTNPTAPTPSDVCNDGCYYTYAVDAGGPKGYTYVPSGATCTTDDAAPPIDDGGDGDDDGGGDGGGDGGGDGGGDGGGDGGGDGGGDGGGDGGGDGGGDGDGGGDGDGDGDGDGDGDGDGDGDGDGGTLPGDGDGEEGGEGAPMSELYKKSGKTVESVLSKFNTQVRGTPMVAGIGDFMKVPSGGSCPVFSLGASKWWDAMTINFHCGGDFLAFLRAAGWVILAIAAYAAIRIAVT

SEQ ID NO: 15174 - protein, 485 aa, Xanthomonas campestris pv. campestris str. ATCC 33913
MLRIQAEALTYDDVSLVPAHSIVLPKDVSLETRLTRDLRLKLPILSAAMDTVTEHRLAVAMAQLGGIGIIHKNLTPAQQAGEVAKVKKFESGVITEPFTVSPDTTIGEVIALTRARNISGVPVVDGSELVGIVTSRDMRFEKKLDDPVRHIMTKKDRLITVREGASDEEVLELLHRNRIEKILVVNDSFELRGLITVKDIQKKTDNPNAAKDGAKRLLVGAAVGVGGDTEQRIELLAAAGVDVVIVDTAHGHSQGVIDRVAWVKKTYPHLQVIGGNIVTGDAALALMDAGADAVKVGVGPGSICTTRVVAGVGVPQITAVDMVAEALQDRIPLIADGGIRYSGDIGKALVAGASTVMVGGLLAGTEEAPGEVELFQGRSYKSYRGMGSLGAMEKGSKDRYFQDASDADKLVPEGIEGRVPYRGPVGGIIHQLIGGLRATMGYVGCATVEEMRTKPKFVKITGAGQRESHVHDVQITKEPPNYRAG

SEQ ID NO: 15175 - protein, 382 aa, Xanthomonas campestris pv. campestris str. ATCC 33913
MPVTTKLPKVGTTIFTVMSQLAAEHGAVNLGQGFPDFAVPQRLVDALGQAMAAGHNQYPPMTGVAALRQAIAGKAQRCYGAQVDADTEITVTSGATEAIFNAIHAVVRAGEEVIVLDPAYDCYEPAIDLAGARAVHVALDPQTFAVDWDALRAAITPKTRLLMINSPHNPSGAMLSAADMQTLTELLHGTDIFLLSDEVYEHIVFDGRRHESVLRWPELRARAFVISSFGKTYHCTGWKIGYAIAPPALSAEFRKVHQYNTFTSFGPAQHAFAAMLRDEPEHDEQLGAFYQAKRDRFREQLLTTRLVPLPVPGGYFQLVDYSAISDLPDTEFVKWLTVEKGVAAIPLSPFYETAPAGQRLARLCFAKNDATLDAAIARLQQL

SEQ ID NO: 15176 - protein, 495 aa, Xanthomonas campestris pv. campestris str. ATCC 33913
MYAPLALYDTAAARMLDAQATTLLGGDGYTLMQRAGQAAWQWLQERLPRARRIVVMCGTGNNGGDGYVLARLAHRAGRQVQVVHLPEQGPASELAQRACTDYLAVGGAIALFPCALAHADVLVDAVFGIGLNRAPGAQMDALFDAINAAGVPVLALDVPSGIDADRGIAPGSAVRASATLQFIVPHVGLYTGDALEYAGERDLATLEVPGSAFDGLAPVAQRWERDALAAHLLPRRRNTHKGESGRVLCVGGNAGSGGAIMLTTEAALRSGSGLVQVATRAEHVAPLLARCPEAMVRGVQEDADITALAEAADAVALGPGLGRDSWARALWSGVLASATPTVIDADGLNLLASTSVPARGPRVLTPHPGEAGRLLGQSTAQVQRDRLGAAHALATRFDAVVVLKGAGTVVAAPDRLPRLIDAGNAGMAVGGMGDLLTGVIASLLGQGWAPFDAASLGALLHACAGDAAAADGERGLLPTDLLPALRRLANAGAIA

SEQ ID NO: 15177 - protein, 460 aa, Xanthomonas campestris pv. campestris str. ATCC 33913
MSERVVDPSVLRSLQQLDAAHHLHPFNDNAALASKGTRILTRGEGVYVWDADGNKLLDAFAGLWCVNLGYGRAELAQAAARQMEQLAYYNSFFQCTTEPTVHLAAKLAELAPGDLNHAFFANSGSEANDTILRLVRHFWAVQGQPQKHIFIGRHDGYHGTTMGGASLGGMRGMHRQGGLPIPGIEHIAPPNHFGEGGEMDPDDYGLLAARRLEEKILQLGPDTVAAFIGEPIMGAIGVYIPPRSYWPEIERICRRYDVLLVADEVICGFGRTGAWFGAEYFGFQPDVMTLAKGITSGYIPLAAAMFNDRVAGVLKRQGGELAHGGTYAGHPVCAAVALENLRLLQDEGIVDTARTQIAPYLAQRWAELGAHRLVGEARIAGLVGALELVPDKRRRGVYFPERGRVGALCRDFALRRGLILRATYDAMLLSPPLIITCEQVDELFDKTWAALDDTAQALGK

SEQ ID NO: 15178 - protein, 459 aa, Xanthomonas campestris pv. campestris str. ATCC 33913
MATETRVASLPSIDAAALAAIEGCALVDLLLPDTNGVLRGKRVTREALDKVYRDGVCLPMSLIATDITGNTVEETGLGYAIGDADRICRPIAGSLRPVPWAPQPMAQLLLAMHTPNGALFEVAPRAVLQRVVQGFAALGLTPVIAVELEFYLFDAMADAQGRPQTPRDAHTGERNTSTQVYALQDLDDHRSFTDAVTAACRQQGIPADTAVAEYAPGQFEINLQHRADAVAACDEALLLKRTIKAIAQQQHLLASFMAKPFAGQAGSGLHVHVSLLDAAGHNVLHGTADAPAAALRHAIAGLQRHADASLLLFAPHANSYRRFVPNAFVPLDASWGFNNRTVALRIPHSDAHNTRIEHRIAGADANPYLVAAAVLAAMLDGLQHPGDPTAPVQGNAYAQATFTPRTWQGAVDAFLRSDFIATQLGTQFQHVFGQQKQRELLDYQALVPDLDYARYLRTV

SEQ ID NO: 15179 - protein, 450 aa, Xanthomonas campestris pv. campestris str. ATCC 33913
MHDHPSSDAAHAMQTPAAMEAFWMPFTANRQFKARPRLLASAAGMYYRDVEGRQILDGTAGLWCCNAGHARERIVAAIRAQAGTLDFAPTFQMGSPLPFALAERLAALAPPGLGHVFFTNSGSEAVDSAMKIVLAYHRLRGEGQRTRFIGREKAYHGVGFGGMSIGGLPNNRKWFGPLLAGTDHLRHTLDLQRNAYSRGLPAFGVELADDLERLITLHDASTIAAVFVEPVSGSAGVILPPEGYLQRLRAICDRHGIVLVFDEVITGFGRVGEAFAAQRFGVTPDLITAAKGLTSGTVPMGAVLVADAIHDAFMHGPQAAIELFHGYTYSGHPLACAAALATLDTYAEEQLFTRAITLGPQWEEALHSLRGLPHVIDIRNIGLIGAIELAPREGAPGARGYEVFERCFHEGGLLVRVTGDVIALSPPLIVTPDQIGQMVETLAAILRKVD

SEQ ID NO: 15180 - protein, 251 aa, Xanthomonas campestris pv. campestris str. ATCC 33913
MRRKIVAGNWKLHGTRAFATELVAQVAAHMPLAGVDVVILPPLPYLGDLIEDFEAHHLAFGAQDVSSNEKGAYTGEVSASMLVDVGAEYGLVGHSERRQYHQESSELVARKFAAAMHAGLIPVLCVGESLEQREAGQTEAILRAQLEPVLSLVGSAGFARAVVAYEPIWAIGTGRTATPDQAQAVHAFIRGEVAKADARIADSLPILYGGSVKPDNASELFSQPDVDGGLVGGASLVAEDFLAIARAAAAC

SEQ ID NO: 15181 - protein, 272 aa, Xanthomonas campestris pv. campestris str. ATCC 33913
MSRAPDRIAACFDALRHSGRKALIPFITAGDPSLEATVPVMHALVRAGANIIELGVPFSDPMADGPTIQRSSERALGRGAGLAYVIEAVQEFRREDATTPVVLMGYLNPIEIHGTRRFAETAVAAGIDGVLLVDLPPEEADETRAIFTEVGLALIALASPTTGEARLDMLCSTAQGYLYYVSFSGVTGAADRLDTHAASDRLRQLRARAGAPVVAGFGIKDAASAAAMAVDADGVVVGSALVAALADASDVRSARKRAEDFLQPLRQALDAG

SEQ ID NO: 15182 - protein, 352 aa, Xanthomonas campestris pv. campestris str. ATCC 33913
MSDTARPKVWVSQPLFDDVVEQLGAHFELVTTAQVTAYSSADLAARLAPLDGALVTLNERIGAAEIAAAPQLRAIANVGVGYNNLDIDALSAAGILASNTPDVLSETTADLGFALLMATARRVTEAERWLRDGQWGQWSFKTMLGADIHGSTLGILGMGRIGQGIARRGAHGFGMRVLYHNRSQLPAETEQAVGAQYVGLDTLLAQSDHLVLVLPYTQASHHIIDAAALAKMRPTATLVNIARGGIVDEIALADALANGRLAGAGLDVYEGEPRVRPELLAQHNVVLTPHIGSASLATRRAMVQLAVDNLIAALGVGANAGHPPSALNADAVAAAKRGGATVGATKTAATKR

SEQ ID NO: 15183 - protein, 456 aa, Xanthomonas campestris pv. campestris str. ATCC 33913
MSARYDYDVVVLGGGSGGLAAAFRAAKHGARVAIMEPGELGGTCVNLGCVPKKAMWLAADLASKIELAGALGFDVVRPTLTWQELVTHRQGYIGNIHASYRRRLDDDGVVLIPQRGVLQDRHTLMGADGVPVTAEHIVIATGAHPLRPHVEGAEHGHVSDDFFNLCHAPDHVAIVGGGYIAVEIAGLLQALGSRVHLFVQGERLLERFDAELTLQLADNLRHLGVRLHFGFRTTGVQRDDTGKLRMRGHSAHPGELGNDVFDQVFFAIGRRANTAGLGLEALGVELGKKGEIVVDDGQTTNVPNIHAVGDVDGKVGLTPVAIAAGRKLMDRLFGGQPDARMDYDNVPSVVFSHPPLGAVGLTEEQARERYDGAVRVYRSNFRPMLHALADAPQRSVFKLVCVGEEERVVGVHLLGESADEMLQGFAVAVKMGATKRDFDETVAIHPTSSEEIVLMH

SEQ ID NO: 15184 - protein, 166 aa, Xanthomonas campestris pv. campestris str. ATCC 33913
MTWTTPDLCDRFPEVAVAEPLFRHFGGRTTFSGPIATVRCVEDNSRIRELASTPGDGRVLVVDGQGSLRQALFGDQIGAQAVANGWAGVLIHGCVRDVEILAGLPLGVLALAACPRRTERRDLGDVDVPVNFAGVAFVPGHWLYADANGVVVAATPLSLEIAGVEH

SEQ ID NO: 15185 - protein, 327 aa, Xanthomonas campestris pv. campestris str. ATCC 33913
MHTRTLGRSGLRVSALGLGCMGLSYGYGPATERKQAVALLHAAVEQGVTLFDTAEAYGPIANEELLGEALAPYGAQVVVATKFGFRDGHADAGLDSRPARIRAVAEASLLRLKRERIDLFYQHRVDPAVPIEEVAGTVKDLIAEGKVGHFGLSEASADTIRRAHAVQPVAAVQSEYSLWWREPEASVLPTLEELGIGFVPFSPLGKAFLTGAIQPDTQFDQSDFRNSVPRFAAEARRANQALVQRLQAIADDKGATPAQVALAWLLSRKPWIVPIPGTTKRHRLDENIGGAALVLSSDELARIQQALDAVEIVGERYSPERQKLVGK

SEQ ID NO: 15186 - protein, 249 aa, Xanthomonas campestris pv. campestris str. ATCC 33913
MTRKLVLLRHGQSQWNLDNRFTGWVDVDLTEQGRQEAAAAGKLMKDEGLQFDVAYTSVLKRAIHTLQGALKELDQDWLPVHKSWRLNERHYGGLQGLDKAETAAKHGEEQVKIWRRSYDIPPPAMDVTDPGHPGHDRRYATLDRNALPGTESLATTLVRVLPYWHDAIAPQLKAGQTVLVTAHGNSLRALYKYLNDISNAQILELNIPTGIPLLFELDDNLQVQSYRYLGDPEAAKRAAEAVANQGKAK

SEQ ID NO: 15187 - protein, 335 aa, Xanthomonas campestris pv. campestris str. ATCC 33913
MRGIRLQQPAGLASLSSVALPDPGQPAAGQIRVRLHASSLNFHDLGIVSGQMPTADGRIPMSDGAGVVEAVGEAVSDFAVGDHVVSTFFPQWLDGEPLHAGFATTPGDGVDGYARSAVVAAAQAFTHAPRGYSHAEAATLTTAGVTAWRALVVNGRIKAGDTVLVLGTGGVSIFALQFAKAMGAMVIVTSSSDQKLETARTLGADHCINYRQHTEWAAQVLEITNGRGVDHVVEVGGPGTLAQSIKAARVGGHIALIGVLTGAAGPVPTAEMMGRQQRLQGLVVGSRRHQQELVRALDGLPLRPVIDRSFALEDIAEAFALQHAGGHLGKIVLEF

SEQ ID NO: 15188 - protein, 461 aa, Xanthomonas campestris pv. campestris str. ATCC 33913
MPLPTDPVAETASSAAPALRHALKPRQLMMMGLGTAIGAGLFLGSGVGIHAAGPAVLVSYLIAGALVIIVMNALGEMAAAKPASGAFSVYAADAMGPTAGATVGWLWWLQIVVVIAAEAVGAASLLATVWPALPVPMLASVFMATFTVINLLGVRNFGEFEFWFAILKVVAILIFLMIGGALLAGLLPGVASPGLSNFTQHGGFAPKGLAGIGTALLVVVFAFGGTEIVAVAAAETADPGRSLARTIRTVAWRILVFYIGSISVIVAVVPWTSDALSSPFAAVLEVARIPGAATGITLVAVVALLSALNANLYGASRMIFSLAQRGEAPRWLGNTSRQQVPLVAVIASVLFGFAAAVLELLYPGKVLPMLLNIVGATCLLVWTISLLSQLILRARADRAGIALPFRMRGYPVLTLLALAILAVIFVLLALSADTRAQFLSMVGLTAGIALVSELARRMRKR

SEQ ID NO: 15189 - protein, 472 aa, Xanthomonas campestris pv. campestris str. ATCC 33913
MHRHVHEPEILADPAAFEAAEHWRQRDLAVVWHPCTQMREHPHTLPLVPIARGDGAWLIGHDGRHYLDAVSSWWTNLFGHAEPRIGAAIAQQAGRLEQVMLAGFTHAPAVQLAERLLAIAPRQPDRAPLAKVFYADNGSAGVEVALKMAFHYFHNRDEHRRTRFIALENGYHGETIGALSVGDIPLYRRVYAPLLLESIFAPSPDAYLAEPGQSAEDYALQAADALQHLLEQSPGEICALILEPRVQCAGGMRMYHPAYLRRARELCDAHGVFLIADEIATGFGRTGTLFACEQAGVMPDLLCLSKGLTGGFLPLSAVLATQQLYDAFLDDSRERAFLHSHSYTGNPLACAAALATLQIFADDDIIARNQRTAAHMTQLAAQIGEHSAVADVRQAGMIVAFELTQGGDKRTPFPAAARVGLQAYRAALARGVVLRPLGDVLYWMPPYCVDDAQLALLADTTRHAIAKAVACA

SEQ ID NO: 15190 - protein, 386 aa, Xanthomonas campestris pv. campestris str. ATCC 33913
MRRPAFPASVMNSSGAVWQHKRRTLMPAFRAALVRESAMQASAATRSLLHELGDSCATQDMRTLMTGLCAQLGAGFLLGDSANAADLLRMLPMVDAISKQTRRQSLAPTWWPSSGRRRLRRLRADIDMALDRILMQSTQRPPRAASVLALLLAETARDDGDWCRDEAAAILMSALEPMSAALTWTLLLLAQHPHIAQEVAQEASALDGADVASGTSLLDRLPQSRACVKESMRLYPPAWITARIAQRDATLNGFHVPRGTQLLVSAWVVHRDGRHFPDPEIFLPARWLDDSATHSLTRYSYFPFGGGPRSCIGCMLALTQMTIVIATVLHACSLHLAPDARPSPFPALVLRPMDVRIALRPRVIRSVVPSRAHASPVRLASVTPND

SEQ ID NO: 15191 - protein, 319 aa, Xanthomonas campestris pv. campestris str. ATCC 33913
MALYDNILDTIGRTPVVKLNRLAPDHVSLYVKVESFNPGGSVKDRLALAIILDAEQRGLLKPGDTIVEATSGNTGVALAMVAAARGYKFVATMVETFSIERRKLMRAYGAKVILTPAAERGSGMVRKAKELAEQHGWFLASQFANPANPAYHRNTTAAEILRDFAGHRLDHFVTGWGTGGTLTGVGEVLRVARPEVRITATEPAGAALLQGQDWKPHKIQGWTPDFVPEVLNREVAHEILSVEDTDAISVARRLAAEEGIFTGISGGGTVSTALRVAETAVPGAVILAMLPDTGERYFSTPLFADINEGSDDDWLAGLP

SEQ ID NO: 15192 - protein, 334 aa, Xanthomonas campestris pv. campestris str. ATCC 33913
MSIEQLAETAQAMVAPGKGIIAIDESTSTIAKRFSGVGIENTEENRRAYRELLLTTPKLSDYISGAILFDETIRQKTKDGVPFAKYMADHGIIPGIKVDKGAQPLAGMPGELVTEGLDGLRARLEEYYTLGARFAKWRAVINIGEDIPSGTCIEANAHALARYAALCQEQGLVPMVEPEVIMDGDHDIETCYEVTEATLRSLFGALYEQNVVLEGTILKASMVISGKGCEEQASVEEVAESTVMCLKSTVPAILPGIVFLSGGQTDEQSTAHLNEMHQLGNLPWPLSFSYGRAMQQAALKLWSKDMTGNYAKAQQIIYERAKENGLAALGKWKG

SEQ ID NO: 15193 - protein, 508 aa, Xanthomonas campestris pv. campestris str. ATCC 33913
MPSSVRDACVKFRGFYREAIMKERQRRTKILATLGPATDPPGVLDALFKAGVNVVRLNFSHGDPSGQAKRAAEVRAAAVRVGAEVGILADLPGPKIRIERFAGGKIKLTMGDRFDLVADINAPAGDQHQVGVSYLGLPQDVTAGDVLLLDDGLVQLQVTDVQGARIVTTVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRYLSRFRSNMPIYAFTRHDGARRQMAMMRGVFPIGFDSRGLTPREAARAAIRLLVENERMGPGDRVVFTSGEHMETHGATNTLRLLEVGEDGRASGLGEL

SEQ ID NO: 15194 - protein, 391 aa, Xanthomonas campestris pv. campestris str. ATCC 33913
MSIVRMTDLDLSGKRVLIRQDLNVPIDNGQITSEQRITASVPTIKLALEKGAAVMVTSHLGRPKEGTWSEEDSLAPVAARLTTLLGLDVPLVRDWVDGVDVAPGQVVLLENCRMNVGEGKDDEALARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHDVGKSLSEPDLIPTANQIVADAKARGAEIPLPTDVVVAKQFLPDAEASVKSLDQVDADDLILDIGPQTAAHYAELIANAGTVVWNGPVGVFEFEPFSHGTETLARAIAASKAFSIAGGGDTLAAVDKYAIAKDVTYISTGGGAFLEFLEGKTLPAVAALEARGQ

SEQ ID NO: 15195 - protein, 429 aa, Xanthomonas campestris pv. campestris str. ATCC 33913
MNHSRSHALFSQAQNLMPGGVNSPVRAFKSVGGEPFFVARADGAYLFDVDGNRYIDYVGSWGPMIAGHNHPAVREAVERAIRDGLSFGAPCEAEVTMAETITRLVPSCEMVRMVNSGTEATLSAIRLARGATGRNRIVKFEGCYHGHGDSFLVKAGSGMLTLGVPTSPGVPAGLSELTATLSFNDFEGATALFDEIGAEVAAVIIEPVVGNANCIPPQAGYLQHLRTLCTRHGALLIFDEVMTGFRVALGGAQAHYGVTPDLTTFGKIIGGGMPVGAYGGGRDLMEQISPAGPIYQAGTLSGNPVAMAAGLAMLQLVQEPGFHARLSETTSLLCEGLEDAARAAGVAVTTNQVGGMFGLFFTDQIVENYAQATACDVTTFNRFFHAMLQQGVYLAPSAYEAGFVSSAHDEAVIEATLAAAREAFADVMR

SEQ ID NO: 15196 - protein, 408 aa, Xanthomonas campestris pv. campestris str. ATCC 33913
MSTAADSPLSLAHYYLPVYRPRQVVLERGQGSRVWDDQGREYLDLSSGIAVSGLGHNDPDLMAALTEQAGKLWHTSNVFFSAPPLKLAEELVTASRFAQKVFLCNSGTEANEAAIKLVRKWASSQGRPADKRVIVTFRGSFHGRTLASVTATAQPKYQEGYEPLPGGFRYVDFNDVPALESAMASGDVAAVMLEPIQGEGGVMPAAPGFLARVRALCDQHDALLVLDEIQCGMGRTGSLFAHWQEQVTPDIVTLAKALGGGFPIGAMLAGPKVAETMQFGAHGTTFGGNPLAAAVARVALRKLASPQIAENVARQSAALRAGLEALNAEFGVFAQIRGRGLMLGAVLAPAHAGQAGAILDLAAAHGLLLLQAGPDVLRFVPALNLTDAELADGLARLRLAIAAYVAQH

SEQ ID NO: 15197 - protein, 187 aa, Xanthomonas campestris pv. campestris str. ATCC 33913
MRLVLLGPPGSGKGTQAARLKDTFQIPHISTGDLLRAEVAAGSPLGLKAKEVMARGDLVSDEILLGMLEARLGQADVANGFILDGYPRNVAQANALDSLLSKIGQPLDAVVQLDVASELLVERIAGRAKAEGREDDNPESVRKRLQVYTDSTAPVIGFYEQRGKLARVDGVGSLDEVLERIGQALGR

SEQ ID NO: 15198 - protein, 369 aa, Xanthomonas campestris pv. campestris str. ATCC 33913
MKSRAAVAFGPGKPLEIVEIDVAPPQAGEVLVRITHTGVCHTDAFTLSGDDPEGIFPSVLGHEGGGIVEQIGEGVTGVKVGDHVIPLYTAECRKCKFCLSGKTNLCQAVRATQGKGLMPDGTTRFSYNGEPIFHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGEIDLDPFITHTMPLEQINEAFDLMHEGKSIRTVIHF

SEQ ID NO: 15199 - protein, 490 aa, Xanthomonas campestris pv. campestris str. ATCC 33913
MPRFPDQLLYIGGRYVPARGGHTFEVVNPATGEVLANVHNADADDLDAAVDSAKAGQRHWAALTVVERSRILLRAVALLRERNDALAELETLNTGKPLSETRSVDIVTGADVLEYYAGVAQALQGVQVPLREGSFFYTRHEPLGVVGAIGAWNYPIQIALWKAAPALAAGNAMIFKPSEVTPLTALKLAEIFTEAGLPDGVFNVLPGDGASVGHALTEHPEIEKISFTGGTATGRKVMASASSSSLKDVTMELGGKSPLIVCADADLDLAADIAMMANFYSSGQVCTNGTRVFVPRALRTAFEARLLARVQRIHIGDPLDERTTFGPMVSAAHMQRVLEHIEQGKAEGARLLFGGERLRDGALAQGCYVAPTIFSDCTDVMTIVREEIFGPVLSLLTYDDEDEAITRANATSYGLAAGVVTPDLSRAHRLIHRLEAGICWINTWGESPAPMPVGGYKQSGVGRENGLATLQAYTRTKSVQVELERYASVF

SEQ ID NO: 15200 - protein, 313 aa, Xanthomonas campestris pv. campestris str. ATCC 33913
MELGMVGLGRMGANMAERLVRGGHRVHGFDLGAAARTSAQSKGIQTTDALVTLVSALPSPRVVWLMVPAGKIVDDTLAQLLPLLQAGDIVIDGGNSYYKDSQRRAAQLQSSGIAFVDCGTSGGVWGLQEGYSLMVGGDEAAVTTLHPVLATLAPAPDKGWGRVGPSGAGHFTKMVHNGIEYGMMQAYAEGFALLQHKTDFALDLHQVAEIWRDGSVVRSWLLDLTADALAHNPTMGGIAPYVADSGEGRWTVAEAIDLEVSAPVITLSLMERLRSRDKDSFTDKLLAAMRNQFGGHAVLTTTPTPTPIGSKDA

SEQ ID NO: 15201 - protein, 368 aa, Xanthomonas campestris pv. campestris str. ATCC 33913
MKTRAAVAWGPHQPLSIEEVDLQPPRPGEVLVRLVATGICHGDAHALAHAPASSFPAILGQEGSGVVEEVGIGVTSVRVGDHVIPLDMPECGVCKFCRSGRTNLCQAIRSSQERGLMPDGSSRFSLDGRPILHHMGTSTFSEYTVLPEIAVARIHPDAPLDQVCLLGCTVTTGVGAVLNSIHVRPGDCVAVFGLGGIGLSVIQGAVLAQAGRIIVVDIAPGKFALARALGATDCLDPRDYGAPIQQVIVDLTDGGADHSFECIGDVGAMRAALECCHKGWGESVILGVADGAQEISTRPFQLVTGRVWRGSAFGGVKGRSELPGYVERYLRGDLQLAPLITRTLALDDINQALADLRAARGIKSIVLY

SEQ ID NO: 15202 - protein, 459 aa, Xanthomonas campestris pv. campestris str. ATCC 33913
MSDPSAPDHLQRSLSNRHLQLIAIGGAIGTGLFMGSGRTISLAGPSILFVYLIIGVMLFFVMRAMGELLLSNLDYKSFIDFSTDLLGPWAGFFCGWTYWFCWIITAIADVIAIAAYAQFWFPELAPWVPAVLCVLLLLALNLVTVKLFGEMEFWFALIKIIAICALIITGAGLVMWGFRSPSGHVASLSNLWNDGGMFPMGIGGFFAGFQIAVFAFVGIELVGTTAAETADPQRNLPKAINSIPVRILIFYVLALIAIMAVTPWRQVVADKSPFVELFVLAGVPAAASLINFVVLTSATSSANSGIFSTSRMLYGLAEERNAPRGFAKLTRAAVPARGLLFSCICLLLGAMLVYLIPDLVTAFTLVTTLSAVLFMFVWSLILCAYIAYRRKRPEQHAASAFKMPGGVLMCYVCLAFFAFIIVLLTLQPDTLHALLVSPLWFLVLAIAYWVRRNQSPTAR

SEQ ID NO: 15203 - protein, 304 aa, Xanthomonas campestris pv. campestris str. ATCC 33913
MSTTVPMAERSYYEADARERIDGLLDAGSFTEFVGPRRRLISPHLAQLDTPGAFDDGIVVGEGRLRGRHVLIAAQQGAFMGGGVGEVHGAKLTGLLERAAATTPDAVVLLLDTGGVRLHEANAGLIAISEIMRATLGARAAGVPVLALIGSGNGAFGGMGIVARCCSAVIMSEEGRLSLSGPDVIETVRGVEEFDARDRALVWRVTGGKHRYLIGDAQTLVPDRIAAFADAAATTLDTLAEPQGDAALQALEREHHALAARITAYGDCRDGVEIWRRQGIADPERLPLLDTDAFLAATADRSTP

SEQ ID NO: 15204 - protein, 331 aa, Xanthomonas campestris pv. campestris str. ATCC 33913
MHTRSLGRSGPTVSALGLGCMGMSAFYGDRSDEAGSIAVIHRALDRGISLLDTADMYGPHTNEVLVGKAIASRRHEVFLATKFGIKLDPNDPSVRGIDGSPAYVQSACEASLRRLGVEHIDLYYQHRVDPNVPIEDTVGAMARLVEQGKVRFLGLSEAAADTIRRAHAVHPITAVQTEYSLWSREPEDNGVFATVRELGIGFVPYSPLGRGFLTGAFASPDDFDADDYRRHSPRFQGENFTRNLQLVEQVKAIATDKGVTPGQLALAWVLAQGQDLVPIPGTKRLAYLEENIAALDVALMPDELARIDAIFPPQAAAGTRYPEAMMGAVNR

SEQ ID NO: 15205 - protein, 458 aa, Xanthomonas campestris pv. campestris str. ATCC 33913
MSVPHSSPSATPRFAAEVRTTGLLALPLVLGHVSTGLIGFVDNVIAGHHGTATLAAVTIGTSLLWLPMLVPIGTLISLTASVSQLVGAGREREIGPLFRQALWLSLGLGALMFGFLTAVPPLLPTFGIAPDIVPGATDFLHAVRWGGPALTFYFCMRYLSEGMHWTLPTMLLGFGGLLVLAPLGYVLTYGKFGFAEHGAQGLGMASAITMWVQAIAFALYLWRSRRFAHLELFTHLEGPRWRAIGELLRTGLPIGITVLMEGGLFIVTALLIGRLGSTEAAAHQIAINVSQLCFMIPMGVAEATTVRVGHAVGRGDPLGMRRAAWAGYAIVLGTQAVSASILLLGHDAIVGVYTNDAAVAALASVLLLFAATFQFPDGIQVLSAGALRGLKDTRVPMFLAMFSYWGLGMPLGAGLGLGLGWGPQGMWIGLILGLTAAAILMGLRFRQTSRRLTAGAAP

SEQ ID NO: 15206 - protein, 1066 aa, Xanthomonas campestris pv. campestris str. ATCC 33913
MNAQPDTFASSHLARPLLAPELPAAPGALRAAITAAWLKDETEHVRELLEQARLPAAEQAKVQALAADLVTRVRARAQDQGAIEAFMRQYDLGSEEGVLLMCVAEALLRIPDQDTADKLIRDKLGEADWKKHVGGSDSVLVNASTWGLMLTGKLVQLNDLTRADVPGAFKRLIGRVGEPVIRLAVRQAMKIMGHQFVMGRTIGEALARSRKGDNANYRYSFDMLGEGALTMKDAQRYLQAYRDAIHAIGRSGSFVGTDVFAAPSISIKLSALYPRYEHAKRARVMAELVPGVLELAQLAKSYGIGYTVDAEEADRLELSLDIIEATFSDPSLDGWEGYGLAVQAYQKRTPYTIDFLADLARRVGRRIPVRLVKGAYWDAEIKRAQIDGHPGYPVFTRKQNTDVSYLACARRMFAHSDALYPMFATHNAQTIAAVRAISAGKTYEHQKLHGMGDDLYAEVIPADRLGLPCRVYAPVGSHEDLLPYLVRRLLENGANSSFVNRITDEDVAIEDLIRDPVEAVSSFASIPHPKIPLPADLLRSQNQNRKNSMGANLANDNDLRQLADQLTAAIKPWKAAPLVPGAVITTPSEAVFNPADRRETVGHWQPADPATVQKALASAAAAQPAWNRTPAASRATILEHAADLLEARMPEFMAICVKEAGKTLPDAVAEVREAVDFLRYYAAQARAQFGAPERLPGPTGESNELQLHGRGVFVCISPWNFPLAIFLGQVAAALAAGNTVIAKPAEQTNLVGFAAVKLLHEAGVPEAAVQFLPGDGATVGAALTNDPRVAGVAFTGSTDTARIINRTLAARDAAIGVLIAETGGQNAFIADSSSLPEAVVKDAISSAFISAGQRCSAARVLFVQDDIADKVMTMLAGAMGELKIGDPALLSTDVGPVIDADALKILEEHASRMDSEARLIGTTTLDSATAHGSFFAPRAYELKSLAQLQREIFGPVLHIIRWKADQLDSVIDQINATGYGLTLGVHSRIDETIDRITSRVAVGNVYVNRNQIGAVVGVQPFGGQGLSGTGPKAGGPHYLLRFATEKVVTVNTTAAGGNASLLTLGD

SEQ ID NO: 15207 - protein, 285 aa, Xanthomonas campestris pv. campestris str. ATCC 33913
MSTNDNWYIEHFQPTGSAIGYRISGKLDEVQSPFQKIEIYQTTDWGKLMIIDGAVMLTSRDNFFYHEMISHPALFTHAAPKRVVIIGGGDCGTLREVLKHPGVESATQCDIDEQVTRMSEKYFPELCDSNDDARAELLFDDGVAYMANCPAGSVDIVIVDSTDPVGPAEGLFNKSFYESCFKALKDDGILVQQSESPLALLDLIKEMRTEMGKAGFQSFKTLPFPQPCYPTGWWSVTMASKQANADFAFRQADAQAKGFDTLYYTAHLHTGVLVAPPFVAKALGE

SEQ ID NO: 15208 - protein, 460 aa, Xanthomonas campestris pv. campestris str. ATCC 33913
MTATRYDAIVVGAGQAGPSLAVRLAERGQRVAVIERHLVGGTCVNTGCMPTKTLVASARVAHLARRAGDYGVRIAGPVEVDLPQVMARAHAISDAARTGVEQWLAQTPGVQLIRGHARFVAPDRLRVGAQELGAPRIFLNVGGRARTPELPGLDQISPLNNTSILQLRTLPQHLVVIGGSYIGLEFAQIFRRLGAQVTVVEQHAHLIGREDADISEAIAQMLQDEGIAVRTDARCIAFAAHADGAAVQLECAQGAPQIVASHVLLALGRQPNTDDLGLEAAGIATDAQGYVQVDMQLATNVPGVWAMGDCNGRGAFTHTAYNDYEILAANLLDGAERRLSQRVPAYALFTDPPLGRVGMSETQARASGRPLLVAQRPMQQVGRARENGETIGMMKLVADAQTRRVLGAAILGLHGDEAIHGIIDLINADQPIDTLEWAVPIHPTVSELWPTLARALAPAQ

SEQ ID NO: 15209 - protein, 335 aa, Xanthomonas campestris pv. campestris str. ATCC 33913
MNVPRQRVGSTAVQLSALGFGAAPIGNLYSAVDEGDALAAVTGAFEAGIRHFDAAPYYGYGLSEARLGRGLAGVPRADYTLSTKVGRCVYDDATAVAGRDGFAVAGRRAEFDYSANGVRRAFASSLERLGTDYIDVLLLHDIGALTHGDNHANVLRQALEEALPAMAELKAAGACGAIGLGVNEQDVALEVLPRFPLDCVMLAGRYTLLEQHGAAALLDQAQQRNVAILSAGPYSSGLLSDARGPGATYNYAPVDAATLDHAQRLYAACAAFGVDIGAAALQFPLAHPAVITVVAGMRSVAEVQSASARLQATVPAALWQRLRDDGLLDAALPTP

SEQ ID NO: 15210 - protein, 264 aa, Xanthomonas campestris pv. campestris str. ATCC 33913
MTASESPVVQLSGVRIDRGGRAILRDVSLDVPRGSITAVLGPSGSGKSTLLAALTGELRPVAGRVTLFGQEIPRGSRALLEMRRNVGVLLQGNGLLTDLSVADNVALPLRTHTRLPAPVLQRLVQMKLHAVGLLAAADAWPRELSGGMARRVALARALALDPPLMIYDEPLTGLDPIASGVIMSLIQRLNDSLDLTSIIVSHHVHETLPICDQAVVIANGGIVFAGTPEQLQDSTDPLVQQFLHGQPDGPIPFDAAPRRDRSAA

SEQ ID NO: 15211 - protein, 181 aa, Xanthomonas campestris pv. campestris str. ATCC 33913
MSQSIHDIPVTDINGGATSLAAHRGKVLLVVNVASKCGLTPQYEGLEALYRDKQAQGLEVLGFPANDFNGQEPGSEAEIAQFCQLTYDVTFPLFSKIAVTGAEIHPLYQALTSAQPQATGDGPMREKLAGYGIAANPAPGVLWNFEKFLIGRDGQVIERFAPDVAADDVRLRQAVDAALAH

SEQ ID NO: 15212 - protein, 369 aa, Proteus vulgaris
MKSRAAVAFAPGKPLEIVEIDVAPPKKGEVLIKNTHTGVCHTDAFTLSGNDPEGVFPVVLGHEGAGVVVEVGEGVTSVKPGDHVIPLYTAECGECEFCQSGKTNLCVSVRETQGKGLMPDGTTRFSYNGQPLYHYMGCSTFSEYTVVAEVSLAKINPEANHEHVCLLGCGVTTGIGAVHNTAKVQPGDSVAIFGLGAIGLAAVQGARQAKAGRIIAIDTNPAKFELARQFGATDCINPNDHDKPIKDVLLEINKWGIDHTFECIGNVNVMRAALESAHRGWGQSIVIGVAGAGQEISTRPFQLVTGRVWKGSAFGGVKGRTQLPAMVEDAMKGEIELEPFVTHTMTLDEINEAFDLMHEGKSIRTVIRY

SEQ ID NO: 15213 - protein, 387 aa, Streptomyces coelicolor A3(2)
MHVPSTAPPPATAAPLFGPFTVGSLALENRIVMAPMTRELSPGGVPGPEVAAYYARRARNGVGLIITEGAAIGHPSSERRAAVPRIHSADALAGWTRVTQAVHAAGGRIAAQLMHVGLDPLLWGMTPAEMDAASPAGFELLSPSGVDPSQPAAATVGREMSDVDISSVIEAYARAAAEARQAGFDAIELHAAHGYLIDQFFWAVTNRRKDRYGGDLSARTRFGADVVRACRHAVGEDFPIFLRFSQWKVGHYAARLADSPDELAAVLGPLVQAGVDAFHCSTRRFWQPEFEGSDLNLAGWTKKVTGRPVIAVGSVGLKDSDFLSYLDGKGADVGDVSVVADRLAQGEFDLVAVGRALIADPAWPAKVRGGRSADLIPFDARMLTSLH

SEQ ID NO: 15214 - protein, 331 aa, Streptomyces coelicolor A3(2)
MTTNPDGGRHARNDSALLTTPFDSHARAQEVIDGVDLTGRRAVVTGGASGLGAKTVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFEFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDDQPGGVAAHALDPEAADRLWEYGADTLSAG

SEQ ID NO: 15215 - protein, 501 aa, Cytophaga sp. KUC-1
MSNTIQRPEFKAKYDNYINGKFTAPVKGEYFDVLSPIDGKVFTKAAHSGKEDLELAVDAAYEAFKTWGKTSVTERSILLNKIAQKIEDNLEYIATVETIDNGKPIRETLAADIPLAIDHFRYFAGVIRAEESSIAELDSQTVSIALSEPLGVVAQIIPWNFPILMAVWKIAPALAAGNTIVLKPAESTPISILVLMELIGDILPPGVLNIVNGFGAELGRPLVTNKKVAKAAFTGSTTTGRLVMQYATENIIPVTLELGGKSPNIFFPSVADHDDDFFDKAIEGAVLFALNQGEICTCPSRLLIHEDIYEKFIARVIERTEAIIAGNPLDKSTMIGAQTSLVQKEKIMSYIKLGKEEGAELLTGGDENHLGGDLEGGYYIKPTLFKGHNKMRIFQEEIFGPVLAVTTFKTTEEAIEIANDTMYGLGAGVWTRDAHEIYQVPRAIQSGRVWINQYHSYPAGAPFGGYKQSGIGRENHKMMLGQYRQTKNMLISYDKKKLGFF

SEQ ID NO: 15216 - protein, 346 aa, Rhizobium leguminosarum bv. viciae
MRALQLIDDRKLEITDLPEPDAPAAGEVTLRVKAVALNHIDVWGWRGMAFAKRKMPLVIGAEASGVVEAIGPGVANVLPGQLVAIYGARTCGLCRPCREGRDNLCEHVSGVHGFHLDGFAQEKVNLPARLLVPAPPGVDAIGAALAPVTFGTVEHMLFDNAKLEPGETILVHAGGSGIGTAAIQLAKKIGCTVITTVGSDDKIEKAKALGADHVINYRTDRFEGVVRKLTKKKGVDVVFEHVGKDTWAGSMLCMKRGGRLVTCGSTSGVSTEMNLMMLFQQQLKLFGSFGCRMENMADAMQKMGPRARPSRHRYRGQAFSDIDRALEPDGIAPDLRQDHPEDGLTA

SEQ ID NO: 15217 - protein, 280 aa, Nicotiana tabacum
MYRDRGGGSSKSEIVGGPLDRKRINDALDKHLEKSSPSTSRAFKDKAVPSTSAGKSHQHHPDHRATKNKCSDDESETDSEESDVSGSDGEDTSWISWFCNLRGNEFFCEVDDEYIQDDFNLCGLSSQVPYYDYALDLILDVESSHGDMFTEEQNELVESAAEMLYGLIHVRYILTSKGMAAMLEKYKNYDFGRCPRVYCCGQPCLPVGQSDIPRSSTVKIYCPKCEDIYYPRSKYQGNIDGAYFGTTFPHLFLMTYGHLKPQKSTQNYVPRVFGFKLHKT

SEQ ID NO: 15218 - protein, 251 aa, Vibrio sp.
MRQALVMGNWKLNATKGSVEALINGLVDAAKDNATVEVAVCPPAVFIPQVEALTADTAITYGAQDCDVNTSGAFTGENSAVMLKEFGCKYTLVGHSERRVIHGESSEVVADKFAVTPENGLVPVLCIGETLEQFEAGETKAVVEAQLQAVVTKSGITSLNNAVIAYEPVWAIGTGKTATPEIAQEIPAHIRSWLAEQDAAVANKVQILYGGSVKPANSAELFGQADIDGGLVGGASLDAVEFSKVISGASA

SEQ ID NO: 15219 - protein, 170 aa, Bartonella bacilliformis
MDTMVDFKTLPYRKGVGIVVFNREGQVWIGRRLITSSHTYAEVSKLWQFPQGGIDEGEEPLDAARRELYEETGMRSVNLIKEVQDWFCYDFPQELIGHVLNNQYRGQMQKWFAFQFIGETSEIVINSPENSNKAEFDQWKWINLEVLPSIVVSFKRHVYMKVVHEFRNII

SEQ ID NO: 15220 - protein, 431 aa, Clostridium perfringens [sequence omitted]

SEQ ID NO: 15221 - protein, 429 aa, Nostoc sp. PCC 7120 [sequence omitted]

SEQ ID NO: 15222 - protein, 429 aa, Mycobacterium leprae [sequence omitted]

SEQ ID NO: 15223 - protein, 119 aa, Sulfolobus tokodaii
MMKLSENEASKLIEKLWFRHTDSTIIAVLQDYKTKEVLMVGHMNREAVFKTLTTGYVHFWSLSRKKLWLKGETSGHFQLVEDFKIDCDGDAMVFLVKSVGPVCHTGNRSCFYRNFSDLI

SEQ ID NO: 15224 - protein, 187 aa, Xylella fastidiosa [sequence omitted]

SEQ ID NO: 15225 - protein, 184 aa, Nostoc sp. PCC 7120 [sequence omitted]

SEQ ID NO: 15226 - protein, 397 aa, Clostridium perfringens
MNFNKKTIEDVQVKGKKVLVRCDFNVPLKDGVITDENRLNGAMPTIKYLVDNGAKVILCSHMGKPKGEAKPEFSLAPVAKRLSEMLGKEVVFAADDNVVGENAKKAVAEMKDGDVVLLQNTRYRKEETKNGEELSKELASLAEMFVNDAFGTAHRAHCSTVGVTEYLKPAVCGYLIQKELKFLGDAVETPERPFVAILGGAKVSDKINVINNLLEKVDTLIIGGGMAYTFLKAQGYTVGSSLVEEDKVEYAKEMLAKAEEKGVKLLLPVDHRVAKEFKDVEAVVTEDQNIAEGFMGLDIGPKTEAIYAEAIKDAKTVIWNGPMGVFEFENFNKGTIAVAKAMAEADATTIIGGGDSAAAVNILGFGDKMSHISTGGGASLEFLEGKVLPGIAALNDK

SEQ ID NO: 15227 - protein, 400 aa, Nostoc sp. PCC 7120
MSKKTVASLSAADISGKRALVRVDFNVPLDDQGNITDDTRIRAALPTIQDLTQKGAKVILASHFGRPKGVDEKLRLTPVAKRLSELLGQEVIKTDDSIGDEVAAKVATLQNGQVLLLENVRFYKEEEKNDPEFAKKLAANADFYVNDAFGTAHRAHASTEGVTKFLSPSVAGYLVEKELQYLQSAIENPQRPLAAIIGGSKVSSKIGVIETLLEKCDKLIIGGGMIFTFYKARGLNVGKSLVEEDKLELAKSLEAKAKERGVSLLLPTDVVLADNFAPDANSQTVSIENIPDGWMGLDIGPDSVKVFQAALADTKTVIWNGPMGVFEFDKFAAGTEAIAHTLAEIGKTGTTTIIGGGDSVAAVEKVGLADQMSHISTGGGASLELLEGKVLPGIAALDEA

SEQ ID NO: 15228 - protein, 465 aa, Acidithiobacillus ferrooxidans
MSHFSFIEDPRQDPKKLDVEERREAFREIYQSFDLGSAQLQADRCLHCGNPYCEWKCPVHNYIPNWLQLIVENRLEEAATLSHQTNTLPEICGRICPQDRLCEGACTLNATGGAVTIGNLERFVTEEALARAWQPDMPDILPNGKRVAVVGGGPAGLGCADILNRAGTEVVVFDRYPAVGGLLTFGIPSFKLEKAVVARRANLLQEMGIRFQLDTEVGRDISLGKLLEDFDAVFLGMGTYTAKTGDFPGEKLPGVLKALSYLIANTRHLMQLPDPTLPYISLSGKRVVVLGGGDTAMDCLRTAIRQGARQVTCVYRRDEENMPGSRREVANAREEGVHFLFHRQPVEVVGDAASGSPGRASGGDPSGEPDARGRRHPEIIPGSEQVLDADVVIIAFGFDPSPAPWFAEHHITTDSRGRISTNAQFQTSNPRIFAGGDMRRGSDLVVTAVDEGRRAAQGILDYLGV

SEQ ID NO: 15229 - protein, 2032 aa, Bacillus sp.
MVKGRWRKYVAYFSIFLLFAQLFSFSAIVRANEPMQSPVVNGNDVTFRYVGTGEEQSVLLAGSFNDWQTIELTKESDYIWSVTKTLPDGTYMYKFVVDGNWVADPLNANQADDGHGGKNSVVVVGQPAQQQERVVTLVGNLQKELGHEKEWDPTATATVMKHEGNGLYTFTGTLPAGTYEYKIAINGSWDENYGAGGRNGGNISFTLEKETEVTFYYHDSTHAIADSTWYTPIPKEKQPRLVGTILPAIGYEKEVDGWTPETSTAFFTDDDFDSVYTFSARVPKGTYEYKVVLGNSWDENYPQDNNAKLNVLEETTITFFFNAKTKELYTDYSPTGSDGNVDKDRLKHNTWDSLYRQPFGAVKAGTEVTLRLAAKKGDVTKANVYVKNTTTGTAKLYEMSKVGVIGDDEYWEATFTPEEKGLYGYKFIAMDGAAKAEYGEDTQEGQWGRAVDKNAELFQLTVYDPNYKTPDWMKQAVVYQIFPDRFFNGNPNNDKVKEYGRGNEPIEYREWSQLPDNPRMKDTPGYDGDGFWNNDFFGGDIAGIEQKLDYLQSLGVNTIYLNPIAHAPSSHKYDAQDFKEIDPMFGTPEEFESFVQAIASRGMHLILDGVFNHVSDDSIYFDRYGKYPTVGAYEYWSAVYDLMNEKGLSEEQARAQVEQKFKDEGQQFSPYGFHLWFNIENEKVNGVYKYQSWWGFDSLPEFKSVTGTKVPYPSELNNEQLANYIFYERDSVAKSWITRGASGWRLDVANEVDTEFWREFRKELLQSDYDRGPTLKNGQQPLILGEIWDDASKYFLGDQYDSVMNYRFRGAVLDFLRNGKAEEIDARLTAVREDYPEEAFYALMNLIGSHDTARAIFLLGNGTDSYERAELDPNYNEQLGKQRSKVAVIFQMGYPGAPTIYYGDEAGVTGSKDPDNRRTYPWGSEDKELIAHYQKVGKIRTKHQDVLAKGTIETVYAKGDVYVFARQYGKDVALIAMNRGDSAQTVQLDVSSIIPNGTSFVDELHGEYEVTVSDGKVQLNIPALDGRMLFGKVTVNMPNEVTNVQATAGVGQVTLAWEGDASTYRIYQSTLKGAGYELVKETNEKTAVIDNLKNGTAYYFAITAVDENGNESAKVETNRVVPHYPLAEEHVALLSEVNGGVLDLAALITVEAKVQIDNVTKHGLADGLQAVLQVKKPNSDKWEDIQATYDRQDGDANVFRASFTPLQAGTYTYRYGFTTNLGDSWVYTEEKTFTLTANEADQQAPAKGIHLLQPDVESGQVNLSWSFIERDDHDAYMVVIERDGQVIHTTTTISTSFTDYDVENGKTYTYVVKLYDRAGNVVASKDVQITPDIVMVQVTFKVKAPSYTPLDTRITIPNSINGWNTGAWEMTRGGAVTPDWEFTTELQEGETITYKYVKGGSWDQEGLADHTRDDQTDDDVSYYGYGAIGTELKVTVHNQGNNKMVIQDYILRWIDMPVVVEDVTKDGDRVTIKGNAIKDGVLTINKERVTIQDDMSFTYTFTPAANQKEIAIHIEPSERSKSDIFKNDGGAIAKNTKDYVLNLDTKQLREGVLQEDTGSGTTPGSGTTPGSGTTPGSGTTPGSGTTPGSGTTPGSGTTPGSGTTPGSGTTPGSGTTPGSGTTPGSGTTPEKGAVVLQPQVETKEKDGKIVEKVATISSNEVTSIVNSLSNENKQVVVSLGSLAKGVTTKVDVPATLFTQAANKQGEATIVSATEQATYKLPAKEVQASLAAIAKTLGATVEQVNISIEMRVKDAPQLRAKALSDAVEFHVVAKANGKEQVIDRFTQYVEREIVLKQAVNASRSIVVRVNDDGSITPVPTTFVGNKAVIKSLTNSTYVVVEGTHTFSDIEKHWAKGYIETLAAKQLVKGMTETAYRPNEQMTRAQFAVLLVRALALPHETYDGRFADVKGTEWFNKNGELAAAVKLGIIQGKTANTFAPNEPITRVQAAVMIERALKLSFVGYDEATNDKTKKATDFRDAKQLPTWAKQAIEAVYQAGIMQGRDNGSFDPTGHMTRAEMAKVLAEFLGKVKLM

SEQ ID NO: 15230 - protein, 199 aa, Streptomyces lividans
MRIVLVGPPGAGKGTQATRLAETLHIPHISTGDLFRANISQQTELGKLAKSYMDAGNLVPDEVTIAMDRTAWSSPTPRAFLLDGFPRNVSQAEALDELLETEDMKLDAVLDLEAPEDEVVKRIAGRRVCRNDSAHVFHVTYTPPKKEGVCDVCGGELYQRDDDSEETVRKRLEVYHTQTEPIIDYYKSQGLVATIAATG

SEQ ID NO: 15231 - protein, 461 aa, Rhodococcus erythropolis
MRIAEHVVDLIGNTPLVKLTSVTGENFGTVAAKVEYLNPGGSSKDRIAVKMIDAAEASGELKPGGTIVEPTSGNTGIGLALVAQKRGYKCVFVCPDKVSEDKRNVLRAYGAEVVVCPTAVAPDNPNSYYSVSDRLTREIPGAWKPNQYSNPGGPESHYETTGPEIWADTDGKITHFVAGVGTGGTITGTGRYLKEVSGGKVKVIGADPEGSVYSGGTGRPYLVEGVGEDFWPSAYDPSIPDEIIAVSDADSFEMTRRLAREEGLLVGGSCGMAVVAALEVAKREGPDALIVVLLPDGGRGYLSKIFNDQWMASYGFLRTPLDGKTNVPTVGDVLRGKSGELPDLVHTHPSETLRDAIEILREYGVSQMPVVGAEPPVMAGEVAGSVSERDLLSAVFEGRAHLADSVEKHMSKPFPLIGSGEPVSAATKALGDTDALMVVDDGKPVGVITRHDLLGFLSSDS

SEQ ID NO: 15232 - protein, 269 aa, Arabidopsis thaliana
MYNNMGPQPGMPRPPGNPEPGPFGNPFTGAGSGFIRGGLGAYGERILGSSSEYVQSNISRYFSDPQYYFQVNDQYVRNKLKVVLFPFLHRGHWTRISEPVGGRLSYKPPIYDINAPDLYIPFMAFGTYVVLAGLSLGLNGKFTPEALNWLFVKGLVGWFLQVMLLKVTLLSLGSGEAPLLDIVAYGGYAFAGLCLAGFAKIMWGYSYYALMPWTCLCTGIFLVKTMKRVLFAEVRSYDSSKHHYLLLFLALVQFPLLIWLGNISVNWLL

SEQ ID NO: 15233 - protein, 462 aa, Arabidopsis thaliana; identical to SEQ ID NO: 583

SEQ ID NO: 15234 - protein, 202 aa, Arabidopsis thaliana
MNPEYDYLFKLLLIGDSGVGKSCLLLRFADDSYLDSYISTIGVDFKIRTVEQDGKTIKLQIWDTAGQERFRTITSSYYRGAHGIIVTYDVTDLESFNNVKQWLNEIDRYASENVNKLLVGNKNDLTSQKVVSTETAKAFADELGIPFLETSAKNATNVEEAFMAMTAAIKTRMASQPAGGAKPPTVQIRGQPVNQQSGCCSS

SEQ ID NO: 15235 - protein, 318 aa, Arabidopsis thaliana
MFYQSSSSLTQILHSFCGNTEMETPYPKLIDPSKTRIGWIGIGIMGSAMVSHIIAAGYSVTVYARDLRKTKDLQTKGARIANSPKELAEMSDVVFTIVGNFNDVRSLLLGDDGVLSGLTPGGVTVDMTSSKPGLAREIHAEARRRNCWAVDAPVSGGDAGAREGTLGIFAGGDSEIVEWLSPVMKNIGTVTYMGEAGSGQSCKIGNQIAGASNLVGLAEGIVFAEKAGLDTVKWLEAVKDGAAGSAVMRLFGEMIVKRDYRATGFAEYMVKDLGMAAEAAMPGAALSKQLFTGMVANGDGKLGIQGVVSVIRRLNGIS

SEQ ID NO: 15236 - protein, 462 aa, Arabidopsis thaliana
MAPAQNQITSKHVAVIGAGPAGLITSRELRREGHSVVVFEREKQVGGLWVYTPKSDSDPLSLDPTRSKVHSSIYESLRTNVPRESMGVRDFPFLPRFDDESRDARRYPNHREVLAYIQDFAREFKIEEMIRFETEVVRVEPVDNGNWRVQSKNSGGFLEDEIYDAVVVCNGHYTEPNIAHIPGIKSWPGKQIHSHNYRVPDPFENEVVVVIGNFASGADISRDIAKVAKEVHIASRAREPHTYEKISVPQNNLWMHSEIDTTHEDGSIVFKNGKVIFADSIVYCTGYKYNFPFLETNGYLRIDEKRVEPLYKHVFPPALAPGLAFVGLPAMGIVFVMFEIQSKWVAAVLSGRVTLPSTDKMMEDINAWYASLDALGIPKRHTHTIGRIQSEYLNWVAKESGCELVERWRGQEVDGGYLRLVAHPETYRDEWDDDELIEEAYNDFSRKKLISVDPSYYLENGR

SEQ ID NO: 15237 - protein, 489 aa, Talaromyces emersonii
MTTTETPTTTTTSTLPPDFLWGFATASYQIEGAFDEDGRLPSIWDTFSKTPGKVEDGTNGDVACDSYHRTGEDIEILKKYGAKIYRFSLSWPRIIPLGGRNDPINEKGLQFYSKFLDDLHAAGIEPFVTLFHWDLPDELMKRYGGMLNKEEFVADYANYARVVFNALGSKVKHWITFNEPWCSSVLGHNTGKHAPGRTSDRTKSPEGDGTREPWIVGHNLLVAHGTVVDIYRREFKEKQGGEIGITLNGDWAEPWDPENPADVEACDRKIEFAISWFADPIYHGKYPDSMVKQLGDRLPKFTPEEIAFVHGSNDFYGMNHYCENYIRNRTGEPDPEDIAGNLDILMEDKNGNPIGPETQCEWLRPFPLGFRKLLKWLADRYNNPKIYVTENGTSVKGESDKPLEEVLNDEFRVQYYRDYIGAMVDAVAQDGVNVKAYMAWSLLDNFEWSEGYRSRFGVTYVDYKNGQKRIPKKSALVIGELFNKYIRKE

SEQ ID NO: 15238 - protein, 463 aa, Methanocaldococcus jannaschii
  misc_feature (457)..(457): Xaa can be any naturally occurring amino acid
MFIDGKWINREDMDVINPYSLEVIKKIPALSREEAKEAIDTAEKYKEVMKNLPITKRYNILMNIAKQIKEKKEELAKILAIDAGKPIKQARVEVERSIGTFKLAAFYVKEHRDEVIPSDDRLIFTRREPVGIVGAITPFNFPLNLSAHKIAPAIATGNVIVHHPSSKAPLVCIELAKIIENALKKYNVPLGVYNLLTGAGEVVGDEIVVNEKVNMISFTGSSKVGELITKKAGFKKIALELGGVNPNIVLKDADLNKAVNALIKGSFIYAGQVCISVGMILVDESIADKFIEMFVNKAKVLNVGNPLDEKTDVGPLISVEHAEWVEKVVEKAIDEGGKLLLGGKRDKALFYPTILEVDRDNILCKTETFAPVIPIIRTNEEEMIDIANSTEYGLHSAIFTNDINKSLKFAENLEFGGVVINDSSLFRQDNMPFGGVKKSGLGREGVKYAMEEMSNIXTIIISK

SEQ ID NO: 15239 - protein, 216 aa, Halobacterium salinarum
MSHPNVLLLGAPGAGKGTQSRRLVDEFGVEHVTTGDALRANKTKDITHLDVEYDTPGAYMDAGELVPDAVVNEIVKTALDDADGYVLDGYPRNESQTEYLDSITDLDVVLYLDVDEDELVGRLTGRRVCEDCGATFHVSFNQPETEGVCDACGGSLYQREDDTLETARERITVYEENTAPVVEYFREQGVLAEVDGERTPDEVWTDVAAAVDERTA

SEQ ID NO: 15240 - protein, 120 aa, Solanum tuberosum
VRQTDEYGNPIQQTGGTMGEYGTTGTGYGTQAGHTTGVLGGEQRQHGTLGGMLHRSGSSSSSSSSEDDGHGGRRKKKGIKDKIKEKLPGGHRDDLAHSTATTTTTGYGMEGTHEKKGIME

SEQ ID NO: 15241 - protein, 509 aa, Hordeum vulgare
MEVESSSHGAGDEAASKFSLPVDSEHKAKSIRLFSFANPHMRTFHLSWISFFTCFVSTFAAAPLVPIIRDNLNLAKADIGNAGVASVSGSIFSRLAMGAICDLLGPRYGCAFLVMLAAPTVFCMSLIDDAAGYITVRFLIGFSLATFVSCQYWMSTMFNSKIIGTVNGLAAGWGNMGGGATQLIMPLVFHAIQKCGATPFVAWRIAYFVPGMMHVVMGLLVLTMGQDLPDGNLASLQKKGEMAKDKFSKVVWGAVTNYRTWIFVLLYGYCMGVELTTDNVIAEYYFDHFHLDLRTSGTIAACFGMANIVARPAGGYLSDLGARYFGMRARLWNIWILQTAGGAFCLWLGRAKALPESITAMVLFSICAQAACGAWFGVIPFVSRRSLGIISGLSGAGGNFGAGLTQLLFFTSSKYGTGRGLEYMGIMIMACTLPVALVHFPQWGSMLLPPNANATEEEFYAAEWSEEEKKKGLHIPGQKFAENSRSERGRRNVILATAATPPNNTPQHA

SEQ ID NO: 15242 - protein, 473 aa, Hordeum vulgare
GSFGKVKIAEHIITGHKVAIKILNRRKIKSMEMEEKVKREIKILRLFMHPHIIRLYEVIDTPADIYVVMEYVKSGELFDYIVEKGRLQEEEARRFFQQIISGVEYCHRNMVVHRDLKPENLLLDSKCNVKIADFGLSNVMRDGHFLKTSCGRPNYAAPEVISGKLYAGPEVDVWSCGVILYALLCGTLPFDDENIPNLFKKIKGGIYTLPSHLSPLARDLIPRMLVVDPMKRITIREIREHSWFKARLPRYLAVPPPDTAQQVKKLDDETLNDVIKMGFDKNQLTESLQKRLQNEATVAYYLLLDNKLRTTSGYLGAEYQESMDSSFSQISPETPSSASEARQYGSPGFGLRQHFAAERKWALGLQSRAHPREIITEVLKALQELNVCWKKIGHYNMKCRWSPGFFENMMHNNNGFGVESAIIEADGLGDKSTHIVKFEIQLYKTRGDKYLLDLQRVSGPQLLFLDLCSAFLT

SEQ ID NO: 15243 - protein, 231 aa, Spinacia oleracea
MSFTIPTNLYKPLATKPKHLSSSSFAPRSKIVCQQENDQQQPKKLELAKVGANAAAALALSSVLLSSWSVAPDAAMADIAGLTPCKESKQFAKREKQALKKLQASLKLYADDSAPALAIKATMEKTKKRFDNYGKYGLLCGSDGLPHLIVSGDQRHWGEFITPGILFLYIAGWIGWVGRSYLIAIRDEKKPTQKEIIIDVPLASSLLFRGFSWPVAAYRELLNGELVDNNF

SEQ ID NO: 15244 - protein, 378 aa, Propionibacterium freudenreichii subsp. shermanii
MDFSLTEDQQLMVDGFTELMNSEAWEKYFHECDENSEYPERWVKAICDLGFDRILLPEEYDGLGLGWQTLAAAYEALGRAGGPTYVLYQLPGWDTVIREGTEEQKKDILKFVGSGKQMLNYAMTEPSAGSSWDDMSTTYSRKGGKVYLNGHKTFITSSMKVPYLVVMARDADNMGTYTEWFVDMSLPGITKEPLHKLGLRMDSCADIYFDNVELREEDLFGTEGNGFKRGVKDFDLERFEVAMTNYGTAYCAFEDAAKYANQRVQGGEAIARKQLIQLKFADMKVDITNMRNMLYEIAWKADNDQLGRGDCSMAKYYCSHAAARVVDNALQTLAGVGVTGEHRVQRFYRDLRVDRVSGGTDEMMILAAGRGALRDYRS

SEQ ID NO: 15245 - protein, 112 aa, Bifidobacterium breve
LEVTKVEGNNVHTKVVVAGPVSSHKGINLPGVAVSLPALTEKDEADLRWAIRTGADIIAMSFVRFATDIDRAHEIMDEEGRRIPIVAKIEKPQALENLEEIVKTFDGIMVAA

SEQ ID NO: 15246 - protein, 112 aa, Bifidobacterium catenulatum
LEVTKVEGNNVYTKVIVAGPVSSHKGINLPGVAVSLPALTEKDEADLRWAIRTGADIIAMSFVRFATDIDRAHEIMDEEGRRIPVVAKIEKPQALENLEEIVKAFDGIMVAR

SEQ ID NO: 15247 - protein, 110 aa, Bifidobacterium longum bv. Infantis
VTKVEGNNVHTKVVVAGPVSSHKGINLPGVAVSLPALTEKDENDLRWAIQTGADIIAMSFVRFATDIDRAHEIMDEEGRRIPIVAKIEKPQAVENLEDIVKVFDGIMVAR

SEQ ID NO: 15248 - protein, 108 aa, Bifidobacterium longum
KVEGNNVYTKVVVAGPVSSHKGINLPGVAVSLPALTEKDEADLRWAIRTGADIIAMSFVRFATDIDRAHEIMDEEGRRIPIIAKIEKPQALENLEEIVKTFDGIMVAR

SEQ ID NO: 15249 - protein, 110 aa, Bifidobacterium adolescentis
VTKVEGNNVYTKVVVAGPVSSHKGINLPGVAVSLPALTEKDEEDLRWAIRTGADIIAMSFVRFATDIDRAHEIMDEEGRRIPVVAKIEKPQALENLEEIVKAFDGIMVAR

SEQ ID NO: 15250 - protein, 111 aa, Bifidobacterium angulatum
EVTKVEGNNVHTKVVVAGPVSSHKGINLPGVAVSLPALTEKDEEDLRWAIRTGADIIAMSFVRFATDIDRAHEIMDEEGRRIPVVAKIEKPQALENLEEIVKAFDGIMVAR

SEQ ID NO: 15251 - protein, 111 aa, Bifidobacterium animalis
EVTKVEGNNVYTKVVVAGPVSSHKGINLPGVAVSLPALTAKDEEDLRWAIRTGADIIAMSFVRFATDIDRAHEIMDEEGRRIPVVAKIEKPQAVENLEDIVKVFDGIMVAR

SEQ ID NO: 15252 - protein, 112 aa, Bifidobacterium bifidum
LEVTKVEGNNVHTKVVVAGPVSSHKGINLPGVAVSLPALTEKDENDLRWAIQTGADIIAMSFVRFATDIDRAHEIMDEEGRRIPIVAKIEKPQAVENLEDIVKVFDGIMVAR

SEQ ID NO: 15253 - protein, 111 aa, Bifidobacterium longum
EVTKVEGNNVYTKVVVAGPVSSHKGINLPGVAVSLPALTEKDEADLRWAIRTGADIIAMSFVRFATDIDRAHEIMDEEGRRIPIIAKIEKPQALENLEEIVKTFDGIMVAR

SEQ ID NO: 15254 - protein, 111 aa, Bifidobacterium pseudolongum
EVTKVEGNNVHTKVVVAGPVSSHKGINLPGVAVSLPALTEKDENDLRWAIQTGADIIAMSFVRFATDIDRAHEIMDEEGRRIPIVAKIEKPQAVENLEDIVKVFDGIMVAR

SEQ ID NO: 15255 - protein, 111 aa, Bifidobacterium thermophilum
EVTKVEGNNVYTKVVVAGPVSSHKGINLPGVAVSLPALTEKDEADLRWAIRTGADIIAMSFVRFATDIDRAHEIMDEEGRRIPIVAKIEKPQAVANLEDIVKTFDGIMVAR

SEQ ID NO: 15256 - protein, 112 aa, Bifidobacterium longum bv. Suis
LEVTKVEGNNVYTKVVVAGPVSSHKGINLPGVAVSLPALTEKDEEDLRWAIRTGADIIAMSFVRFATDIDRAHEIMDEEGRRIPVVAKIEKPQALENLEEIVKAFDGIMVAR

SEQ ID NO: 15257 - protein, 112 aa, Bifidobacterium longum bv. Suis
LEVTKVEGNNVYTKVVVAGPVSSHKGINLPGVAVSLPALTEKDEADLRWAIQTGADIIAMSFVRFATDIDRAHEITDEEGRRIPVVAKIEKPQALENLEEIVKAFDGIMVAR

SEQ ID NO: 15258 - protein, 391 aa, Myxococcus xanthus
MADDYYQTLGVDRSASAEDVKKAYRKLARKYHPDVNPGNKAAEEKFKQVSAAFEVLSDTRKRKLYDEFGPDAEKIGFDEKKAEAYRAYKASAGSAGAGGIPYGAEGFDLGDLFGDLFGGRGGGAAGGAPGGFDIGEMFGRRGRNAGPERGEDLTVRVQLTLAEAVSGTERPLAFNRPGRCSTCSGRGTSGPVSTCNVCNGTGRARRSGSLFGGAGACPNCHGTGKAAPPCPQCGGAGVKEELARLTVKIPAGVHTGSKVRLSGQGAAGTRGGPPGDLYIETEVAEHPLVRREGDDLHLDLPVTVSEALLGADVRVPTFQGEVTVKVLPHSQSGRRMRLKGRGVPSLKGGAQGDLYLHLQVKVPEETTAEARAAAEALARAYQGDVRRELTL

SEQ ID NO: 15259 - protein, 349 aa, Myxococcus xanthus
MIPVRGYAAQDAKSPLAPFQFERREPGPSDVQIEILYCGVCHSDLHQVRDEWGGSRFPMVPGHEIIGRVVRVGDQVKKVKVGDMAGVGCMVDSCRTCPSCQEGLEQYCEKGNVQTYNGKEKDGQTATQGGYSEAIVVDEAFTLKIPENLDPAAAAPLLCAGITTYSPLRHWKVQPGQRVGVVGLGGLGHMGVKLAKAMGAHVTVFSHTDSKKQDATRLGADAVVVSSNKEEMAAQTGGFDFILDTVSAQHDINAYLRLLRRDGHLVLVGAPEKPLDVRPFSLIPTRRSFSGSMIGGIQETQEMLDFCGKHNIVSDIELISIQQVNDAYERLLKGDVKYRFVIDLASLRK

SEQ ID NO: 15260 - protein, 166 aa, Datura ferox
  misc_feature (36)..(36): Xaa can be any naturally occurring amino acid
SMGGACGKGDLYSQGYGTNTAALSTALFNNGLSCGXCFELKCGGDSKWCLPGSIVVTATNFCPPNYALPNNAGGWCNPPLHHFDLSQPVFQQMAQYRAGIVPVAYRRVRCQKRGRIRFTMNGHSYSNLVLVTNVGGSGDVNAVSVKGSRTDWILMSRNWGQNWQDP

SEQ ID NO: 15261 - protein, 164 aa, Datura ferox
SMGGACGYGNLYSQGYGVNNAALSTVLFNNGLSCGACFELKCVNDGKWCLPGNPSIFVTATNFCPPNFALPNDDGGWCNPPRPHFDLAMPMFLKIGQYRAGIVPVTYRRVACRKQGGIRFTINGFRYFNLLLVTNVAGAGDLQKVLIKGTNTQWIAMSRNWGAK

SEQ ID NO: 15262 - protein, 147 aa, Theobroma cacao
MSNDQNKPMTQKLYESAPSSRQAAKFLTATTLGATLLFLSGLTLTGTVMALIMATPLMVIFSPILVPAGVVIFLVITGFLFSGGCGVAAITALSWIYNYVRGKHPPGADQLDYARNTLARTARDMTEKAKEYGQYVQHKAQEVAQGS

SEQ ID NO: 15263 - protein, 396 aa, Hevea brasiliensis
MASASLLKSSPVLDRSEFVKGQSLRQPSASIIRCHPASSSALTILAGSYADELVKTAKTVASPGRGILAMDESNATCGKRLASIGLENTEANRQAYRTLLVTAPGLGQYISGAILFEETLYQSTTDGKKMVDVLIEQNIVPGIKVDKGLVPLPGSNNESWCQGLDGLASRTAAYYQQGARFAKWRTVVSIPNGPSALAVKEAAWGLARYAAISQDNGLVPIVEPEILLDGEHGIDRTFEVALKVWAEVFYYLAENNVLFEGILLKPSMVTPGAECKDKATPQQVSDYTLKLLKRRIPPAIPGIMFLSGGQSEVEATLNLNAMNQGPNPWHVSFSYARALQNTCLKTWAGRPENVKAAQEVLLVRAKANSLAQLGKYTGEGESEEAKKGMFVKGYVY

SEQ ID NO: 15264 - protein, 428 aa, Hordeum vulgare
MKMMAMAEAPCLCARPFLAARAWRPGPAPRLRRWRPNATAGKGVGEVCAAAVEAATKAEEEEDEEEEPVAEDRYALGGACRVLAGMPAPLGATALAGGVNFAVYSGGATAAALCLFTPEDLKADRVSEEVPLDPLMNRTGDVWHVFLEGELHGMLYGYRFDGTFAPHCGHYFDVSNVVVDPYAKAVISREEYGVPAHGNNCWPQMAGMIPLPYSTPDWEGDLPLRYPQKDLVIYEMHLRGFTKHDSSNVEHPGTFIGAVSKLDYLKELGVNCIELMPCHEFNELEYATSSSKMNFWGYSTINFFSPMTRYTSGGIKNCGRDGINEFKTFVRESHKRGIEVILDVVFNHTAEGNENGPILSFRGVDNTTYYMLAPKGEFYNYSGCGNTFNCNHPVVRQFIVDCLRYWVMEMHIDGFRFDLASIMTRGSR

SEQ ID NO: 15265 - protein, 344 aa, Hordeum vulgare
MKMMAMAEAPCLCARPFLAARAWRPGPAPRLRRWRPNATAGKGVGEVCAAAVEAATKAEEEEDEEEEPVAEDRYALGGACRVLAGMPAPLGATALAGGVNFAVYSGGATAAALCLFTPEDLKADRVSEEVPLDPLMNRTGDVWHVFLEGELHGMLYGYRFDGTFAPHCGHYFDVSNVVVDPYAKAVISREEYGVPAHGNNCWPQMAGMIPLPYSTFDWEGDLPLRYPQKDLVIYEMHLRGFTKHDSSNVEHPGTFIGAVSKLDYLKELGVNCIELMPCHEFNELEYATSSSKMNFWGYSTINFFSPMTRYTSGGIKNCGRDGINEFKTFVRESHKRGQQQYILP

SEQ ID NO: 15266 - protein, 329 aa, Saccharomyces cerevisiae
MRSIKCVIIGDGAVGKTSLLISYTTNSFPTDYVPTVFDNYSTTIAIPNGTASSPLELDNGNDKRGSLSSASSSPSTDRKLYKINLWDTAGQEDYDRLRPLCYPQTDIFLICFSVSEHASFANVTEKWLPELKQTSNIEGTSLYTKLGKYPILLVGTKSDLRDDPATQKKLQEANSDYVSQEEIDELVQRCGFMGYTECSAATQAGVREVFEQAVRYAIYEPESPNQKSANHTLTDELTTATTNTNGDKNIREQKQQPHHNNSTDSTLPKGSLQQEKEALNIKPTKKGQKDKIHEQSKSKGSKIASNNIITTSKLNQRRETTRRKRSQSV

SEQ ID NO: 15267 - protein, 353 aa, Arthrobacter sp. KUJ8602
MEELRIEANGNLGPIDSSRIPRYAGAATYARLPRLDQVSKADVTVVGVPFDSGVSYRPGARFGANHVREASRLLRPYNPAWDVSPFENIQVADAGDMAVNPFNINEAIETIQQNALDLTANGSKLVTLGGDHTIALPLLRAAAERAGEPIAMLHFDAHLDTWDTYFGAEYTHGTPFRRAVEEGILDTEAISHVGTRGPLYGKKDLDDDHRFGFGIVTSADVYYQGVLETVAKIRDRIGNRPLYISVDIDVLDPAHAPGTGTPEAGGITSRELLEIIRGFRGMNLVGADVVEVAPAYDHAEITGVAGSHVAYELVTLMADNAVEGDRHGAPNGYAQQALGARIQEVAQAIGGQR

SEQ ID NO: 15268 - protein, 261 aa, Hymenophyllum acanthoides
MSVRNRFEDKRKLGGLIGAFLEKATKGYVSSEREKDRHITIDTNKGLWTRCDNCGNMLYVRFLKQNKSVCEECGYHPPMTSTERIELLIDRDTRIPMDEDMTAQDVLSFSDEDSHQNRIITSQKRTGLTDAVQTGIGYLNGTPLALGVMDFQFMGGSMGSVVGEKITRLIEYATDKSLPIIIVCASGGARMQEGTLSLMQMAKISSVLQIHQVQRNLLYISVLTYPTTGGVTASFGMLGDIIIAESKAYIAFAGKRVIEQT

SEQ ID NO: 15269 - protein, 366 aa, Galactomyces geotrichum
MLFSTTAILAMAAMVAAAPADGDLHARASCTFKDAKSAIAGKKSCSNIVLQDIAVPAGETLDLTGLNKGTVVTFAGTTTFGYKEWVGPLISVSGDSITVNQASGGKIQCDGARWWDGKGSNDGKIKPKFFYAHKMQNSNINGLQVYNTPVQGFSILSDHLTLSNILIDNRAGDKTNGGHNTDAFDVGSSTYITIDHATIYNQDDCLAINSGDHITFQNGYCSGGHGLSIGSVGGRSNNVVSNVNILSSQVVNSDNGVRIKTVSGATGSVTGVKFQDITLSNIAKYGIDVQQDYKNGGPDGKPTNGVKISGITFSNIHGSIKSSGTKAYLLCGSGSCSNFTWNKINLTGGKTSGACKNVPSPATCNI

SEQ ID NO: 15270 - protein, 381 aa, Citrobacter freundii
  misc_feature (252)..(252): Xaa can be any naturally occurring amino acid
MIRAAHIAHLRRESPFDGGMPPTPPTILRERLLAQQQARVEELRHAKYEGILDGNSAITVLHGEARFKDDQSLIVSLNEGGERVVMFDRCLVATGASPAVPPIPGLKESPYWTSTEALASDTIPERLAVIGSSVVALELAQAFARLGSKVTALARNTLFFREDPAIGEAVTAAFRAEGIEVLEHTQASQVAHMDGEFVLTTTHGEIRADQLLVATGRAPNTRSLALETAGVAVNAQGAIVIDKGMRTSSPHXYAAGDCTDQPQFVYVAAAAGTRAAINMTGGDAALDLTAMPAVVFTDPQVATVGYSEAEAHHDGIETDSRPLTLDNVPRALANFDTRGFIKLVIEEGSGRLIGVQAVAPEAGELIQTAVLAIRNRMTVQE

SEQ ID NO: 15271 - protein, 389 aa, Beta vulgaris
MAIDCMRNLSSTPKSYQNSKQEQNNPLIFDASFLNHQSHIPQQFIWPDGEKPDFIEPEELAVPLIDLQGFLSDDPEKTLKASKLIGEACLKHGFFLVVNHGVERDLIKDAHNLMDDFFEEPLSLKQKALRKLGEHCGYASSFTGRFSCNLPWKETLSFNYSPQESSSSKTHVQDYFNNKFGDSFNHLGTTYQQYCEAMSTLSLRIMELLGLSLGVGRRHFREFFEGHESVMRLNYYPPCQRPDLTLGTGPHCDPTSLTILHQDQVGGLQVFADGKWRSISPNFNAFVVNIGDTFMALSNGRYKSCLHRAVVNSEKPRKSLAFFLCPNKDKVVKPPRELVDEENNPRVYPDFTWPLLLEFTQKHYRADMNTLKVFSQWVQQQRSTQQVEK

SEQ ID NO: 15272 - protein, 300 aa, Pseudomonas putida
MTHLKITGMTCDSCAAHVKEALEKVPGVQSAIVSYAKGAAQLALDPGTAPDALTAAVAGLGYKAMLADAPPTDNRTGLFDKVRGWMGAADKGSGGERPLQVAVIGSGGAAMAAALKAVEQGAQVTLIERGTIGGTCVNVGCVPSKIMIRAAHIAHLRRESPFDGGMAPTPPTILRERLLAQQQARVDELRHAKYEGILDGNPAITVVHGEAHFKDDQSLAVRLNEGGERVVIFDRCLIATGASPAVPPIPGLKESPYWTSTEALVSDTIPERLAVIGSSVVALELAQAFARLGSQVTILA

SEQ ID NO: 15273 - protein, 343 aa, Pseudomonas fulva
MTTLKITGMTCDSCAVHVKDALEKVPGVQSADVSYAKGSARLAIEAGTSPDALTAAMAAALAKTGYRATLADAPVAPVGGGLLGKMREWLGSEDKTGGDGGKLHIAVIGSGGAAMAAALKAVEQGARVTLIERGTIGGTCVNVGCVPSKIMIRAAHIAHLRRESPFDSGITAAEPAIQRTRLLAQQQARVDELRHAKYEGILESNPAITVLHGAARFKDNRNLVVQLNGGGERTVTFDRCLVATGASPAVPPIPGLKDTPYWTSTEALVSETIPKRLAVIGSSVVALELAQAFARLGSKVTILARSTLFFREDPAIGEAVTAAFRAEGIEVREHTQANQVTYM

SEQ ID NO: 15274 - protein, 337 aa, Pseudomonas stutzeri
MTHLKITGMTCDSCAAHVKEALEKVPGVQSAIVSYAKGAAQLALDPGTAPDALTAAVAGLGYKAMLADAPPTDNRTGLFDKVRGWMGAADKGSGGERPLQVAVIGSGGAAMAAALKAVEQGAQVTLIERGTIGGTCVNVGCVPSKIMIRAAHIAHLRRESPFDGGMPPTPPTILRERLLAQQQARVEELRHAKYEGILDGNSAITVLHGEARFKDDQSLIVSLNEGGERVVMFDRCLVATGASPAMPPIPGLKESPYWTSTEALVSDTIPERLAVIGSSVVALELAQAFARLGSQVTILARSTLFFREDPAIGEAVTAAFRAEGIKVLEHTQANQVG

SEQ ID NO: 15275 - protein, 134 aa, Pseudomonas aeruginosa
  misc_feature (85)..(85): Xaa can be any naturally occurring amino acid
PSKIMIRAAHVAHLRRESPFDGGLPATPPLVLRERLLAQQQGRVDELRHAKYEGILESTPAITVLRGSARFQDSHTLSVELVEGXERIVTFDRCLIATGASAAVPPIPGLQDTPFWNSEKALASSSIPQRLAVI

SEQ ID NO: 15276 - protein, 512 aa, Corynebacterium glutamicum ATCC 13032
MKVNLGIGSYPRRRATVRPESTAIEFEGTSITYGEFSKRVNRLGHALLDLGVAHQDRVAYVGFNHPALLEVFFSTNLIGATPVLVNPRLSANEIDYIIQDSGASIVFYGIDLIEHATYLQELHPEIIMVAVEGDEGPGLRRKALIEAASDADIDLEVSDDDIALLMYTSGTTGRPKGAMLSHRNLFFNYFNALLSQEIEQGAVLLSTAPLFHIAGLNMTTIPVMMKGGKVIIHREFRAEHVLDEIERSKVSESFMVPAMIDMLSNHPSFAERDLSSLRAIMVGGSPLSERALRIWQGRDVKIVQGFGMTETAPGACILEATDTSTHLGTAGRAHFFTDIKLVDPKTGEEVPTGEAGEVLIRGPHVMTGYWNRPEDTASALQNGWYHSGDIAIKDEDGYYTIKDRIKDMYISGGENIYPAEVEQALQELEAVLDAAVIGVPDERWGETGIAFVSIRESYLTNPPTGPELRELLGSVLARYKLPREIHIIEELPRNATGKIQKNILRDFTIPVS

SEQ ID NO: 15277 - protein, 403 aa, Corynebacterium glutamicum ATCC 13032
MNPLRTNQWGIKYSSCMSNDFVVSRLRPFGETIFATMTQRAVEAGAINLGQGFPDEDGPRRMLEIASEQILGGNNQYSAGRGDASLRAAVARDHLERFDLEYNPDSEVLITVGATEAITATVLGLVEPGDEVIVLEPYYDAYAAAIALAGATRVAVPLQEVENSWDVDVDKLHAAVTKKTRMIIVNSPHNPTGSVFSKKALKQLAGVARAYDLLVLSDEVYEHLVFDDQKHVSVAKLPGMWDRTVTVSSAAKTFNVTGWKTGWALAPEPLLEAVLKAKQFMSYVGATPFQPAVAHAIEHEQKWVSKMSKGLELKRDILRTALDKAGLKTHDSMGTYFIVADIGDRDGAEFCFELIEKVGVAAIPVQAFVDHPKKWSSKVRFAFCKKEETLREAAERLKGIKKL

SEQ ID NO: 15278 - protein, 491 aa, Corynebacterium glutamicum ATCC 13032
MRYPAMTSGKSTSTRGALDRYFKISERGSSIGTEIRAGVVTFFAMAYIIILNPLILGTTPDVEGNTLGIAQVAAATALAAGVMTIAFGLIARYPFGIAAGLGINTMVAVTLVSGEGLTWPEAMGLVVLDGVVIVILAVSGFRVAVFRAIPASMKAAISVGIGLFIAMIGLVDAGFVRRIPDAAGTTVPVTLGIDGSIASWPTFVFVVGVLLCGILVVRRVRGGLFIGILGTTILAIIAEAIFDSGASFENGEANAEGWSLAVPGLPDSFGGIPDLSIVGAVDLIGAFSRIGVVAATLLIFTLVLANFFDAMGTMTALGKQGNLVDDEGNLPDIKKALVVEGAGAIVGGAFSASSNTVFADSSAGVADGARTGLANVVTGSLFLAAMFLTPLYEIVPIEAAAPVLVVVGAMMMGQVTEIDFSKFYIAFPAFLTIVIMPFTYSIANGIGVGFIMYAIMAAAAGKAKQVHWLMWLVAGLFVVFFAIDPIMEAVG

SEQ ID NO: 15279 - protein, 166 aa, Corynebacterium glutamicum ATCC 13032
MTQSAPEFIATADLVDIIGDNAQSCDTQFQNLGGATEFHGIITTVKCFQDNALLKSILSEDNPGGVLVIDGDASVHTALVGDIIAGLGKDHGWSGVIVNGAIRDSAVIGTMTFGCKALGTNPRKSTKTGSGERDVVVSIGGIDFIPGHYVYADSDGIIVTEAPIKQ

SEQ ID NO: 15280 - protein, 466 aa, Corynebacterium glutamicum ATCC 13032
MKNKRVAIIGAGPSGIAQLRAFESAEKQGHEIPELVCFEKQDTWGGQWNYSWRTGTDSYGEPVHSSMYRNLWSNGPKEVLEFAEYSFDEHFGKPISSYPPREVLWDYIAGRAKKSNVEKYIKFAHVVRWVSFDEATKLFTVTVENLRTGETSSDTYDNVIVGAGHFSFPNVPHFDGVETFPGQIMHAHEFRGAEAVADKDILLIGASYSAEDIGTQAYKMGARSVTFSYRSNPMGYEWPEEMTELPLVERFDGSEVHFVNGEKRKVDIVVFCTGYLHHYPFMPSELTLSSPNNLYPDTLYRGVVSEANNQLFWLGAQDQWLTFNMFDAQAWYVRDVILGRVALPSKEAQRNHMDKWLSRFEGLKSENDQIDFQCDYVEDLIDQTDYPSFDLKEVANILKGWVKSKEEDILNYRDYTYTSVMTGTTSVEHHTPWMIELDDSLERYLSEPQEDEARQVYRGKKVRDKA

SEQ ID NO: 15281 - protein, 250 aa, Corynebacterium glutamicum ATCC 13032
MIDAQQVCKNYGRLEVLKGIDLQVPKGTVTCLIGPSGSGKSTMLRCVNHLEKVNAGRLYVDGDLIGYRERDGVLYEISEKDAAKQRSDIGMVFQNFNLFPHRTVIENIIEAPIHVKKQPESKARARAMELLEQVGLAHKADAYPVQLSGGQQQRVAIARAVAMEPKLMLFDEPTSALDPELVGEVLRVMKQLADDGMTMLVVTHEMGFAHEVADQVVFMADGVVVEAGTPEQVLDNPKEQRTKDFLSSLL

SEQ ID NO: 15282 - protein, 1004 aa, Corynebacterium glutamicum ATCC 13032
MPGKLRVHELAKQLGITSKELLATLKDKGEFVKTASSTIEPPVVKRMQEHYGSSGSDKSDTAAKPAAAKPAAPKPAASAAPKPGAPAKPAAPAAKPAPAAPSAASAAKPGAAPKPGVQAKPAAAAKPGAPAKPAAPAAPSAAKSGSAPKPAAAAKPAFSGPTPGDAAKKAEPAAKPGAEAPRPGGMPRPMGKPAPKPGARAPRVANNPFSTGGGERPAPRPGGGPRPGGGPRPGGGPRPQGQGRPGGQRDGQRDGQRDGQGNRGGQRQGAGAGGPRPQGGPRPQGGSRPQGGSAQGAQGAPSQERQGGGRRPSPAMMPPTPGQMPAKAPGKGGRGGQAGGGAGGGFNRGGGTGGGAGRGGRRGGTAGAFGRPGGAPRRGRKSKRQKRNEYESMQAPNVIGGVRLPDGKGATIRLARGASLADFADKIGADAAALVQALFNLGEMVTATASVSDETLQLLGEEMNYKVQVVSPEDEDRELLESFDLQFGEDEGGEADLAKRPPVVTVMGHVDHGKTRLLDTIRKANVGSDEAGGITQGIGAYQVKVNVEDTERTITFLDTPGHEAFTAMRARGAKSTDIAVLVVAADDGVMPQTVEAINHAKAADVPIVVAVNKIDKPEASPEKIRGQLTEYGLIPEEYGGDTIFVDISAKQGLNIDELLASVCLTADAELDLVANPEMDAQGVAIEAHLDRGRGPVATVIVQRGTLRVGDSIVAGDTYGRVRRMVDEYGRDVEEAGPSRPVQVQGLNGVPGAGDNLLVVEDDRIARQIANQRNARKRNALAARSRKRVSLEDLDSVLKEHSTLNLILKGDNAGSVEALEEALLKIEMDDEVQLNIIDRGVGAVTQTNVTLAAASDAVIIAFNVRAEGKATEEANAEGVDVRYYTIIYRAIEEVEAALKGMLKPIYEERVIGHAEIRAIFKASSVGLIAGCMVEDGKVRRNATVRIIRDGNVIAENAKIVSLRREKDDATEVSAGYECGMVLSYPDISVDDKIEVYEMVEVPREA

SEQ ID NO: 15283 - protein, 475 aa, Corynebacterium glutamicum ATCC 13032
MDRRTKIVCTLGPAVASADGILRLVEDGMDVARLNFSHGDHPDHEQNYKWVREAAEKTGRAVGILADLQGPKIRLGRFTDGATVWENGETIRITVDDVEGTHDRVSTTYKNLAKDAKPGDRLLVDDGKVGLVCVSVEGNDVICEVVEGGPVSNNKGVSLPGMDISVPALSEKDIRDLRFALKLGVDFIALSFVRSPADAELVHKIMDEEGRRVPVIAKLEKPEAVTSLEPIVLAFDAVMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRVARLHSHLPLLVFTPNEAVRSELALTWGATTFLCPPVSDTDDMMREVDRALLAMPEYNKGDMMVVVAGSPPGVTGNTNMIHVHLLGDDTRIAKL

SEQ ID NO: 15284 - protein, 460 aa, Corynebacterium glutamicum ATCC 13032
MTMCDYFTSSRRISVASQISGGWQSAKHRTTVYMVLVVVGISILFDGYDLVIYGAVLSTLLEDPTQIGALSPAVAGTLGSYAMIGVMIGALSAGAVGDRLGRRKVMLTAIVWFSVGMALTAFASSIALFGFLRFLTGLGVGMIVATGGAIIAEFAPANRRNLFNAIVYSGVPAGGVLASILALLFEDVIGWRGLFLIGGSPLLFLLPLAYFFLPESPRWLTSRGRAADAKALCARYGLPTEEFVVEKQQETKGTGFAGIFSSKYLMGTILIGAMSFIGLLSTYGLNTWLPKIMESNGATSHDSLYSLLFLNGGAVFGGLIASWFADRIGAKTVITSTFALAAICLGVLPNISSWPMMYTAIAFAGVGVLGTQVLTYGLTSNFFGTECRAAGVAWCAGFGRLGGIVGPAIGGLIIGAGFGPSSAFLIFAAAAAIGAVCTLLIPRSPAEVEVKVAQEPLARV

SEQ ID NO: 15285 - protein, 438 aa, Corynebacterium glutamicum ATCC 13032
MQAKEEEKRAFDNDRAHVFHSWSAQDKISPKVWAAAEGSTLYDFDGNAFIDMGSQLVSANLGHNNPRLVEAIQRQAARLTNINPAFGNDVRSDVAAKIVSMARGEFSHVFFTNGGADAIEHSIRMARLHTGRNKILSAYRSYHGATGSAMMLTGEHRRLGNPTTDPDIYHFWAPFLHHSSFFATTQEEECERALKHLEDVIAFEGAGMIAAIVLEPVVGSSGIILPPAGYLNGVRELCNKHGILFIADEVMVGFGRTGKLFAYEHAGDDFQPDMITFAKGVNAGYAPLGGIVMTQSIRDTFGSEAYSGGLTYSGHPLAVAPAKAALEIYAEGEIIPRVARLGAELIEPRLRELAEENVAIADVRGIGFFWAVEFNADATAMAAGAAEFKERGVWPMISGNRFHIAPPLTTTDDELVALLDAVEAAAQAVELTFAGALF

SEQ ID NO: 15286 - protein, 308 aa, Corynebacterium glutamicum ATCC 13032
MYNNITETIGHTPLVKLNKLTEGLDATVLVKLESFNPANSVKDRIGLAIVEDAEKSGALKPGGTIVEATSGNTGIALAMVGAARGYNVVLTMPETMSNERRVLLRAYGAEIVLTPGAAGMQGAKDKADEIVAERENAVLARQFENEANPRVHRDTTAKEILEDTDGNVDIFVASFGTGGTVTGVGQVLKENNADVQVYTVEPEASPLLTAGKAGPHKIQGIGANFIPEVLDRKVLDDVLTVSNEDAIAFSRKLATEEGILGGISTGANIKAALDLAAKPENAGKTIVTVVTDFGERYVSTVLYEDIRD

SEQ ID NO: 15287 - protein, 484 aa, Corynebacterium glutamicum ATCC 13032
MTATFAGIDATKHLIGGQWVEGNSDRISTNINPYDDSVIAESKQASIADVDAAYEAAKKAQAEWAATPAAERSAIIYRAAELLEEHREEIVEWLIKESGSTRSKANLEITLAGNITKESASFPGRVHGRISPSNTPGKENRVYRVAKGVVGVISPWNFPLNLSIRSVAPALAVGNAVVIKPASDTPVTGGVIPARIFEEAGVPAGVISTVAGAGSEIGDHFVTHAVPKLISFTGSTPVGRRVGELAINGGPMKTVALELGGNAPFVVLADADIDAAAQAAAVGAFLHQGQICMSINRVIVDAAVHDEFLEKFVEAVKNIPTGDPSAEGTLVGPVINDSQLSGLKEKIELAKKEGATVQVEGPIEGRLVHPHVFSDVTSDMEIAREEIFGPLISVLKADDEAHAAELANASDFGLSAAVWSKDIDRAAQFALQIDSGMVHINDLTVNDEPHVMFGGSKNSGLGRFNGDWAIEEFTTDRWIGIKRS

SEQ ID NO: 15288 - protein, 194 aa, Corynebacterium glutamicum ATCC 13032
MADHKDLNVPANPYGTDIESVLISEEKLKQRIAEMAKRVSEEFKDAEEDLILVCVLKGAFYFLADFSRMLDIPTQSEFMAVSSYGNSTSSSGVVRILKDLDKEIEGRDVLIVEDIIDSGLTLSWLMRNLKNRNPKSLNVITLLRKPERLTTNIDMFDIGFDIPNEFVVGYGLDFAERYRDLPYVGTLEPHVYSD

SEQ ID NO: 15289 - protein, 448 aa, Corynebacterium glutamicum ATCC 13032
MSQRVIFSGMNLTRNDRLDRLPVTSKHKKILGGSGIGWALDAMDVGLISFVMAALATHWGLSPTETSLLGSIGFVGMAIGASLGGLLADKLGRRQVFALSLLVYGVATGASALSVSLAMLMALRFVVGLGLGAELPVASTLISEFSPRKVRGRMVVILEAFWALGWIMAAIVGTFVVAGSDNGWRWALALGCVPAIYAVYVRLGLPESVRFLEKKGRHDEAEAIVVSFEEAAAAEGKAADATTAVVHDNAAEGSVSIWSAALRKRTVALWIVWFCINLSYYGAFIWIPSLLVADGFTLVKSFQFTLIITLAQLPGYAVAAWLIEKWGRRSTLATFLVGSAISAALYGLANVEWQILVAGCLLSFFNLGAWGALYAIGPELYPTNVRGTGTGAAAGFGRIASIIAPLIVPPVIAFGGPIALFALFATAFAIAAIAAFTLPEQKGKSLAD

SEQ ID NO: 15290 - protein, 448 aa, Corynebacterium glutamicum ATCC 13032
MPESILGRMDTKLGAELGTEFDLIVVGFGKAGKTIAMKRSAAGDKVALIEQSPQMYGGTCINVGCIPTKKLLFETATGKDFPDAVVARDQLIGKLNAKNLAMATDKGVTVIDGKATFTASHEITVTSGSDTLVLYAPTIVINTGSTPVIPNVPGTDNPHVFDSTGIQHISPLPKHLAIIGGGPIGLEFATLFSGQGSKVTIIDRGELPLKNFDREVAELAKTDLEARGITFLNNAELTGFSGDLTIALKDHDLLADAALLAIGRRPATDGLGLEQAGIKTGTRGEVLVDAHLRTNIDGIFAVGDVNGGPQFTYVSYDDHRIVLDQLAGTGKKSTAHRLIPTTTFIEPPLSTIGDNTEGENVVVKKALIADMPIVPRPEIINQPHGMVKFFVDKQSDALLGATLYCADSQELINTVALAMRHGVTASELGDGIYTHPATSEIFNQLLGS

SEQ ID NO: 15291 - protein, 370 aa, Corynebacterium glutamicum ATCC 13032
MDFWTILDTMTSLLTPIAIRGLEIPNRMWLAPMCQYQANNLDGVPLDWHLVHYGARAVGGFGLLIAESTGISPEGRISSRCTGLWNEAQVEAWERITNFVHAQGGLIGVQLNHAGRKASTYPALPNFPTGTQSVDEGGWETFGPSAVAQPGLADPTELTREGIEKVIQDFAAAAERAVRAGFDAVEVHGAHGYLLHQFLTPVANKRTDIYGGSFENRTRLFREVAQAIRAVIPGSMPLIARISATDWIDDEPSWDDDQTVSLVSDLKKLGVDAVDISTGGAVPATIPVEPSYQVKFARRVKQEVGIPTSAVGLITHVGQAQGHLDRGDADIISLGRAALRYPSWPLFAAHELGKTRDEIPYPPSYVRGAW

SEQ ID NO: 15292 - protein, 364 aa, Corynebacterium glutamicum ATCC 13032
MEPLVSKLFTPIQIRDITIPNRVWMSPMCTYSAATGSGLPTDFHQAHYAARAAGGVGLVMVEATGVNPVAPISPVDLGLWSHDQIEPFSRVTAAIRAGGAVPAVQLAHAGRKASTDAPWNGGGYVGPETNGWETVGPSPLAFPGLPAPRELTVSEIQEVVQQFAGAAVRADQAGFDVVEIHAAHGYLLHNFLSPISNKRTDSYGGSLENRARIVLEVIDAIRAVWPEEKPVFMRISTTDWVEENPQDDRESWTLSQSRQLALWASEHGVDLIDASSGGLDIVPIPHDRDYQTAKAADLHASTGVTVAAVGRIDDAQTAHNLVDSGDVNAVFLGRPLLKDPSWANQAALALGAEPRYVHQYDYVL

SEQ ID NO: 15293 - protein, 343 aa, Saussurea medusa
MALLVSSWSNGVQSVPKDYVMPPERRPGDFVSACNEIPVIDLQENPKIDRSDIVQQILKACQEFGLFQVINHGVSEKMMEDMRVLYHEFFNMPVDDKLRGYFEPWSTTGCSLYTSGVNYAKEDVHYWKDTLRHPCHPLEEHTPSWPEKPARYREEVGRYAVEVRKMGFKILDLIGEGLGLNEGYFNGVNQYQTMAINHYPLCPDPGLAMGIDGHTDPNLITFLQQDQYGLQMCKDGKWMGIDPIPNAFVVNIGYQLEIISNGKLKSAEHRVVTSSTTARTSIVTFFGPNAGLPIVVEPAKELVTSTSPKMFKSYQYNNFIADYLAYIRKPFPPSGTPLDPYRV

SEQ ID NO: 15294 - protein, 382 aa, uncultured proteobacterium
MSKRDYYETLGISKGATAEEIKKAYRRKAKELHPDRNADNPASEGLFKEANEAYEVLKDSNKKAAYDRYGHAAFEGGMGGGGGGRPGGQGDFSSAFSDVFDDLFGDFMGGRGGGGRQRAARGADLRYNMHVTLEEAFRGLQKTINVPTAVSCANCSGTGAASGSAPATCGTCSGMGKVRAQQGFFTVERTCPSCSGAGQVIKNPCSSCHGAGRVEKDRALSVNIPAGVETGTRIRLSGEGEAGARGGPQGDLYIFIEVADHQIFEREGNNLFCNVPVSMTSAALGGDIEVPNIDGGRSRVKIPSGSQSGRQMRLRSKGMPSVRGGGVGDMFIELQVETPVNLTARQKEILKEFEALSSDNSPESQGFFKKVKRFWDGVKGQE

SEQ ID NO: 15295 - protein, 203 aa, Yarrowia lipolytica
MSHSQRTYDLLIKLLLIGDSGVGKSCLLLRFCEDQFTPSFITTIGIDFKIRTIDIGNQRVKLQVWDTAGQERFRTITTAYYRGAMGILLVYDVTDEKSFNNIENWYQNVQTYANEGVELILVGNKCDLDEKRVVSTEQGQALADKFGIPFLEASSKTNINVEECFYSVATRIRDTVAKTKGNESGSGGINIAEGEENSASKCC

SEQ ID NO: 15296 - protein, 208 aa, Podospora anserina
MAAAAVVQIPAGATFLKTFKKSFVDVPIDAEKGNAISTAEFLEAAESLTTMFDVLGSIAFTPVKKDMLGNVEKIRKRMLAAPLESQNIQDLVRNELKTKSHTATEGLLWLVRGLEFTCIALSKNIDSTEELADSFRGSYSETLMRHHSFLVKPIFSAAMGACPYRKDFYAKLGDDEQKVQEELREYLAALDKIVYILKGFLESKEAKW

SEQ ID NO: 15297 - protein, 318 aa, Pseudomonas putida
MSLNPDLAAYLQLVEAGRSAGKVLPMHALEADEARRQFEESSALIAGKADEPDCISDLSLTTRDGHTLPVRLYRPPQDDPALAGAALLYLHGGGYVVGSLDSHDTLCWNLAQDAGVPVIAVGYRLAPQWRFPTASDDALDAWRWLVEQAEALGIDAQRLAVVGDSVGGSLATILANQLAAQRELAAPRLQVMIYPVTDASCRRPSVQRYGSGYLLEAQTLEWFYQQYATVPADRLDPRFSPLLGSVASNSAPALMLIAECDPLHDQGVAYARHLEQAGVAVQLAVIPGVTHDFMRMGSIIEEADEGLVMVVEALQQHL

SEQ ID NO: 15298 - protein, 475 aa, Cedrus deodara
MSPKTETKASVGFKAGVKDYRLTYYTPEYQTKDTDILAAFRVTPQPGVPPEEAGAAVAAESSTGTWTTVWTDGLTSLDRYKGRCYDIEPVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTSLAHYCRDNGLLLHIHRAMHAVIDRQRIHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREASKWSPELAAACEVWKEIKFEFEAIDVL

SEQ ID NO: 15299 - protein, 209 aa, Pyrococcus furiosus
MEIEKLLEQVNWEKNNGIVPVIVQDEKGEVLTLAYMNKEALRKTLETGIAHYYSRSKGRIRMKGEVSGNIQTVKEIKIDCDNDALLLIVSPKGPACHTGNYSCFYRKLGEPERVLPIDYSLSILKELEEIIKRRKETPVEGSYTSKLFKEGREKIYKKFGEEAIEVLVAEKRERIIYEVADLLYHLLVLLTYNDISLGEVMNELRRRRK

SEQ ID NO: 15300 - protein, 216 aa, Nostoc sp. PCC 7120
MSFIDSLSPQNVIPVEEIRYDERGLVPAIVQDYLDGTVLMMAWMNRESLQKTLDTGETWFWSRSRQEFWHKGGTSGHTQKVQSIRYDCDSDALLVGVEQIGDIACHTGERSCFHQVEGKIVAPPGDTLSQVFQVICDRRNHPTESSYTSKLFAGGDNKILKKIGEESAEVVMACKDDDQEAIAGEVADLLYHTLVALAHHQVDIKAVYRKLQERRR

SEQ ID NO: 15301 - protein, 211 aa, Bacillus halodurans
MNVDDLTFDDKGLIPAVVQDAQSKEVVTVAYMNRESFEKTVETGETWFYSRSRQELWHKGATSGHTQKVVDIRYDCDGDALVVLVELKGPACHTGKYSCFFESVFGKKIYGASDRFGIIATLEALIAEREAEMPEGAYTTYLFEKGVDKILKKVGEEATEVVIAAKNRDAEELKWEVADLLYHLLVLLREQKLPVDEVLAVLEERHRPKEE

SEQ ID NO: 15302 - protein, 466 aa, Escherichia coli O157:H7
MPHSYDYDAIVIGSGPGGEGAAMGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIEGCDDGVIMHLKSGKKLKADCLLYANGRTGNTDSLALQNIGLETDSRGQLKVNSMYQTAQPHVYAVGDVIGYPSLASAAYDQGRIAAQALVKGEATAHLIEDIPTGIYTIPEISSVGKTEQLLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 15303 - protein, 173 aa, Nostoc sp. PCC 7120
MPRTQKNDNFVDKSFTVMADIILKILPTNKKAKEAFVYYRDGMSAQAEGEYAEALEYYEEALTLEEDTNDRGYILYNMGLIYASNGDHDKALELYHQAIELNPRLPQALNNIAVIYHYQGEKAKETGDHDGGEALFDQAADYWIRAIRMAPNNYIEAQNWLKTTGRMQIDVFF

SEQ ID NO: 15304 - protein, 174 aa, Arabidopsis thaliana
MTTVTTSFVSFSPALMIFQKKSRRSSPNFRNRSTSLPIVSATLSHIEEAATTTNLIRQTNSISESLRNISLADLDPGTAKLAIGILGPALSAFGFLFILRIVMSWYPKLPVDKFPYVLAYAPTEPILVQTRKVIPPLAGVDVTPVVWFGLVSFLSEILVGPQGLLVLVSQQQVN

SEQ ID NO: 15305 - protein, 445 aa, Arabidopsis thaliana
MVGSHKASGVLLVLLVVMATTIANGTPVVDTAKNAATAVEDTAKNAATAVGGAAASVGAKVTGAKPGGASLDVKASGAKGDGKTDDSAAFAAARKEACAAGSTITVPKGEYLVESLEFKGPCKGPVTLELNGNFKAPATVKTTKPHAGWIDFENLADFTLNGNKAIFDGQGSLAWKANDCAKTGKCNSLPINIRFTGLTNSKINSITSTNSKLFHMNILNCKNITLTDIGIDAPPESLNTDGIHIGRSNGVNLIGAKIKTGDDCVSIGDGTENLIVENVECGPGHGISIGSLGRYPNEQPVKGVTVRKCLIKNTDNGVRIKTWPGSPPGIASNILFEDITMDNVSLPVLIDQEYCPYGHCKAGVPSKVKLSDVTIKNIKGTSATKVAVKLMCSKGVPCTNIALSDINLVHNGKEGPAVSACSNIKPILSGKLVPAACTEVAKPGP

SEQ ID NO: 15306 - protein, 162 aa, Physcomitrella patens
MAGGEEFRCFVGGLAWATTDGRLEGAFRPFGEVVQSKVISDRETGRSRGFGFVTFADENSMNAAIKEMNGQELDGRNITVNQAQSRGGGGGGGGGGGGYGRREQGGGGYGGGYGGSRGGGDREGSGYGGSRGGGYGGGGGGGYGGRGGPSSGNWRNDRQPEY

SEQ ID NO: 15307 - protein, 178 aa, Physcomitrella patens
MGEEFRCFVGGLAWATTDGSLEEAFRPFGEVVQCKVITDRETGRSRGFGFVTFADENSMNEAIKDMNGKELDGRNITVNQAQSRGGGSGGGGGGGYNNRQGGGGGYGGGGYGGGGGGGYGAGGGGAYGSRSSYDREGGGGGGYGGSRGGGGYGSGGGGGGGRGGSGSGNWRGGRENAY

SEQ ID NO: 15308 - protein, 155 aa, Physcomitrella patens
MAFLAQLGGLVRQSIARNALQRHSSAAAIPAMFLVSRGMSGSKLFVGGLAWGTTDDNIKEAFSAFGEVTEVKIICDRDTGRSRGFGFVTFATDQDAEAALQALDGRDLAGRTIRVNYATKQSPQDRQSGGGMYGRRDHSGGNSGNFGGSGTWRGM

SEQ ID NO: 15309 - protein, 468 aa, Androsace septentrionalis
  misc_feature (209)..(210): Xaa can be any naturally occurring amino acid
NAGVGFKAGVKDYKLTYYTPDYETKDTDILAAFRVTPQPGVPPEEAGAAVAAESSTGTWTTVWTDGLTNLDRYKGRCYGIEPVAGEENQYICYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRXXFLFCAEAIYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFAQDWVSLPGVLPVASGGIHVWHMPALTEIFGDDSVLQFGGGTLGHPWGNAPGAVANRVALEACVQARNEGRDLAREGNEVIREACKWSPELAAACEVWKEIKFVFEAMDTL

SEQ ID NO: 15310 - protein, 468 aa, Cortusa sp. Trift 23
KAGVGFKAGVKDYKLTYYTPDYDPADTDILAAFRVTPQPGVPPEEAGAAVAAESSTGTWTTVWTDGLTNLDRYKGRCYHIEPVAGEETQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLSFYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15311 - protein, 468 aa, Primula muscarioides
KAGVGFKAGVKDYKLTYYTPDYDPLDTDILAAFRVTPQPGVPPEEAGAAVAAESSTGTWTTVWTDGLTNLDRYKGRCYHIEPVAGEDNQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWENAPGAVANRVALEACVQARNEGRDLAREGNEIIREACKWSPELAAACEVWKEIKFEFEAMDTL

SEQ ID NO: 15312 - protein, 468 aa, Primula capitata
KAGVGFKAGVKDYKLTYYTPDYDPLDTDILAAFRVTPQPGVPPEEAGAAVAAESSTGTWTTVWTDGLTNLDRYKGRCYHIEPVAGEDNQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDGFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15313 - protein, 468 aa, Primula ioessa
  misc_feature (79)..(79): Xaa can be any naturally occurring amino acid
NAGVGFKAGVKDYKLTYYTPDYDPLDTDILAAFRVTPQPGVPPEEAGPAVAAESSTGTWTTVWTDGLTNLDRYKGRCYXIEPVAGEDNQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15314 - protein, 468 aa, Primula stricta
  misc_feature (15)..(15): Xaa can be any naturally occurring amino acid
  misc_feature (50)..(50): Xaa can be any naturally occurring amino acid
  misc_feature (79)..(79): Xaa can be any naturally occurring amino acid
NACVGFKAGVRDHKXTYYTPDYDTLDTDILAAFRVTPQPGVPPEEAGRAXAAESSTGTWTTVWTDGLTNLDRYKGRCYXIEPVAGEDNQFIAYVAYPLDLFEEGSVTNMFTSIVGNVFGFKALRALRLEDLRIPVAYVKTFQGPPHGIQVERDKLNKYGRPLLGCTIKPKLGLSAKNYGRPVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15315 - protein, 468 aa, Primula veris subsp. macrocalyx
NAGVGFKAGVKDYKLTYYTPDYETLDTDILAAFRVTPQPGVPPEEAGAAVAAESSTGTWTTVWTDGLTNLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15316 - protein, 468 aa, Primula cortusoides
  misc_feature (48)..(48): Xaa can be any naturally occurring amino acid
KAGVGFKAGVKDYKLTYYTPDYDPADTDILAAFRVTPQPGVPPEEAGXAVAAESSTGTWTTVWTDGLTNLDRYKGRCYHIEPVAGEETQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLSFYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15317 - protein, 465 aa, Primula modesta
VGFKAGVKDYKLTYYTPDYDPLDTDILAAFRVTPQPGVPPEEAGAAVAAESSTGTWTTVWTDGLTNLDRYKGRCYHIEPVAGEDNQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15318 - protein, 468 aa, Primula japonica
  misc_feature (171)..(172): Xaa can be any naturally occurring amino acid
KAGVGFKAGVKDYKLTYYTPDYETLDTDILAAFRVTPQPGVPPEEAGPPVAAESSTGTWTTVWTDGLTNLDRYKGRCYHIEPVAGEENQFIAYVAYPLDLFEEGSVTNMFTSIVGNVFGFKALRALRLEDLRIPVAYVKTFQGPPHGIQVERDKLNKYGRPLLGCTIKPKXXLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15319 - protein, 468 aa, Primula veris
KAGVGFKAGVKDYKLTYYTPDYETLDTDILAAFRVTPQPGVPPEEAGAAVAAESSTGTWTTVWTDGLTNLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15320 - protein, 468 aa, Primula veris
IAGVGFKAGVKDYKLTYYTPDYETLDTDILAAFRVTPQPGVPPEEAGAAVAAESSTGTWTTVWTDGLTNLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15321 - protein, 468 aa, Primula cortusoides
IAGVGFKAGVKDYKLTYYTPDYDPADTDILAAFRVTPQPGVPPEEAGAAVAAESSTGTWTTVWTDGLTNLDRYKGRCYHIEPVAGEETQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLSFYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15322 - protein, 468 aa, Primula malacoides
IAGVGFKAGVKDYKLTYYTPDYDPADTDILAAFRVTPQPGVPPEEAGAAVAAESSTGTWTTVWTDGLTNLDRYKGRCYHIEPVAGEESQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLSFYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWENAPGAVANRVALEACVQARNEGRDLAREGNAIIREACKWSPELAAACEVWKEIKFEFEAMDTL

SEQ ID NO: 15323 - protein, 468 aa, Dionysia tapetodes
KAGVGFKAGVKDYKLTYYTPDYETLDTDILAAFRVTPQPGVPPEEAGAAVAAESSTGTWTTVWTDGLTNLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15324 - protein, 468 aa, Dionysia microphylla
KTGVGFKAGVKDYKLTYYTPDYETLDTDILAAFRVTPQPGVPPEEAGAAVAAESSTGTWTTVWTDGLTNLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15325 - protein, 468 aa, Primula dryadifolia
NAGVGFKAGVKDYKLTYYTPDYDPADTDILAAFRVTPQPGVPPEEAGAAVAAESSTGTWTTVWTDGLTNLDRYKGRCYHIEPVAGEENQYIAYVAYPLDLFEEGSVTNMFTSIVGNVFGFKALRALRLEDLRIPAAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAFYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFVFEAMDTL

SEQ ID NO: 15326 - protein, 468 aa, Primula cusickiana subsp. maguirei
KAGVGFKAGVKDYKLTYYTPEYDPADTDILAAFRVTPQPGVPPEEAGAAVAAESSTGTWTTVWTDGLTNLDRYKGRCYNIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEITFEFAAMDTL

SEQ ID NO: 15327 - protein, 468 aa, Soldanella pusilla
KAGVGFKAGVKDYKLTYYTPEYDPLDTDILAAFRVTPQPGVPPEEAGAAVAAESSTGTWTTVWTDGLTNLDRYKGRCYHIEPVAGEENQYIAYVAYPLDLFEEGSVTNLFTSIVGNVFGFKALRALRLEDLRISTAYAKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMLKRAVFARELGVPIIMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15328 - protein, 463 aa, Omphalogramma elwesiana
FKAGVKDYKLTYYTPDYDPADTDILAAFRVTPQPGVRPEEAGAAVAAESSTGTWTTVWTDGLTNLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15329 - protein, 466 aa, Hottonia palustris
GVGFKAGVKDYKLTYYTPDYDPLDTDILAAFRVTPQPGVPPEEAGAAVAAESSTGTWTTVWTDGLTNLDRYKGRCYHIEPVPGEETQFIAYVAYPLDLFEEGSVTNLFTSIVGNVFGFKALRALRLEDLRISPAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFVFEAMDTL

SEQ ID NO: 15330 - protein, 468 aa, Primula miyabeana
KAGAGFKARVKDYKLTYYTPDYETLDTDILAAFRVTPQPGVPPEEAGAAVAAESSTGTWTTVWTDGLTNLDRYKGRCYHIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTWEEMLKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 15331 - protein, 1207 aa, Lycopersicon peruvianum
MKAHKTVFNQHPLSLNKLFFVLLLIFFLPPASPAASVNGLYKDSQQLLSFKAALPPTPTLLQNWLSSTDPCSFTGVSCKNSRVSSIDLSNTFLSVDFSLVTSYLLPLSNLESLVLKNANLSGSLTSAAKSQCGVTLDSIDLAENTISGPISDISSFGVCSNLKSLNLSKNFLDPPGKEMLKGATFSLQVLDLSYNNISGFNLFPWVSSMGFVELEFFSIKGNKLAGSIPELDFKNLSYLDLSANNFSTVFPSFKDCSNLQHLDLSSNKFYGDIGSSLSSCGKLSFLNLTNNQFVGLVPKLPSESLQYLYLRGNDFQGVYPNQLADLCKTVVELDLSYNNFSGMVPESLGECSSLELVDISNNNFSGKLPVDTLLKLSNIKTMVLSFNKFVGGLPDSFSNLPKLETLDMSSNNLTGIIPSGICKDPMNNLKVLYLQNNLFKGPIPDSLSNCSQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGAMYYLSILNLGHNDLSGMIPQQLGGLKNVAILDLSYNRFNGTIPNSLTSLTLLGEIDLSNNNLSGMIPESAPFDTFPDYRFANNSLCGYPLPLPCSSGPKSDANQHQKSHRRQASLAGSVAMGLLFSLFCIFGLIIVAIETKKRRRKKEAALEAYMDGHSHSATANSAWKFTSAREALSINLAAFEKPLRKLTFADLLEATNGFHNDSLVGSGGFGDVYKAQLKDGSVVAIKKLIHVSGQGDREFTAEMETIGKIKHRNLVPLLGYCKVGEERLLVYEYMKYGSLEDVLHDRKKTGIKLNWPARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKQPTDSADFGDNNLVGWVKLHAKGKITDVFDRELLKEDASIEIELLQHLKVACACLDDRHWKRPTMIQVMAMFKEIQAGSGMDSTSTIGADDVNFSGVEGGIEMGINGSIKEGNELSKHL

SEQ ID NO: 15332 - protein, 487 aa, Aspergillus oryzae
MQKSWLVLLVACLGLQGTTALTLHRRDLPAVVSLDIKRNNAVDPVARDRMRRKRDKTVEQNLDNEETLYFCNITLGTPKQSLRLVLDTGSSDLWCNAANSTLCSSRDQPCNASGSYDPSSSSSYAYTSSDFNISYADGTGAAGDYVTDTIHIGGATVKDFQFGVGYSSSSAEGVLGIGYTTNEVQVGRLGKSAYANLPQAMVKNGLIQSNAYSLWLNDLGADTGSILFGGVNTEKYHGELQTLPIQTVNGVYSEFIIALTGVSLSSASSHHNYSSSDALPAAVLLDSGSSLTYLPNSIVQDIYDDLGVTYESSSGVGYVPCSLAQQNINVTYTFSSPIITVGIDELVLDAGDLRFRNGARACIFGIVPAGDSTAVLGDTFLRSAYVVYDLSNNEISLANTKFNSTKDNILEIGTGDDSVPGATQVSNPVTSVVADGSGARIGGPTGEIFTDIPSATSSGGAAAPAGPTDVPKHLVLGAAAIGYVLAF

SEQ ID NO: 15333 - protein, 486 aa, Aspergillus oryzae
MMRGASLLPVALAALSCVDALSLHRRDTPATVELPIERRQHAGGLQKRDSTLNLPLINYYDSFYILNLTLGTPAQQFAVALDTGSSDLWVNVANSSYCSSRTNPCKPFGLYDPDASSTYKNLGVEFNATYGDGTNAYGYYATDELGLGDVNVDDMQFGVAESTTITQGIVGVAYDTLTNEASHEGKTYVNLPQALVNSGAIKSPAYSLWLNDPQASRGSILFGGVNKAKYKGELQTIPIVRTLRGYSYLAVTLTGVSVEQGKESEDYSSRLPIVVLLDSGTSLTYLPDSLVDELYKTFNATFLEDDGLAYVDCELMKKDYTVNFDFSGATIAVGISELVLKAVAEDFPLGTCAFGVVPSGDSQDAMYILGDTFLRSAYVVYDLGNNEISLANTNFSPGDDDILEIGTGTSAVPGATPVESPVTSATVASATDIVHTVMVGGTKATATDSNSGAAETSSSSGIAALPTSNTRHLLSGLAGAGLLLAL

SEQ ID NO: 15334 - protein, 397 aa, Aspergillus oryzae
MKSTLVTASVLLGCASAEVHKLKLNKVPVSEQFNLHNIDTHVQALGQKYMGIRPNIKQDLLNENPINDMGRHDVLVDNFLNAQYFSEIEIGTPPQKFKVVLDTGSSNLWVPSSECGSIACYLHNKYDSSSSSTYQKNGSEFAIKYGSGSLSGFVSQDTLKIGDLKVKDQLFAEATSEPGLAFAFGRFDGILGLGFDTISVNKIPPPFYSMLDQGLLDEPVFAFYLGDTNKEGDDSVATFGGVDKDHYTGELVKIPLRRKAYWEVDLDAIALGDSVAELDNTGVILDTGTSLIALPTTLAELINKEIGAKKGFTGQYSVDCDKRDSLPDLTFTLSGYNFTIGPYDYTLEVQGSCISAFMGMDFPEPVGPLAILGDAFLRKWYSVYDLGNGAVGLAKAK

SEQ ID NO: 15335 - protein, 298 aa, Aegilops speltoides subsp. ligustica
FSLAPLVPRLSELLGIAVKKAEDVIGPEVEKLVADLENGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADV

SEQ ID NO: 15336 - protein, 298 aa, Aegilops speltoides subsp. speltoides
FSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVAASAIPDGWMGLDIGPDSVKTFNDALDTTQTIIWNGPMGVFEFDKFAVGTESIAKKLAELSKKGVTTIIGGGDSVAAVEKVGVADV

SEQ ID NO: 15337 - protein, 298 aa, Aegilops speltoides subsp. speltoides
FSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADV

SEQ ID NO: 15338 - protein, 298 aa, Secale cereale
FSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVVIADKFAPDANSQTVAASAIPDGWMGLDIGPDSVKTFNDALDTTQTIIWNGPMGVFEFDKFAVGTEAIAKKLAELSKNGVTTIIGGGDSVAAVEKVGVADV

SEQ ID NO: 15339 - protein, 298 aa, Hordeum vulgare subsp. vulgare
FSLAPLVPRLSELLGIEVKKADDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVVIADKFAPDANSQTVAASAIPDGWMGLDIGPDSVKTFNDALDTTQTIIWNGPMGVFEFDKFAVGTEAVAKKLAELSKKGVTTIIGGGDSVAAVEKVGVADV

SEQ ID NO: 15340 - protein, 298 aa, Zea mays
FSLAPLVPRLSEFLGIQVIKADDVVGPEVEKLVSALPNGNVVLLENVRFYKEEEKNDPEFAKKLASLADLYVNDAFGTAHRAHASTEGVTKFLKPSVAGFLLQKELDYLVGAVSNPKRPFAAIIGGSKVSSKIGVIESLLEKCDILLLGGGMIFTFYKAQGHSIGSSLVEDDKLELATSLLRKAKEKGVSLMLPFDLVVADKFAPDASSQVVPASAIPDAWMGLDIGPDSISAFSSALETTQTVIWNGPIGVFEFDKFAVGTKAIAKKLAELSGKGVTTIVGGGDSIAAVEKVGVADS

SEQ ID NO: 15341 - protein, 342 aa, Serratia marcescens
MTHLKITGMTCDSCAAHVKEALEKVPGVQSAIVSYAKGAAQLALDPGTAPDALTAAVAGLGYKAMLADAPPTDNRTGLFDKVRGWMGAADKGSGAERPLQVAVIGSGGAAMAAALKAVEQGAQVTLIERGTIGGTCVNVGCVPSKIMIRAAHIAHLRRESPFDGGMPPTPPTILRERLLAQQQARVEELRHAKYEGILDGNSAITVRHGEARFKDDRDLSVSLNEGGERVVMFDRCLVATGASPAMPPIPGLKESPYWTSTEALVSDTIPERLAVIGSSVVALELAQAFARLGSQVTILARNTLFFRDDPSIGEAVTAAFRAEGIKVLEHTQASQVAHVNGE

SEQ ID NO: 15342 - protein, 215 aa, Synechocystis sp. PCC 6803
MSHSDLPLANAVPLDKIRYNDQGLVPAIAQDYLDGTVLMLAWMNEAALAKTLATGQVWYWSRSRQELWHKGATSGHFQKLLGIRYDCDSDALLLTIEQKGDIACHTGERSCFHQLDGHKSPPPADMLTELARVIGDRRDHPTPESYTCKLLAGGDNKILKKIGEESAEVVMACKDDDPEAIAGEVADLFYHTLVALAHHNVDLRAVYRKLGDRRR

SEQ ID NO: 15343 - protein, 348 aa, Pichia stipitis
MSVPTTQKAVVFESNGGPLLYKDIPVPTPKPNEILINVKYSGVCHTDLHAWKGDWPLDTKLPLVGGHEGAGVVVGIGSNVTGWELGDYAGIKWLNGSCLNCEFCQHSDEPNCAKADLSGYTHDGSFQQYATADAVQAARLPKGTDLAQAAPILCAGITVYKALKTAQIQPGNWVCISGAGGGLGSLAIQYAKAMGFRVIAIDGGEEKGEFVKSLGAEAYVDFTVSKDIVKDIQTATDGGPHAAINVSVSEKAIAQSCQYVRSTGTVVLVGLPAGAKVVAPVFDAVVKSISIRGSYVGNRADSAEAIDFFTRGLIKCPIKVVGLSELPKVYELMEAGKVIGRYVVDTSK

SEQ ID NO: 15344 - protein, 158 aa, Arabidopsis thaliana
MAEKLAPEKRHDFIHNGQKVFEWDQTLEEVNMYITLPPNVHPKSFHCKIQSKHIEVGIKGNPPYLNHDLSAPVKTDCSFWTLEDDIMHITLQKREKGQTWASPILGQGQLDPYATDLEQKRLMLQRFQEENPGFDFSQAQFSGNCPDPRSFMGGIRSD

SEQ ID NO: 15345 - protein, 450 aa, Arabidopsis thaliana
MFSLILHGRKSVELQKWRNLRVTVSIVQNAFPFTTKSFSSTIAKDSSPKGSTFTVSYLVESLGLTKKLAETISKKVTFEDKVNPDSVLNLLRSNGFKDSQISRIIRAYPRLLVTDAEKSLRPKLQFLKSRGASSSEVIEIVSNVPTILDKKGEESVSLYYDFVKDIMQDGKSLCISCPEGKKGNRIRNISVLRELGVPQKLLFSLLISRYQPVCGKEKFEESLKKVVDMGFDPAKSKFVEALHVVYEMSEKTIEEKVNVYKRLGFSEAEIWAIFKKWPYFLKFSEKKIILMFETLKKCGLVEEEIISVLKSRPQCIRSSEQKILDSIEMFLGLGFSRDDFKMMVKRYPCCTAYSGETLRKKFEVLVKMMNWPLEAVVMIPTVLGYSLEKRIVPRSNVIKALMSKGLIGSENPPISSVLVCTDQEFLKRYVMKHDKLVPKLMAIFNRGRVS

SEQ ID NO: 15346 - protein, 460 aa, Bifidobacterium breve
MTMIFPKGFMFGTATAAYQIEGAVAEGGRTPSIWDTFSHTGHTLNGDTGDVADDFYHRWEDDLKLLRDLGVNAYRFSIGIPRVIPTPDGKPNQEGLDFYSRIVDRLLEYGIAPIVTLYHWDLPQYMASGDGREGGWLERETAYRIADYAGIVAKCLGDRVHTYTTLNEPWCSAHLSYGGTEHAPGLGAGPLAFRAAHHLNLAHGLMCEAVRAEAGAKPGLSVTLNLQICRGDADAVHRVDLIGNRVFLDPMLRGRYPDELFSITKGICDWGFVCDGDLDLIHQPIDVLGLNYYSTNLVKMSDRPQFPQSTEASTAPGASDVDWLPTAGPHTEMGWNIDPDALYETLVRLNDNYPGMPLVVTENGMACPDKVEVGTDGVKMVHDNDRIDYLRRHLEAVYRAIEEGTDVRGYFAWSLMDNFEWAFGYSKRFGLTYVDYESQERVKKDSFDWYRRFIADHSAR

SEQ ID NO: 15347 - protein, 396 aa, Populus sieboldii x Populus grandidentata
MDLLLLEKTLLGSFVAILVAILVSKLRGKRFKLPPGPLPVPVFGNWLQVGDDLNHRNLTDLAKKFGDIFLLRMGQRNLVVVSSPDLSKEVLHTQGVEFGSRTRNVVFDIFTGKGQDMVFTVYGEHWRKMRRIMTVPFFTNKVVQQYRYGWEEEAAQVVEDVKKNPEAATNGIVLRRRFQLMMYNNMYRIMLDRRFESEDDPLFNKLKALNGERSRLAQSFDYNYGDFIPILRPFLRGYLKICQEVKERRLQLFKDYFVDERKKLASTKTMSNEGLKCAIDHILDAQKKGEINEDNVLYIVENINVAAIETTLWSIEWGIAELVNHPEIQKKLRHELDTLLGPGHQITEPDTYKLPYLNAVVKETLRLRMAIPLLVPHMNLHDAKLGGFDIPAESKI

SEQ ID NO: 15348 - protein, 454 aa, Populus sieboldii x Populus grandidentata
DLNHRNLTDLAKKFGDILLLRMGQRNLVVVSSPDLAKEVLHTQGVEFGSRTRNVVFDIFTGKGQDMVFTVYGEHWRKMRRIMTVPFFTNKVVQQYRHGWEEEAAQVVEDVKKNPEAATHGIVLRRRLQLMMYNNMYRIMFDRRFESEEDPLFNKLKALNGERSRLAQSFDYNYGDFIPILRPFLRGYLKICKEVKERRLQLFKDYFVEERKKLGSTKSMSNEGLKCAIDHILDAQKKGEINEDNVLYIVENINVAAIETTLWSIEWGIAELVNHPEIQKKLRDELDTVLGPGHQITEPDTYKLPYLNAVIKETLRLRMAIPLLVPHMNLHDAKLGGFDIPAESKILVNAWWLANNPAKWKNPEEFRPERFFEEEAKVEANGNDFRYLPFGVGRRSCPGIILALPILGITLGRLVQNFELLPPPGQSKIDTSEKGGQFSLHILKHSTIVAKPRSF

SEQ ID NO: 15349 - protein, 4684 aa, Actinosynnema pretiosum subsp. auranticum
MLRSDLIRPLPELLREHAAERGDRVAFRDARRAVTWVDLELRTRRLAGHLAARRLLPGDRAVILLGNRVETVECYLALVRAGAVGVPLNPVSTDAELGALLDDSGARLVLTDAAHADQLAGLRATRPALEVVHVDRDYEALAGVDAPLPAHDALELDDLAWMLYTSGTTGAPKGVLSTQRNCLWSVAACYAPVLGLTPDDRVLWPLPLFHSLSHIAGVLATTAVGATTRVVDGRSPQDVLAALHEERSTVLAGVPTTYHHLVRAAGERGFLAPDLRVGLVGGAITTAELRAAVEQRFGVPLIDAYGSTETCGSITVNWPTGPRVEGSSGLPVPGLAVRLVDPDTGLDAPTGAEGEVWVRGPSVMVGYHNRPEATAAALRDGWYRTGDLATRDESGFHAVTGRIDDVVVRGGEKVHPAEVEAVLRAVPGVADAAVVGRPHDVLGEVPVAFLVPGEGFDPAQVLAVCRERLSYHKVPEELYQIESVPRTASGKITRRVLLDTPARLRASGERGALFRTDWVPLAAAPGGATAPGAVAGSGAATASSAVTGAGAATGPARATTPAAATAPATTPAEASTPVAAARPGGHPVAVMAEPTAPAPGGAPVVLDLRGDDAPALSGRPDLVLTRGAVAVDGGPVRLGQLAAWTAACRAGITAVDADDDGAVDPVGLLAAGEPRLLVRSGVVLVPRLHEVPGSVVGRGALDPRRAVAVTGADSGTAAALARHLRGAHGVRDLLLITAPHGRARAGALRDDLVASGARVVLAVAGPDALDRALSRAPSPLGALVHTGDGDPEALPRLLGARVELVVCATAFDSAAAEDVVLRRRAAGMPARCLAWGPWEAETAQARPGLAVLPLRDGLAAFDAALGADEPVVSVLRPDPDLVAGDVPAPLRDLLHVVAAEPEPVRVAELRASLAGRGERERRRRLLDLVRAETAALRPAEFLVDGHERGFAELGFTSATSVALRNRLTAATGLALPATAAFEHPTPTALAALLHDELFGASRTPVAPARAVERPVERSGEPIAVVAAGCRLPGGVASPEDLWEVVRSGADVVSPFPVDRGWDLDALRGACAGGGFLADAALFDAALFGVHPREALAMDPQQRLLLEVAWEVFERAGIDPRSVAGDGTGVFAGLMGHDYGSRPGLDRQLVEGYLSTGNAGSVASGRIAYAFGLTGPALTVDTACSSSLVAVHLAVQSLRRGECSMALAGGATVMATPADFVEFARQGALAPDGRCKPFSASADGTAWSEGAGLVLLERLSDARRNGRRVLAVIRGSAVNSDGASNGLTAPSGAAQQRVIRAALADAGLSTSDVDAVEAHGTGTRLGDPIEARALVATYGRDRDGEPLWLGSLKSNFGHPQGAAGIAGLIKLVQALRHGVLPRTLHVDAPTPEVDWDGVEVLAEQRAWPEVDRPRRAAVSSFGVSGTNAHVVLEQAPAETAAPAAPERGPVPLPVSAVDAAALRAQARRLADFLAPSDVTAAELAGALRAGRADLGERAVVVAADRAGALAALEALAADEPSPALVTGRADVTGRTVLVFPGQGGQWVGMGARLLDESPVFAERVGECAAAVDPLVDFRVVDVLRGGDLSRVDVVQPVAFVVMVALARLWRSVGVEPDAVVGHSQGEIAAACVAGALSLADAARVVVLRSRAIAAGLNGGGMASIPLPQAQVEELVAGTGVCVAAVNGPGSVVVSGEVDALVARVEGARRLPVDYASHSPAVDVLREGLLADLAPITPRPAAIPMLSTVTGKWLDGAELDADYWFANLRHPVRFADATALLVADGFRAFVEVGAHPVLTAPVQDLLAGAGPSVATGTLRRDDGGLDRFLRSAAELHVRGVPVDLSPLAPPPVRALDLPTYPFQRARYWLDADPTAASALRHPLLTSATDLAGGEDLVCQARLSTARHPWLADHAVRGSAVLPGTCWAELAIRAGDEVGAPALDELLVEAPLVLPERGAVEVQLRIGAPDAAGRRPLEAHARAEGGAWTRHASGSLAADRSTPVPLTEWPPTGAREVDLAGFYDSRAAEGYDYGPALRGLRRAWTRDGEVFAEVELPAPLSPDGWGLHPALFDAALHATGLLPPARVAADEVLLPFSWRGTRLRATGATALRVRLTGTADDHVLRAYDPEGAPVVEVDALRLRPAPATALVGSGALFRVEWVDLDLPVSTPDSTPGAPVLDRPVLDLPGGDARTLVGLTLEALREHDELTVVTRGAAEDPAAAAVWGLLRTAQTERPGRFAVVDLDDDPASRALLPALPATGEPQVRVRAGRASAPRLARTRDDGLPLPAAPTWRLTCDGGTFTDLAATPSPAANRPLEPGEVRVGVRAAGVNFRDAAVVLNAVPGQRGLGGEAAGVVLETGPGVTGLAVGDRGLGTFDRDFGAFGPVAVTDARLLAPVPPGWGFARAASVPVAFLTALYGLRDLAQVGPGDRVLVHAGAGGVGGAAVRLAALLGAEVFATASPAKWPVLRALGLDDAHLASSRDTGFAERFPNVDVVLNSLTGELVDASLRLLAPGGRFLELGKVDVRDLVRADVTYRAYDLRDAGPDRTAELLAEVLGLFAAGRLEPLPLTVRDVRHAPEALRHVASGGHVGKVVLTVPRPLDPEGTVLVHGGGALGALTARHLVSAHGARHLLITSRRGPDAPGAAELAADLAELGATTRFERCDAADRDRVAALLADLGGRPLTAVVHTAGALDDALLADQDAARVDAVLRPKLDGALLLDELTRDADLAAFVLFSSAAGTLGNAGQANYAAANAALDALAARRRSAGLPATSIAWGHWEHTSALTAGLTAADLARGARHGAGSLTTTEALALLDAALASPEPAVLAAALDPRRAAEVPPLLRDLAGPRRAVAAQAVAGADRPLIDVVRAHTATVLGHRDASAVDANRAFKELGVDSLTAVELRNRLAAATGLALAATSVFDHPTPALLTAHLLAELGHAPAAGTTAPPATAAVTADAGEPIAIVSMACRFPGDVSSPEDLWDLVAGGGDALTPFPADRGWDLAALFAPDPDRAGRSHAREGGFLADVAGFDADLFGISPREAIGTDPQQRLLLEVAWELFERAGIAPDSLRGTDTGVFAGVIAHGYPVLPAHSDQGLEGHRVTGVSGSVVSGRVAYAFGLQGPAMTVDTACSSSLVGVHLAVRALRGGECSLALAGGVTVLSTPDLFVDFSRQRGLAADGRCKAFGAGADGTGFGEGVGLVLLERLWDARRNGRRVLGLVRGSAVNSDGASNGLTAPSGPAQERVIGRALADAGLSAADVDLVEAHGTGTRLGDPIEARALVATYGRDRGGEPVWLGSVKSNIGHTQAAAGVAGLIKAVQALRHGVLPATLHAAEPTPEVEWDGVAVLAEQRDWPEVGRPRRAAVSSFGVSGTNAHVVLEQAPEELSPEGRIPEVRIPDRRTSEGRVPEGRAPEGRTSGGRAPEGQTSEGRAFGGRVPEDQTSEDRTSEGQASMGRAPEGQAPLGQVSESRAPDHRVPAGPDRDVPGHLPLVLSAHDPAALRATAARLLPVAERVPLPDLALSLVTGRAALPCRAVIPARDRGQALAALRDLASGATAPAERDGGGVAFLLSGQGSQRAGTGRLLERRFPVFRDALREVCALLDRRVVGGPGVRAALDDPGLLADTRYAQAGLFAVQVALVRLLDALGVRPDLLAGHSVGEIAVAHAAGVLSLEDASTLVAARGALMRELPPGVMVAVRAGEDEARAALVDGVELAAVNGPRATVLTGDEAAVTEVAARLGRATRLRVAHAFHSAAVDAVLPAFADVLARLDFRPPRVPVATTAPGALDAPEYWLGQAREPVRFADAVTDLHRRGATAFVEVGPGGGLAAAAQECLDGHDVLCAPLLHRDRDEDHSLITALGALHARGARVDFAPLLADAGGRTTDLPTYPFQRRRFWLDPAPPTTDAAPLEHPLLTGELEIPGSDTAAFTGRAATGAHPWLADHRLLDAVVVPGTALLDLVRAAGRQLGLPEVAELVNEVPLVLGDGAALLRVTAAAPGPDGRREVAVHSRPESAGPRSPWTRHVTGQLAPESGPLAFDLAQWPPPGALPLPVADHRAAMAATGHGYGPAFLGLRAAWKLDDEVLVEAVLPDEVADDGHAVHPALLDAVLQAIALTGVEDGSQVRVPFSWRSARGAGRAGRAVRASLRPDGDGGVRVRVACPRGRPLLEIASLVSRPVTPDRLRPGVLLRQAWTEVGPPPGAAEPVPLREVGERVPPVVRVDAGHVRDLLPLLQEVVTEPRWESTRLLVTTSGAVGPRAGRAEGAAVWGLVRSAAAEHPGRFVLADLDDRPESAALLPALATGALPEAVLRAGRVLVPGLHRVSAPGAGGAVLDPGGAALITGGSGALAALLAEHLVRAHGVRCLVLLSRSGRGPDVPGADVRHVRGDVANRADVVAALAAVPPDRPLTLVAHLAGVLDDGALTALTPERLDAVLRPKAEGARHLDELTRDRDLAAFVLFSSVAGALGHAGQANYAAANAHLDGLAHERHALGLPATALAWGPWTEGMARGRGTLSPQVALGLFDAALRTGLPALVPLDREPERRVPAPRAATPAPAGPSLADRLRPMPPAERRAHLLELVTAEALGVLGHDDGAALPAGQAFRDAGFDSITAMALRNRLVRLAGVRLPASVVFDHPTPAATAERLEAELFPADRLPGPRHGDDFDDMAADELVRRALGGE

SEQ ID NO: 15350 - protein, 357 aa, Actinosynnema pretiosum subsp. auranticum
MVADRAGEWDLAGELPVAALRELGAAGALCGEVAERHGGLGLGSLDNGELTARTGALCGSVRSVQTSQGMAAWTVRRLGDQAQRAAVLPRLTGGSLAAVALSEPGAGSDLSAMATTVEDDPGEPGTVLVRGHKVWTTAARYADLLLVAGRRGDGAAVALVPATAPGVTITPVANPMGCRAAGHADVELDDVRLPATSVLGGDGVSTALLVTTVLAHGRLSVAWGCVGILRACLAASAEHARTRRQFGVPLAAHQLVAGHLADLLVAEQVSTRVCEHASRRWDESSAELVTATVLAKHVSAGHAARAAATAVQVLASAGAHDGHPVARAYRDAKLMEIIEGSNELCRLVLAEHAVATA

SEQ ID NO: 15351 - protein, 1005 aa, Actinosynnema pretiosum subsp. auranticum
MVATGTRIPGPKPLPLVGNLLDVLTSDLDTDVDFLDRCHREHGGIVALTFAGQRQVFASSHELVARMCSDPSWGKAVHPALEQVRDFAGDGLFTARGDEPNWGKAHRLLMPAFGPTAMRDHFPAMLDIAEQMLVRWRRFGPDHRIDVADDMTRLTLDTIALCAFGARFNSFYRDRAHPFVDAMVRSLVEAGERAERLPGVQPFLVGRNQRYRDDIATMNRIADGIVAARAALPAGERPDDLLERMLTCADPVTGERLSARNVRYQLATFLIAGHETTSGLLSFAVHRLLAHPEVLRKAKDAVDGVLGDRVPAFEDLARLDYLGQVLRETLRLHPTAPAFALAPDEPAELGGHAIGAGEPVLVMLPTLHRDPAVWRDPDVFDPERFAPERMDEIPACAWMPFGHGARACIGRPFALQEATLVLALVLQRFDLALADPDHRLTIKQTLTLKPDSLVVRARPRADRPGATATVETVVPHQVPATHRHGTPLHVFYGSNGGSGEGLARTIAGDGAARGWATSVAPLDDAVRALPASGPVVIVSSSYNGAPPDNAAHFVRWLTQDGPDLSGVDYLVLGCGNLDWSATYQRVPTLIDEAMAAAGARRLRERGATDARADFFGDWERWYEPLWPLLSAECGVEVGEIGPRFRVVESDAADGLGDLASAVVLENRELVRGPDAGSKRHLELRLPDGTSYRTGDYLSVLPQNHPDLVRRAVARLGTRAERVVTVESSAPTGLVPVGRALRVDELLTRCVDLSAPAGAGVVARLAERCPCPPERAELAATTGATLLELLERFPSCAVDLALALELLPAPRTRLYSISSAAEEQRAEVALTVSVTGVTSGYLSRVRPGDRVAVGIASPPESFRPPADNTVPVVLIAAGTGIAPFRGFLRARAALGGEPGPALLLFGCRGPELDDLYAEEFAALGDWLEVDRAYSRHPDGEVRHVQHRLWQRRDRVRELVDAGARVYLCGDATRVGPAVEEVLGRIGPGAGWLDALRAGGRYATDVF

SEQ ID NO: 15352 - protein, 227 aa, Listeria monocytogenes
VKTLHPAIHGGLLARRDTAEHMEAIAAHNIKPIDLVIVNLYPFQETIQKPGVTLEEAIENIDIGGPSMLRSAAKNYAAVTVVVDTADYDAVLTELQEHGATTFETRQRLAAKVFRHTAAYDALIAEYLTNITGETFPEKVTFTYNRKQVLRYGENPHQDAAFYTEPGTIENSISAAKQLHGKELSYNNIRDADAALKIASEFTEPVAVAVKHMNPCGVGVGENIEEA

SEQ ID NO: 15353 - protein, 276 aa, Mycobacterium leprae
MFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCGVALNAFNPGQAFEIVLSVAALGIIAGWGTIVLCQLRLHKMAKAGIMRRPRFRMPLAPYSGYLTLAFLFAVLVVMAFDKPIGTWTVASLIVIVPALIAGWYSIRKRVMTIARERMGYTGPFPAIANPPVQPSERSHSQNP

SEQ ID NO: 15354 - protein, 244 aa, Mycobacterium leprae
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAPANSCQLRSDVRLRCRRTGRHRSR

SEQ ID NO: 15355 - protein, 352 aa, Arabidopsis thaliana
MATWNASSPAASPCSSRRRTKAPARRPSSESPPPRKMKSMAEIMAKSVPVVEQEEEEDEDSYSNVTCEKCGSGEGDDELLLCDKCDRGFHMKCLRPIVVRVPIGTWLCVDCSDQRPVRKETRKRRRSCSLTVKKRRRKLLPLVPSEDPDQRLAQMGTLASALTALGIKYSDGLNYVPGMAPRSANQSKLEKGGMQVLCKEDLETLEQCQSMYRRGECPPLVVVFDPLEGYTVEADGPIKDLTFIAEYTGDVDYLKNREKDDCDSIMTLLLSEDPSKTLVICPDKFGNISRFINGINNHNPVAKKKQNCKCVRYSINGECRVLLVATRDISKGERLYYDYNGYEHEYPTHHFL

SEQ ID NO: 15356 - protein, 398 aa, Pseudomonas putida
  misc_feature (211)..(211): Xaa can be any naturally occurring amino acid
MHGSNKLPGFATRAIHHGYDPQDHGGALVPPVYQTATFTFPTVEYGAACFAGEQAGHFYSRISNPTLNLLEARMASLEGGEAGLALASGMGAITSTLWTLLRPGDEVLLGNTLYGCTFAFLHHGIGEFGVKLRHVDMADLQALEAAMTPATRVIYFESPANPNMHMADIAGVAKIARKHGATVVVDNTYCTPYLQRPLELGADLVVHSATXYLSGHGDITAGIVVGSQALVDRIRLQGLKDMTGAVLSPHDAALLMRGIKTLNLRMDRHCANAQVLAEFLARQPQVELIHYPGLASFPQYTLARQQMSQPGGMIAFELKGGIGAGRRFMNALQLFSRAVSLGDAESLAQHPASMTHSSYTPEERAHYGISEGLVRLSVGLEDIDDLLADVQQALKASA

SEQ ID NO: 15357 - protein, 333 aa, Lactobacillus delbrueckii subsp. bulgaricus
MTKIFAYAIREDEKPFLKEWEDAHKDVEVEYTDKLLTPETVALAKGADGVVVYQQLDYIAETLQALADNGITKMSLRNVGVDNIDMAKAKELGFQITNVPVYSPNAIAEHAAIQAARILRQDKAMDEKVARHDLRWAPTIGREVRDQVVGVVGTGHIGQVFMQIMEGFGAKVITYDIFRNPELEKKGYYVDSLDDLYKQADVISLHVPDVPANVHMINDESIAKMKQDVVIVNVSRGPLVDTDAVIRGLDSGKIFGYAMDVYEGEVGIFNEDWEGKEFPDARLADLIARPNVLVTPHTAFYTTHAVRNMVVKAFDNNLELVEGKEAETPVKVG

SEQ ID NO: 15358 - protein, 333 aa, Lactobacillus delbrueckii
MTKIFAYAIREDEKPFLKEWEDAHKDVEVEYTDKLLTPETVALAKGADGVVVYQQLDYIAETLQALADNGITKMSLRNVGVDNIDMAKAKELGFQITNVPVYSPNAIAEHAAIQAARILRQDKAMDEKVARHDLRWAPTIGREVRDQVVGVVGTGHIGQVFMQIMEGFGAKVITYDIFRNPELEKKGYYVDSLDDLYKQADVISLHVPDVPANVHMINDESIAKMKQDVVIVNVSRGPLVDTDAVIRGLDSGKIFGYAMDVYEGEVGIFNEDWEGKEFPDARLADLIARPNVLVTPKTAFYTTHAVRNMVVKAFDNNLELVEGKEAETPVKVG

SEQ ID NO: 15359 - protein, 335 aa, Chondrostereum purpureum
ATCTVKSVDDAKDIAGCSAVTLNGFTVPAGNTLVLNPDKGATVTMAGDITFAKTTLDGPLFTIDGTGINFVGADHIFDGNGALYWDGKGTNNGTHKPHPFLKIKGSGTYKKFEVLNSPAQAISVGPTDAHLTLDGITVDDFAGDTKNLGHNTDGFDVSANNVTIQNCIVKNQDDCIAINDGNNIRFENNQCSGGHGISIGSIATGKHVSNVVIKGNTVTRSMYGVRIKAQRTATSASVSGVTYDANTISGIAKYGVLISQSYPDDVGNPGTGAPFSDVNFTGGATTIKVNNAATRVTVECGNCSGNWNWSQLTVTGGKAGTIKSDKAKITGGQYL

SEQ ID NO: 15360 - protein, 281 aa, Escherichia coli
MSQTSTLKGQCIAEFLGTGLLIFFGVGCVAALKVAGASFGQWEISVIFGLGVAMAIYLTAGVSGAHLNPAVTIALWLFACFDKRKVIPFIVSQVAGAFCAAALVYGLYYNLFFDFEQTHHIVRGSVESVDLAGTFSTYPNPHINFVQAFAVEMVITAILMGLILALTDDGNGVPRGPLAPLLIGLLIAVIGASMGPLTGTAMNPARDFGPKVFAWLAGWGNVAFTGGRDIPYFLVPLFGPIVGAIVGAFAYRKLIGRHLPCDICVVEEKETTTPSEQKASL

SEQ ID NO: 15361 - protein, 447 aa, Enterococcus faecalis
  misc_feature (42)..(42): Xaa can be any naturally occurring amino acid
MKVIVLGSSHGGYEAVEELLNLHPDAEIQWYEKGDFISFLSXGMQLYLEGKVKDVNSVRYMTGEKMESRGVNVFSNTEITAIQPKEHQVTVKDLVSGEERVENYDKLIISPGAVPFELDIPGKDLDNIYLMRGRQWAIKLKQKTVDPEVNNVVVIGSGYIGIEAAEAFAKAGKKVTVIDILDRPLGVYLDKEFTDVLTEEMEANNITIATGETVERYEGDGRVQKVVTDKNAYDADLVVVAVGVRPNTAWLKGTLELHPNGLIKTDEYMRTSEPDVFAVGDATLIKYNPADTEVNIALATNAMKQGRFAVKNLEEPVKPFPGVQGSSGLAVFDYKFASTGINEVMAQKLGKETKAVTVVEDYLMDFNPDKQKAWFKLVYDPETTQILGAQLMSKADLTANINAISLAIQAKMTIEDLAYADFFFQPAFDKPWNIINTAALEAVKQER

SEQ ID NO: 15362 - protein, 394 aa, Rhizobium etli
MRARVASSPSGRSSHSRSNCGRTQENIMVKITAAVAVKPKSPLEFRELELADPEGNEILVRTVASGICHTDLLLRDGIFGPPAPVIPGHEGVGVVEAVGPEVQSLKVGDHVALSQSSCGFCADCRRSHPMNCQNYTQYNLTGLRPNGKKALLCDEVGIGSNFVGQSSFATHILATENNAALLPKTDLDLTDAAPLGCGMATGAGTVINAMKPEIGSTIAVFGAGAVGMAAVMAAKVRRCSKIIIIDLNQQRLDMAMGLGATHAINGKDPDVVNQIHALTGGGADFAIDAVGIIPVILNSIKCTRAGGHVVLLGLDALGNDIPIPLDLMVFNRKIQGAILGDQIPQLFIPQMMDLNQAGLFPFQKLITKYPFEKINEAIADAEAGRVIKPVVVFN

SEQ ID NO: 15363 - protein, 209 aa, Rhizobium etli
MSTLVIVRHGQSEGNARGEFTGTSDVPLTQEGWSESRRAGSLLANLGISFDIAFSSALLRTVDTCRAILNETNGDLLEPIRRTELNERDYGQLTGINKNVARERWGQDVVQVWRRSYSTPPPGGESIRDISARVLPFLISEVFPPLLRGKSVLVVAHGNTIRSLKQGIERLTIQDTLAIESPTAAPTVYRIASDLSIIEKTNVLVGTVC

SEQ ID NO: 15364 - protein, 368 aa, Rhizobium etli
MKQAYAAVSREKAKPLILECIGIEEPRADEILVRIVASGVCHTDLVVRDQGYDVPQPVVLGHEGSGVVEAVGSAVKDLVPGDHVALSYAYCGKCEKCLSGTPFYCEDFFGRNFRGTRPDGTCPIHDSHGKQISGCFFEQSSFATYAIASERNAVKVAKDVPLELIGPLGCGLQTGAGAVLNCLKPKPGSSIAVFGAGAVGMAATMAAKIAGCATIIVIDLNDERLELSRELGATHTINARKLDSVAAIRKIVPAGVDFSLECTSSPRVFRQAVDCLGTPGTCGLVGSSALGTEGTIDIGNFLFGRTLIGVVEGQSVPSEFVPQLIEYWQQGLFPFDKLVQFYDLDQINEAMADSESGKVIKPILRMKH

SEQ ID NO: 15365 - protein, 431 aa, Rhizobium etli
MNVLRKETSQPPASVSIIGAGGICDLIGNSVLDFHRIQRLPPYVFEQVNRLKASARAGGADIIDLGMGNPDLPTPQSIVDKLCEVVQDPRTHRYSSSKGIPGLRRAQAAYYARRFGVKLNPDTQVVATLGSKEGFANMAQAITAPGDVILCPNPTYPIHAFGFLMAGGVIRSMSVEPDESFFPPLERAVRHSIPKPLALILNYPSNPTALVATLDFYKDVVAFAKKHDIIVLSDLAYSEIYFDGAPPPSVLEVPGAMDVTVEFTSMSKTFSMPGWRMGFAVGNERLIAALTRVKSYLDYGAFTPIQVAATHALNGDGSDIAEVRNVYKRRRDVMVESFGKAGFDVPPPAATMFAWAKIPEKFRHLGSLEFSKLLVEKADVAVAPGIGFGEMGDDYVRLALVENEHRIRQAARNIKRWLSGDEKFEINVMNQ

SEQ ID NO: 15366 - protein, 375 aa, Rhizobium etli
MQMRSVILRESGLPKPYSNSKPLKIELVELTPPGPMEVLVKIKAAGVCHSDLSAINGDRPRPLPVALGHEASGVVAAIGPSVEKVEVGDHVVMSFLPVCGHCSYCAEGRASLCEPGYQANAAGTLLSGGKHIRLRGYEINHHSGVSAFSEYAVVSASSVVKVTKDIDLATAALFGCAVMTGVGAVMNTCGVRPGRSVAVIGLGGVGLSAILGAVASGASDIVAIDLIQAKLDLAKELGATKTFLATSPNIVAQVKGATSGGVDYAIEMAGSKKAFELAYEITRRGGMTATAGLASANSRFEVSPLPLVGEERTIKGSYMGSCVPSRDIPRYIDLYLKGKLPVDKLLSSTGPLDEINEVFDRLDRAEINRHLVLMD

SEQ ID NO: 15367 - protein, 495 aa, Rhizobium etli
MAISSTLLGRLKDQTLVREQMLVGGKWSSEGVNGTRINVLNPSTMDVLASLPSAGLAEVRASIDAAKAAQKKWAKVSAKERSLIMRKFYEEVVANAEDLAVILTSEMGKPLAEARGEIAYGASYIEWFGEEAKRVYGDTIPGHQADKRLLVIKQPVGVVAAIAPWNFPSAMVCRKIAPALASGCAIVFKPAAETPLSALALAILAERAGIPDGLFSVLPTDNARMFGEEVCSNPVVKKLTFTGSTEVGRILMAQGAQKIMKLSLELGGNAPFIVFDDADLDQAVEGAMLSKFRNAGQTCVCANRIYVQSGIHDRFVEKLAMRVSALQVLDGFESGATIGPLINDEAVAKLYGHIDDAVTKGATVVVGGDRDARGGTFVQPTLLSGATKDMKVAREETFAPLAPVFKFDTVEEVIELANDTEFGLAAYFFANDLRNVWKVTEALEYGMVGVNTGLISTELAPFGGVKQSGFGREGSKYGMDDFLSMKYVCMGGIGA

SEQ ID NO: 15368 - protein, 294 aa, Rhizobium etli
MSPRKNLRVAFIGLGAMGGPMAQHLLSAQFEVTGFDLSAEARERFAAVGGVPAETVAEAFNGADVAVTMLPNGKIVQDALFKDGAWQSLSADALVIDMSSSAPNDTRELAERLHQKGLRLVDAPVSGGVKRAVEGSLTIMAGGASDDIDQADPILCAMGGQIFRTGPIGSGHAMKAINNFVSGAGVLAAIEGVLLGRTFGLDPRTIVDILNSSSGKNNATEVKMKQFILSETFGSGFALGLMAKDIRIAADLSKALNLQLPTLAGTADAWDAARHALGPDVDHTKIAQFVKDQA

SEQ ID NO: 15369 - protein, 257 aa, Rhizobium etli
MKKYVCEFFGTFTLVFLGCGTLLYMRQEVGLLGVALAFGTTVVAMAYTIGPVSGAHLNPAVSLGFLVSRRLRVWDFLAYVSAQCAGAIAAAGTLYLIAMNKVGGYDITLEGFAQTGWVVYGWRAAFLFEFIATFLFVTVFLKCTAGRGAVARLAIGLALVAIHLGGITVSGSSVNPARSIGPALFAGGAALSQLWLYICAPMLGAIAAGLLQLRGIVASSEPQSLRQFESREMTSDISSPVSFFRHRRRGIPKRESH

SEQ ID NO: 15370 - protein, 150 aa, Cynara cardunculus
GSGIVALTNDRDTDYFGEIPTQTPPQNFAVIFDTGSSDLWVPSEISAGKAVPVWNMVLNGLVEEAVFSFWLNRLVFGGVDPNHFRGGHYYVPVTRMGDVLIGDKSAESIVDCNGISSMPNTAFTIGGKKLTPEMSPYHTVFDYGKLRVGF

SEQ ID NO: 15371 - protein, 513 aa, Hordeum vulgare
MDGNNRGGGHSEVLKNYNLGKTLGLGTFGDVKVAERNVTGQRVAIKILNRRKMETMEMEEKGNREIKIMRLFIDFIHPHIIRVYEVIETPKDIFVVMEYCNNGELLDYIIENGRLQEDEARRIFQQILAGVEYCHRIMVVHRDLKPENLLLDSRYNVKLADFGLSNVMRDGHFLKTSCGSLNYAAPEIISSKLYAGPEVDVWSCGVVLYALLCGSVPFDDDNIPSLFRKIKGGTYILPSYLSDSARDLIPKLLNIDPMKRITFHEIRVHPWFKNHLPCYLAVPPPYKEQQAKMIDEDILREVVNLGYDKDHVCESLWNRLQNEETVAYYLLLDDRFRSTSGYLGADHQHLMDRSFNEFTLSESASPSTRNYLPGINDSQGGGLRPYYPVQRKWAIGLQSGAHPRDIMIEVLKALKELNVCWKKNGLYNMKCRWCPGFPQVSDMLLDSNHNFVDDSTIMDNGNADGRLPAVVKFEIQLYKTKDNKYLLDIQRVTGPQLLFLEFCGAFLTNLRVL

SEQ ID NO: 15372 - protein, 299 aa, Bacillus caldovelox
MKPISIIGVPMDLGQTRRGVDMGPSAMRYAGVIERLERLHYDIEDLGDIPIGKAERLHEQGDSRLRNLKAVAEANEKLAAAVDQVVQRGRFPLVLGGDHSIAIGTLAGVAKHYERLGVIWYDAHGDVNTAETSPSGNIHGMPLAASLGFGHPALTQIGGYSPKIKPEHVVLIGVRSLDEGEKKFIREKGIKIYTMHEVDRLGMTRVMEETIAYLKERTDGVHLSLDLDGLDPSDAPGVGTPVIGGLTYRESHLAMEMLAEAQIITSAEFVEVNPILDERNKTASVAVALMGSLFGEKLM

SEQ ID NO: 15373 - protein, 400 aa, Aspergillus parasiticus
MPLLEAPRNGPKVSNGVLSGVSHSQSFGIDTESHSDDPNRRQRIVVVGLGMVAISFLEKLVKQDSERRKYDIVVIGEEPHVAYNRVGLSSFFEHRNIEDLYLNPKEWYGSFKDRSFDYHLNTRVTDIFPDRKTVKTSTGDTIAYVLLVLATGSDAVLPTHTPGYDANGVFVYRTISDLERLIEFASKHQGETATTVGGGLLGLEAAKAMTDLEDFGKVKLIDRNKWVLARQLEADAGTLVTRKIRELGLDVLHQKRVAKIKTDDNNNVTGIVFEDGEEIDCCCVCFRIGVRPRDELGTTAGIQCASRGGFVINESLQTSIPEIYAIGECASCANQTFGIIAPGIEMADVLAFNLTNPDKEPKSFRRPHLSTKLKLLGVDVASFGDFFADRDGPKFLPGRR

SEQ ID NO: 15374 - protein, 185 aa, Oryza rufipogon
FGSVYRGRLSIKGTVTEAAVKQLDRNGMQGNREFLVEVLMLSLLAEHPNLVTLLGYCTDGDHRILVYEYMARGSLEDHLLDLPPGAAALDWTTRMRIAQGAARGLEHLHDAARPPVIYRDFKASNILLDSSLQARPSDFGLAKVGPVGDRTHVSTRVMGTYGYCAPEYALTGKLTTCSDVYSFGV

SEQ ID NO: 15375 - protein, 314 aa, Methylobacterium dichloromethanicum
MTKKVVFLDRESLDATVREFNFPHEYKEYESTWTPEEIVERLQGAEIAMINKVPMRADTLKQLPDLKLIAVAATGTDVVDKAAAKAQGITVVNIRNYAFNTVPEHVVGLMFALRRAIVPYANSVRRGDWNKSKQFCYFDYPIYDIAGSTLGIIGYGALGKSIAKRAEALGMKVLAFDVFPQDGLVDLDTILTQSDVITLHVPLTPDTKNMIGAEQLKKMKRSAILINTARGGLVDEAALLQALKDGTIGGAGFDVVAQEPPKDGNILCDADLPNLIVTPHVAWASKEAMQILADQLVDNVEAFVAGKPQNVVEA

SEQ ID NO: 15376 - protein, 148 aa, Arabidopsis thaliana
MPSSTFSGTVSTPKLSVAVDMGNPFLNLTVDAFLKIGAVGVTKSLAEDTYKAIEKGSLSKSTLEHALKKLCKEGVYWGAAGGVYIGTEYGIERIRGSRDWKNAMLAGAATGAVLSAVGKKGKDTIVIDAILGGALATASQFVNNHYFY

SEQ ID NO: 15377 - protein, 334 aa, Arabidopsis thaliana
MSKNNKKKRRWDLKNGGILLEELIASFDGKTNPIRCFSSDQILKATDNFSESRIISSWGYFIWYKGVIEERQVSIKKWSSQNLSSFTEAYRDISVSSQMSGHKNALKLIGCCLEFDLPALVCEYTEHGPLNRDGGLSSGVVLPWKVRLKIAKEIASSVTYLHTAFPETIVHRNINPTNIFIDENWTAKLSDFWFCVAIPEGELYVEDDVKGVIGFVDPDYYWTMKVTEKVDIYSFGVVMLVLLSGRAAVFNGPDEAPMSLNDHVSEVMEKGEFDEIVDKEIWNDLGGDDDLVLRRSQVKAFLRLALRCVRYKKEDPVSGMLEVAKELKLIEKLS

SEQ ID NO: 15378 - protein, 297 aa, Arabidopsis thaliana
MAAVNCHFFQLSRHLKPSRPSFSCSASQPSQNNIKVIINGAAKEIGRAAVVAVTKARGMELAGAVDNHFVGEDIGLLCDMEEPLEIPVVSDLTMVLGSISQGKEVVVIDFTDPSTVYENVKQATAFGMKSVVYVPRIKPETVSALSALCDKATMGCLVAPTLSIGSILLQQAVIMASFHYNNVELVESRPNAADLPSPEAIQIANNISNLGQIYNREDSSTDVQARGQVIGEDGVRVHSMVLPGLPSSTQVYFSSPGDVYTVKHDIIDVRSLMPGLLLAIRKVVRLKNLVYGLEKFL

SEQ ID NO: 15379 - protein, 247 aa, Arabidopsis thaliana
MVILSASSTVRAALDTQPRLPYNPNAPRKVKKIPNGNSFLPPPSPAPSPGISISVADLLKRPSSKEITVDLDDTYMGYETWSPSPPKLEKPRSVFNAASLAFIGDSIYELYARRHFLFPPLSIEDYNDRVRAVVRCEAQYALLKKLVDDDFLTKEERDILRWGKNLGSARTRTRRRAGNAVYKKASSLETLIGYLYLTNGKRLEKIMEKLGFSSDSSTEIVIEETNPKPSESSNLPNFILNEQVVSF

SEQ ID NO: 15380 - protein, 486 aa, Arabidopsis thaliana
MESVALSRIGLAGLAVMGQNLALNIADKGFPISVYNRTTPKVDETLDRASNEGKLPVAGQYSPRDFVLSIQRPRSVIILVKAGAPVDQTITALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAAKVLEEAGLKEDIGSASRGVDKKRLIDDVRQALYASKICSYAQGMNLLRAKSLEKGWDLNLGEMARIWKGGCIIRAVFLDRIKKAYQRNTNLASLVVDPDFAKEMVQRQAAWRRVVGLAISAGISTPGMCASLAYFDTYRRARLPANLQAQRDLFGAHTYERTDRPGAYHTEWTKLARKSQ

SEQ ID NO: 15381 - protein, 293 aa, Arabidopsis thaliana
MATNIGMMDSAYFVGRNEILSWINDRLHLNLSRIEEAASGAVQCQMLDMTFPGVVPMHKVNFEAKNEYEMIQNYKVMQEVFTKLKITKPLEVNRLVKGRPLDNLEFLQWLKRFCDSINGGIMNENYNPVERRSRGGREKSVKGSSKISKSLQTNNMHHPPVATSNKPAGPKQAKSHGIGGGSNSSAEVQALSKEVEDLKVSVDLLEKERDFYFSKLRDIEILCQTPELDDLPIVVAVKKILYATDANESVLEEAQECLNQSLGLEGYEEEGKEEEEEEEEEEEEAAAAAETQT

SEQ ID NO: 15382 - protein, 401 aa, Arabidopsis thaliana
MATKRSVGTLKEADLKGKSVFVRVDLNVPLDDNSNITDDTRIRAAVPTIKYLMGNGSRVVLCSHLGRPKGVTPKYSLKPLVPRLSELLGVEVVMANDSIGEEVQKLVAGLPEGGVLLLENVRFYAEEEKNDPEFAKKLAALADVYVNDAFGTAHRAHASTEGVAKYLKPSVAGFLMQKELDYLVGAVANPKKPFAAIVGGSKVSTKIGVIESLLNTVDILLLGGGMIFTFYKAQGLSVGSSLVEEDKLDLAKSLMEKAKAKGVSLLLPTDVVIADKFAPDANSKIVPATAIPDGWMGLDIGPDSIKTFSEALDTTKTIIWNGPMGVFEFDKFAAGTEAVAKQLAELSGKGVTTIIGGGDSVAAVEKVGLADKMSHISTGGGASLELIEGKPLPGVLALDEA

SEQ ID NO: 15383 - protein, 354 aa, Arabidopsis thaliana
MWQMNLGSDDTMGVDGSYPERHGEPDCAYYIRTGLCRFGSTCRFNHPHDRKLVIATARIKGEYPERIGQPECEFYLKTGTCKFGVTCKFHHPRNKAGIDGSVSVNVLSYPLRPNEDDCSYFLRIGQCKFGGTCKFNHPQTQSTNLMVSVRGSPVYSALQSLTGQPSYSWSRTSFVANPPRLQDPSGFASGSQGGLFSSGFHSGNSVPLGFYALPRENVFPERPGQPECQFYMKTGDCKFGTVCKFHHPRDRQTPPPDCVLSSVGLPLRPGEPLCVFYSRYGICKFGPSCKFDHPMRVFTYNNNTASPSPSSSLHQETAITTELRNLLVSSSVEAKPTSLPETTSAKDTIVDAQH

SEQ ID NO: 15384 - protein, 484 aa, Arabidopsis thaliana
MAAKKVFGSAEASNLVTELRRSFDDGVTRGYEWRVTQLKKLMIICDNHEPEIVAALRDDLGKPELESSVYEVSLLRNSIKLALKQLKNWMAPEKAKTSLTTFPASAEIVSEPLGVVLVISAWNYPFLLSIDPVIGAISAGNAVVLKPSELAPASSALLTKLLEQYLDPSAVRVVEGAVTETSALLEQKWDKIFYTGSSKIGRVIMAAAAKHLTPVVLELGGKSPVVVDSDTDLKVTVRRIIVGKWGCNNGQACVSPDYILTTKEYAPKLIDAMKLELEKFYGKNPIESKDMSRIVNSNHFDRLSKLLDEKEVSDKIVYGGEKDRENLKIAPTILLDVPLDSLIMSEEIFGPLLPILTLNNLEESFDVIRSRPKPLAAYLFTHNKKLKERFTATVSAGGIVVNDIAVHLALHTLPFGGVGESGMGAYHGKFSFDAFSHKKAVLYRSLFGDSAVRYPPYSRGKLRLLKALVDSNIFDLFKVLLGLA

SEQ ID NO: 15385 - protein, 255 aa, Arabidopsis thaliana
MTKDFAVPPVVFPSGGSSGGANVQQRRFPATPFQPPRPSSSAIPFMSFDIGSAAASSATPAGPFGGTIASSSSFGGGSASFEDEEPLLDELGIHPDQIWKKTRSILNPFRINQAVHKDSDLSGPIFLYLALCLFQLLAGKIQFGVILGWIVVSSIFLYVVFNMLAGRNGNLNLHTCTSLVGYCLLPVVILSAVSLFVPQGAGPVRFVLAALFVLWSTRACSTLVVSLADGGEEHRGLIAYACFLIYTLFSLLVIF

SEQ ID NO: 15386 - protein, 452 aa, Arabidopsis thaliana
MAPSLSPIRSHHVAVIGAGAAGLVAARELRREGHSVVVFERQKQVGGTWIYTDHIEPDPLSVDPTRSVVHSSVYGSLRTNLPRECMGYRDFPFVVRSGVSESRDPRRFPSHGEVLAYLQDFAKEFAIEEMIRFDTAVVKVAPAAEEGSGKWRIESTEKEKKVLRDEIYDAVVVCNGHYIEPRHAEIPGISSWPGKEMHSHNYRIPEPFRDQVVVLIGNSASADDISRDIARVAKEVHVACRSNEADTYIERPGYNNLWMHSMIECVHKDGSVVFQNGKTISVDVIMHCTGYKYHFPFLETNGNVTVDDNRVGPLYKDVFSPAFAPWLSFVGIPWKVVPFPMFELQSKWIAGVLSGRIPLPSKEDMMMEIKTLYSTLDAQGIAKRYTHQMGISQFEYNSWLASQCGCSETEEWRKEMYFATGVKKRAHPETYRDEWDDHHLVSQAYQDFSLYA

SEQ ID NO: 15387 - protein, 476 aa, Arabidopsis thaliana
  misc_feature (321)..(321): Xaa can be any naturally occurring amino acid
MDLLFLFFSLLLSYLFFKIWKLIDSKQDKDCYILDYQCHKPTDDRMVSTQFSGEIIYRNQNLGLTEYKFLLKAIVSSGIGEQTYAPRLVFEGREERPSLQDGISEMEEFYVDSIGKLLERNQISPKDIDILVVNVSMLSSTPSLASRIINHYKMRDDVKVFNLTGMGCSASLISVDIVKNIFKSYANKLALVATSESLSPNWYSGNNRSMILANCLFRSGGCAILLTNKRSLRKKAMFKLKCMVRTHHGAREESYNCCIQAEDEQGRVGFYLGKNLPKAATRAFVDNLKVITPKILPVTELIRFMLKLLIKKIKIRQNPSXGSTNLPPGTPLKAGINFKTGIEHFCIHTGGKAVIDGIGHSLDLNEYDIEPARMTLHRFGNTSASSLWYVLAYMEAKKRLKRGDRVFMISFGAGFKCNSCVWEVVRDLTGGESKGNVWNHCIDDYPPKSILNPYLEKFGWIQDEDPDTFKVPDAFM

SEQ ID NO: 15388 - protein, 429 aa, Arabidopsis thaliana
MEYYTYFDESCIQDMNYFVKTITGIKSKGIRPDLIGSIIAHYASKWLPDLSGNVSAIISSTSLESKNNHNDTQPESVTASVMKKRFFVETLIGILPPEKDSVPCNFLLRLLRTAKMVGANPNYLTELETRVSWQLDQASLKELMIPSFSYTSGTLLDIELVTRLVNKFSGLDSEGVKTAAALVKVAKLVDSYLAEAAVDGGLALPEFISLITALPSHARTTEDGLYRAIDTYLKAHPQVLKQERKELCRLIDSRKLSPEAALHAAQNDRLPVRAIIGVLFTEQTKLSRHIDCNSSSISSTTRSPTNASGSHYLEGGSAARCLSKREMNVQQAEIRRLREDVVRLQSQCGAMHFQLERLMEKKSSGGSKGFFRWKRLGLVPSIRGSVSVEKGEEESGDNGEGFEPRTPGNMKTRLVKGRTTPSRWRKSMS

SEQ ID NO: 15389 - protein, 381 aa, Arabidopsis thaliana
MAMHTVRLSPATQLHGGISSNLSPSNRKPNNSIVRYGCGSSKRFRIVTVLASLRENDANGRDNSVRAMEVKKIFEDSPLLPKPLSSNQLTESVSNGSRVRVAYQGVRGAYSESAAEKAYPNCEAVPCEEFDTAFEAVERWLVDRAVLPIENSLGGSIHRNYDLLLRHNLHIVGEVKLAVRHCLLANHGVNIEDLRRVLSHPQALAQCENTLTKLGLVREAVDDTAGAAKQIAFENLNDAAAVASEKAAKIYGLNIVAKDIQDDCDNVTRFLMLAREPIIPGTNRLFKTSIVFSLEEGPGVLFKALAVFALRQINLTKIESRPLRKHPLRASGGLKYFDYLFYVDFEASMADEVAQNALRHLEEFATFLRVLGSYPVDTTML

SEQ ID NO: 15390 - protein, 509 aa, Arabidopsis thaliana
MDIDVGPVDPSVLYEQDLHVSSAVWEGQERGLLRCQEHTSLLHQWKLTDEQINLVDKAGFGYFRKIGPMSLNNSLISALVERWRRETNTFHLPLGEMTITLDEVALVLGLEIDGDPIVGSKVDDEVAMDMCGRLLGKLPSAANKEVNCSRVKLNWLKRTFSECPEDASFDVVKCHTRAYLLYLIGSTIFATTDGDKVSVKYLPLFEDFDQAGRYAWGAAALACLYRALGNASLKSQSNICGCLTLLQCWSYFHLDIGRPEKSEACFPLALLWKGKGSRSKTDLSEYRRELDDLDPSKITWCPYERFENLIPPHIKAKLILGRSKTTLVCFEKIELHFPDRCLRQFGKRQPIPLKVKRRDRKNRRLDDLDTSMSLACEEWAERGDHIVDSPGGGNVVDDGAYMEWYARISITKLYREAFLESQVMNMIACMREFEEAASGIALERLSPAEREVMESVKDTFANSLTFGGWQEVAVNSGYGKRRRRNEHTPTPNNGGGNDISSLLLQKEDS

SEQ ID NO: 15391 - protein, 441 aa, Arabidopsis thaliana
MGKDRISELPDALLIKILSFLPTKIVVATSVFSKQWRPLWKLVPNLEFDSEDYDDKEQYTFSEIVCKSFLSHKAPVLESFRLEFESEKVDPVDIGLWVGIAFSRHLRELVLVAADTGTGTAFKFPSSLCTCNTLETLRLVLLILVDISSPVVMKSLRTLHLELVSYKDESSIRNLLSGCPILEELLVIRGEDSDIEVFTIDEVPSLKRLTINDDHDGQEFWGYVINAPSLKYLLIEDLRCPGFCLNAPELMEANIFDGTSITNDNFLGYLTSVKRLLLNLSPWKITYPTGSIFYQLVSLEMYTREIDWWDLLTLMLEHSPKLQVLKLTDNCVKFHKNGLPGGKWNEPKYVPECLLSHLETFVWRRFDWGREEEKEIATYILKNARRLNKATFSTNPVNSEELDKLKERRKVHNELDGVVRASNSCQFVFKFDTSYHVSDSS

SEQ ID NO: 15392 - protein, 351 aa, Arabidopsis thaliana
MKKQYLKSGSGTRKEKDKAKRWFLDNGSIFLRELVADCNGKSIPIRSFSPEQILKATNNFDSSCFVSQDVYYKWYRGEIEDRSYMIKRFSEDEITGKRHRVKEVYNDIVLSARMSNHSNFLQLLGCCLEFPFPVLVFEFAEHGAMNQRGGVIVNGEESLLPWSVRLKIGKEIANAVTYLHTAFPKIIIHRDVKPMHVFLDKNWTAKLSDLSFSISLPEGKSRIEAEWVLGTFGYIDPLYHKTCFVTEYTDVYSFGICLLVIITGKPAIMTISDGDLQGILSLVRELCENGKLDEVIDPRLMKDITSGQRLQVEACVVLALRCCKERDEDRPKMIQVAKELKQIEASLKNSS

SEQ ID NO: 15393 - protein, 166 aa, Arabidopsis thaliana
MAFVTTAEVCDANQELIRSGQLRALQPIFQIYGRRQIFSGPVVTVKVFEDNGLIRQFIEEKGNGRVLVVDGGGSQRCAILGGNPVVQAQNNGWAGIVVNGCIRDVDEINGCDIGVRALASHPIKARKKGLGEQRVPVNIAGTRICDGEWLYADTDGILVSQIELSV

SEQ ID NO: 15394 - protein, 334 aa, Arabidopsis thaliana
MATATSHQSVVSFASLRSSPSSTISQCGFKIDSSLSFTSKKTNFCKIKAMASSVSYDNTLLSPSKTIPDNSQKKSNEAALILIRRGESLWNEKNLFTGCVDVPLTEKGVEEAIEAGKRISNIPVDVIFTSSLIRAQMTAMLAMIQHRRKKVPIILHDESEQAKTWSQVFSDETKNQSIPVIPAWQLNERMYGELQGLNKQETAERYGKEQVHEWRRSYDIPPPKGESLEMCAERAVAYFQDNIEPKLAAGKNVMIAAHGNSLRSIIMYLDKLTCQEVISLELSTGIPLLYIFKEGKFMKRGSPVGPTEAGVYAYTKRLAQYRQKLEDDSEVLCA

SEQ ID NO: 15395 - protein, 446 aa, Lactococcus lactis subsp. cremoris
MKIVVIGTNHAGIATANTLLEQYPGHEIVMIDRNSNMSYLGCGTAIWVGRQIEKPDELFYAKAEDFEAKGVKILTETEVSEIDFANKKVYAKTKSDDEIIEAYDKLVLATGSRPIIPNLPGKDLKGIHFLKLFQEGQAIDAEFAKEKVKRIAVIGAGYIGTEIAEAAKRRGKEVLLFDAENTSLASYYDEEFAKGMDENLAQHGIELHFGELAKEFKANEEGYVSQIVTNKATYDVDLVINCIGFTANSALASDKLATFKNGAIKVDKHQQSSDPDVYAVGDVATIYSNALQDFTYIALASNAVRSGIVAGHNIGGKELESVGVQGSNGISIFGYNMTSTGLSVKAAKKLGLEVSFSDFEDKQKAWFLHENNDSVKIRIVYETKSRRIIGAQLASKSEIIAGNINMFSLAIQEKKTIDELALLDLFFLPHFNSPYNYMTVAALNAK

SEQ ID NO: 15396 - protein, 500 aa, Arabidopsis thaliana
MATIWFLPLLFLSCLLLAALRLKKRRQHQRKPPSPPGFPIIGNLHQLGELPHQSLWSLSKKYGPVMLLKFGSIPTVVVSSSETAKQALKIHDLNCCSRPSLAGPRALSYNYLDIVFSPFNDYWKELRRMCVQELFSPKQVHLIQPIREEEVKKLMNSFSESAAQKTPVNLSEKLASLTVGVICKAAFGVSFQGTVLNSDNFDKLIHDAFLFLGSFSASDYFPNVGWIIDWLTGLQGQRERSVRGLDAFYEQMFDLHKQGNKEGVEDFVDLLLKLEKEETVLGYGKLTRNHIKAVLMNVLLGGIGTSAITMTWAMTELMRNPRVMKKVQSEIRNQIGGKSMICLDDIDQLHYLKMVINETWRLHPPAPLLVPREVMSEFEINGYTIPAKTRLYVNVWGIGRDPDTWKDPEEFLPERFVNSNIDAKGQNFELLPFGSGRRMCPAMYMGTTMVEFGLANLLYHFDWKLPEGMVVEDIDMEESPGLNASKKNELVLVPRKYLNL

SEQ ID NO: 15397 - protein, 502 aa, Pseudomonas fluorescens
MTRSLTMNSSLPAIDGLRLPHQMLIGGQWVNAQSDKTLNVYNPATGDTLTDVPDGDVEDVNAAVESAAATLQSDAWRRMPPSARERILLRLADLLEAHGDELARLETLNNGKLLIYSKMMEVGASAQWLRYMAGWATKLTGSTLDLSLPLPPDVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 15398 - protein, 477 aa, Arabidopsis thaliana
MQRFAAKRSVQNISVSLWRRCISSTSQAATASVKDSDEFQARLPPFAYTPPPYTGPSADVILSKRKEFLSPSMFCLYRKPLNIVDGKMQYLFDESGRRYLDAFAGIAVVNCGHCHPDVVEPVINQIKRLQHPTVLYLNHAIADFSEALASKLPGDLKVVFFTNSGTEANELALMMAKLYTGCQDIVAVRNGYHGNAAATMGATGQSMWKFNVVQNSVHHALNPDPYRGVFGSDGEKYAKDLQDLIQYGTTGHIAGFICEAIQGVGGIVELAPGYLSAAYDTVKKAGGLFIADEVQSGFARTGNFWGFEAHNVVPDIVTMAKGIGNGFPLGAVVTTPEIAGVLTRRSYFNTFGGNSVSTTAGLAVLNVIEKEKLQENAAMVGSYLKEKLTQLKEKHEIIGDVRGRGLMLGVELVSDRKLKTPATAETLHIMDQMKELGVLIGKGGYFGNVFRITPPLCFTKDDADFLVEAMDYSMSKM

SEQ ID NO: 15399 - protein, 478 aa, Arabidopsis thaliana
MPVLYEQDKHVSSAILTGQERGVLRCQERTSLLHHWKLTKEQIELVEKAGFGWFRLIGSISLNNSLISALVERWRRETNTFHFPCGEMTITLDEVSLILGLAVDGKPVVGVKEKDEDPSQVCLKLLGKLPKGELSGNRVTAKWLKESFAECPKGATMKEIEYHTRAYLIYIVGSTIFATTDPSKISVDYLILFEDFEKAGEYAWGAAALAFLYRQIGNASQRSQSIIGGCLTLLQCWSYFHLNIDRPKRTTRQFPLALLWKGRQQSRSKNDLFKYRKALDDLDPSNVSWCPFEGDLDIVPQSFKDNLLLGRSRTKLIGPKVVEWHFPDRCMKQFGLCQVIPGEVPPRKNEKNHDEDLLEDMNTADEEWMRRRENIVENGGGNGDESEYMQWFNSITVPKLHRDTSLEADIMNVQAAILQFDEVASTLSLEDLHPEEREAIEEAVMSMSNALRVGDWYEASTTNKRKRREEQQQTDWSE

SEQ ID NO: 15400 - protein, 150 aa, Arabidopsis thaliana
MINTKKLLKMAKKWQQRAALKRKRISFQRSTTTTTTTTTTTTTSSSTAVEKGCFVVYTVDKIRFAFPLSYLNNSVFEELLKISEEEFGLRAGGPITLPFDSVFLEYLIKFIERRMDGDTEKALLMSISSARCSMQPQEQQSGYTQQLLVF

SEQ ID NO: 15401 - protein, 277 aa, Arabidopsis thaliana
MAASYHVRSSSLPARLHPHGLNQIQQLLNKLPADDNNSLSLLSNLYDSVSHLFNDSPSSLLVPHHSFFTHLLDLSLLHLDLCSKLRDITCRIKDCLRDLRSAFRRRRHSGDSTIWCHVKAFIRSRKAVHKDIAKLLLLLKQTGLSSSESSHPLITLLQQVCSQTCQTFRTVLLSLSTAVPKPRPSKWALVTKLVIKNVTSTSGQVRTGHRNEFQMMDEELRRFSMAEEIKKDRIKSMITNLDKVDVAVEDLEESLERLYRRMIQARVSLLNILSLHI

SEQ ID NO: 15402 - protein, 400 aa, Arabidopsis thaliana
METDTSAQEARNGKDIQGIQWEGFKYTRDEFRDTRLKHYDNFVNILRPSSREKLDKEHGQVVEKGKNFYDFQFNTRLVTSTIVHFQLRNLVWATSKHDVYLMQNYSLMHWSSLLQRGKEVVNVARSVTPTQKLPGLFSEPLSRVQVSSMAVKENLILLGGFDGELLCKCVNQPGVAFCTRLSTEDNAITNTVDIYRDPSGSLRLITANNDCKIRVFDAQSFTRVSEFTFDWSVNNTSVSPDGKLLAVLGDSTECLISDSRSEKVISSLRGHKDYSFASAWHPNGLILATGNQDTTCRLWDIRNPSESFAVLKGNMGAIRGLKFTPEGRFLAMAEPADFVHIFDTQSGFLQSQEIDLFGEIAGISFSPDSEALYVGVADRTYGSLMEYKRSKDNHYMDSFY

SEQ ID NO: 15403 - protein, 513 aa, Arabidopsis thaliana
MTTTEFQSCFIFLLLCLFSLVCYSLFFRKPSSRRDAHGCDLPPSPPSLPVIGHLHLILSSLVHKSFQKISSNYGPLLHLRIFNVPIVLVSSASVAYDIFRVHDLNVSSRGSPPFEESLLFGSTGFISAPYGDYFKFMKKHLVTKLLGPQALERSRLIRTNELERFYINLLDKATKKESVEIGKEAMKLSNNSICKMIMGTSCLEEKGEAERVRGLIIESFYLTKKFFLAFTLRGLLEKLGISLFKKEIMGVSRRFDDLLERYLREHEEKPDNEHQDTDMIDALLAAYRDEKAEYKITRNQIKAFLVDIFIAGTDISALTTQGTMAEIINNPNIFVRIREEIDSVVGKSRLIQETDLPKLPYLQAVVKEGLRLHPPTPLMVREFQEGCKVKGFYIPASTTLVVNGYAVMRDPNVWEDPEEFKPERFLASSRLMQEDEIREQALKYIAFGSGRRGCPGANVAYIFVGTAIGMIVQCFDWRINGEKVDMKEAIGGLNLTLAHPLKCTPVARFPKPF

SEQ ID NO: 15404 - protein, 382 aa, Arabidopsis thaliana
MDLVRLRDIGSISPQRRRKWLILLAVFGVSGYGVYRVYNSEYIARKTKRLMKLFSGIVSFAEMVIDSAETISIVSRDLKDFLDSDSDEIPNSLKQLSKITKSKEFTDSLARVSEAVAIGVFRGYSFDQNVEKESNLSLVDRVFSEEGAGFVSVVVGSFAKNLVLGFYSGEIDIGSDDSLKPRWMNLLSDDKCRELLADCIERFTSSAVSVYIEKTVGVNTYDQIFAGLTNPKHRDSARDVLVSVCNGALETFMRTSHDVFTSSGEKTDSSSLRKSENRENGWAEALSTTLAVPSNKKFMFDVTGRVTLETMRSILEFVILKTSQSFKRSLDVIHEEVTERGRQVVGYVGAKSSVIITVCLAVYFHIFNRFVRGPPVCLSQQF

SEQ ID NO: 15405 - protein, 323 aa, Arabidopsis thaliana
MEDRCLIKNDVTELVGNTPMVYLNNVVDGCVARIAAKLEMMEPCSSVKDRIAYSMIKDAEEKGLITPGKSTLIEPTAGNTGIGLACMGAARGYKVILVMPSTMSLERRIILRALGADLHLSDQRIGLKGMLEKTEAILSKTPGGYIPQQFENPANPEIHYRTTGPEIWRDSAGKVDILVAGVGTGGTATGVGKFLKEQNKDIKVCVVEPVESPVLSGGQPGPHLIQGIGSGIVPFNLDLTIVDEIIQVAGEEAIETAKLLALKEGLLVGISSGAAAAAALKVAKRPENAGKLIVVVFPSGGERYLSTKLFDSIRYEAENLPIE

SEQ ID NO: 15406 - protein, 381 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKCLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLSGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 15407 - protein, 344 aa, Arabidopsis thaliana
MAQILSPVCTDLLKFQNSALSSRSGASPRFSAKTTGASSSWYLPRYAGKRRTDSIGRLRVATEDASSLSTGDVADDYYAVLGLLPDATQEEIKKAYYNCMKSCHPDLSGNDPETTNFCMFINDIYEILSDPVQRMVYDEIHGYTVTAINPFLDDSTPRDHVFVDEFACIGCKNCANVAPDIFQIEEDFGRARACNQRGNPDLVQQAVETCPVDCIHQTSAAQLSLLEDEMRRVERVNVALMLSGMGSGAVDVFRMARSRWEKRQAKVLNQARSRMMKRKNTDETPSYWDNLWGKQNEYQKSEEEVQERAQRAAAAARRWREYSRRGVDKRPTFKLPDSASRGDN

SEQ ID NO: 15408 - protein, 181 aa, Arabidopsis thaliana
MRKEIESSQENALSLCTEKVLLARQAYDLIDSHVKRLDEDLNNFAEDLKQEGKIPPDEPSVLPPLPIVPKAEKRKSFYGTPQPKKIDYRDRDWDRDRDFELMPPPGSNRKDLMPIEEQPIDPNEPTYCVCHQVSFGDMIACDNENCQGGEWFHYTCVGLTPETRFKGKWYCPTCRLLPQSH

SEQ ID NO: 15409 - protein, 110 aa, Arabidopsis thaliana
MSSSPLSSSLFHPLSTLSTHCHGRRQNLYFNRKQQPFVVRAAKLPEGVIVPKAQPKSQPAFLGFTQTAEIWNSRACMIGLIGTFIVELILNKGILELIGVEIGKGLDLPL

SEQ ID NO: 15410 - protein, 233 aa, Arabidopsis thaliana
MFRNQDSKYLIPVQKEAPPVTTLPMKASTVKSPHNCEAILRDADPPISLSSVNLSEQLRSGVFLKPKKQIKYWVDERNSNCFMLFAKNLSITWSDDVNYWTWFTEKESPNENVEAVGLKNVCWLDITGKFDTRNLTPGIVYEVVFKVKLEDPAYGWDTPVNLKLVLPNGKETPQEQKLSLRELPRYKWVDVRVGEFVPEKSAAGEITFSMYEHVAGVWKKGLSLKGVAIRPKQ

SEQ ID NO: 15411 - protein, 226 aa, Arabidopsis thaliana
MGITRNLILGLACLAFVSIAKALPHEPELGSARVVFQTSYGDIEFGFYPTVAPKTVDHIFKLVRLGGYNTNHFFRVDKGFVAQVADVASGRSAPMNEEQRKEAEKKIVGEFSDVKHVRGTLSMGRYDDPNSAQSSFSMLLGNAPHLDRQYAVFGKVTKGDETLSKLEEVPTRREGIFVMPTERITILSTYYYDTKMESCEEERSVLKRRLQASFVEVERQRMKCFP

SEQ ID NO: 15412 - protein, 457 aa, Arabidopsis thaliana
MASLGQITLPRAPSSEIGLLRRRFERPIIRTRIGFNGRIASVLTNAGDQAVSVKASVSQKVIEEEAKVIVGTYARAPVVLSSGKGCKLFDPEGKEYLDCASGIAVNALGHGDPDWLRAVTEQAGVLAHVSNVYYTIPQIELAKRLVASSFADRVFFCNSGTEANEAAIKFSRKFQRFTHPEDKEVATGFIAFTNSFHGRTLGALALTSKEQYRTPFEPIMPGVTFLEYGNIQAATDLIRSGKIAAVFVEPIQGEGGIYSATKEFLQSLRSACDAAGSLLVFDEVQCGLGRTGLMWAYEAFGVTPDIMTVAKPLAGGLPIGAVLVTEKVAETINYGDHGSTFAGSPLVCSAAIAVMDKVSKPSFLSSVSNKGRYFRDLLVKKLGGNSYVKEVRGEGLIIGVELDVPASSLVDACRDSGLLILTAGKGNVVRIVPPLVISEEEIERAVEIMAQNLTALD

SEQ ID NO: 15413 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLQHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 15414 - protein, 102 aa, Arabidopsis thaliana
MMNTKKLMKMAKKWQQRAALRRKRISFQRSNSTTSSSYAVEKGCFVVYTADQVRFAFPISYLSNSVIQELLKISEEEFGIPTEGPITLPFDSIRFSWSISSN

SEQ ID NO: 15415 - protein, 342 aa, Arabidopsis thaliana
MEWVRGETIGFGTFSTVSTATKSRNSGDFPALIAVKSTGSYGAASLSNEKSVLDSLRDCPEIIRCYGEDSTVENGEEMHNLFLEYASRGSLARYMKKLGGEGLPESTVRRYTGSVLRGLRHIHAKGFAHCDIKLGNILLFNDGSVKIADFGLAMRVHGDLTALRKSEEIRGTPLYMAPESVNDNEYGSAADVWALGCAVVEMLSGKTAWSVKEGSHFMSLLIRIGVGDELPKIPEMLSEEGKDFLSKCFVKDQAKRWTAEMLLNHSFVAIDLEDDHREDFVVKVKEEDKVLMSPKCPFEFDDWDSFTLDSNPSLDSPVERLGSLVSGSIPDWSVGESWVSVR

SEQ ID NO: 15416 - protein, 414 aa, Arabidopsis thaliana
MDLLRLREKGIFLSQRRRKWLIFMAISGVSGYGAYKVYHLPSVARKRKRLFKLFGAIVSVAELISDSAETLSMVSRDVKGFLNSDSDEIPNSLKQIAKITTSNEFTDSLSRVSQAVTIGAFRGYKSESSIGDSGIEKSSDSSVVDRVIDKVFSEAGTGFVSVVVGSFAKNLVLGFYSGKVESGVKCEGSDSSETPRWVTLLGDDKCRELLADCIERFTSTAIGVYLDKTMDINTYDQIFEGLTNPKHQDSVKDVLVSVCNGALETIVRTSHDVFTSSRSKNAIEEIEDDDFKSNGSARSKMVSESGDGVKSNGWTEAIATTLAVPSNRRFMFDVTGRVTLETTRSIIAFIMVKTFQGFRKSINVVHEEVTDRGRQAVEYVGAKSSVIITVCLALYLHIISGCVRNSPIGVSQHF

SEQ ID NO: 15417 - protein, 187 aa, Arabidopsis thaliana
MALEAWFMDDSNEDQRLPHHRNPKELVPLDYLAELGVLYWKLNPENYENDSELIKIREDRGYDYMDLLDLCPEKVSNYEEKLKNFFTEHIHKDEEIRYCLAGSGYFDVRDKDDRWIRIWMQPGDLIVLPAGIYHRFTLDTSNYIKLMRLFVGEPVWTPYNRPQEEHPVRQKYIHGLTYKFGETVKAH

SEQ ID NO: 15418 - protein, 222 aa, Arabidopsis thaliana
MAEEVGLDLEELRQLQNIAKRPRVLNLINSEISNLEKLRDSAVSSNAKPKVPVTVPAPVSSSGKPVSSSALNYVTLGTFSWDQDNDKVKMYISLEGVDEDKVQAEFKPMSLDIKIHDVQGKNYRCAIPKLCKEIMPEKCKVLVKPKRIVITMVKSSRGNWLDIHHKEDKIKPSLEKEKDPMAGIMGMMKNLYEDGDEEMKKTIAKAWTDARSGKAADPLKGL

SEQ ID NO: 15419 - protein, 199 aa, Arabidopsis thaliana
MGEVVKDGREEVIQAWYMDDSEEDQRLPHHKDPKEFLSLDKLAELGVLSWRLDADNYETDEDLKKIRESRGYSYMDFCEVCPEKLPNYEVKVKSFFEEHLHTDEEIRYCVAGSGYFDVRDRNEAWIRVWVKKGGMIVLPAGIYHRFTVDSDNYIKAMRLFVGEPVWTPYNRPHDHLPARKEYIDNFVKVNEGGVIDASA

SEQ ID NO: 15420 - protein, 389 aa, Arabidopsis thaliana
MGGCFSNRIKTDIASSTWLSSKFLSRDGSKGSSTASFSYMPRTEGEILQNANLKNFSLSELKSATRNFRPDSVVGEGGFGCVFKGWIDESSLAPSKPGTGIVIAVKRLNQEGFQGHREWLAEINYLGQLDHPNLVKLIGYCLEEEHRLLVYEFMTRGSLENHLFRRGTFYQPLSWNTRVRMALGAARGLAFLHNAQPQVIYRDFKASNILLDSNYNAKLSDFGLARDGPMGDNSHVSTRVMGTQGYAAPEYLATGHLSVKSDVYSFGVVLLELLSGRRAIDKNQPVGEHNLVDWARPYLTNKRRLLRVMDPRLQGQYSLTRALKIAVLALDCISIDAKSRPTMNEIVKTMEELHIQKEASKEQQNPQISIDNIINKSPQAVNYPRPSIM

SEQ ID NO: 15421 - protein, 439 aa, Arabidopsis thaliana
MDLSSRFSSILILLLISISIASAEIRKSEIRSDDRPIIPLDEFGFTHSGRLELDASKIWLSNSNPDLDLSKVGFFLCTRDAWVHVIQQLEEEEITCALQSDLVKHVFTFNNLKGGDKSKFSTVFTENDADQYSLVFANCLQQVKISMDVRSAMYNLEGKKGGRDYLSAGRTVLPKVYFLFSVIYFSLAATWIYVLYKKRLTVFAIHFFMLGVVVLKALNLLCEAEDKSYIKKTGTAHGWDVLFYIFNFLNGITLFTLIVLIGTGWSFLKPYLQDKEKKVLMIVIPLQVVANFAQVVIDETGPYGQDWVTWKQIFLLVDVVCCCAVLFPIVWSIKNLREAAKTDGKAAVNLVKLTLFRQYYIVVICYIYFTRVVVYALETITSYKYMWTSVVASELATLGFYLFTGYKFRPEVHNPYFVVDDEEEEAAAEALKLEDEFEL

SEQ ID NO: 15422 - protein, 173 aa, Arabidopsis thaliana
MAPLQRTISDISHQISIDNTLTKEPSPTATATTLLSLSAISEVEDAKCECCGMSEECTPEYIHRVRSKFSGKLICGLCEKAVEGEMEKMNNSEVLMEKRREEAVKVHMSACSRFNRLGRSYPVLYQAEAVKEMLKKRSKKMVVATKPEKGGLARSSSCMPALAKELKDRTLVN

SEQ ID NO: 15423 - protein, 181 aa, Solanum tuberosum
MASSIVSSAAVATRSNVAQASMVAPFTGLKSAASFPVTKKNNNVDITSLASNGGRVRCMQVWPPINMKKYETLSYLPDLSDEQLLKEVEYLLKNGWVPCLEFETEHGFVYRENHKSPGYYDGRYWTMWKLPMFGCTDATQVLAEVQEAKKAYPQAWIRIIGFDNVRQVQCISFIAYKPEGY

SEQ ID NO: 15424 - protein, 219 aa, Citrus sp. cv. Murcott x Citrus aurantium
ATLVVSGDGRYYSKDAIQIITKMAAANGVRRVWIGQNGLLSTPAVSAVIRERVGSDGSKATGAFILTASHNPGGPSEDFGIKYNMDNGGPAPEGITDKIYENTKTIKEYSIAEDLPDVDISAVGVTSFGGPEGQFDVEVFDSASDYVKLMKSIFDFELIRKLLSSPKFTFCYDALHGVAGAYAKRIFVEELGAQESSLLNCTPKEDFGGGHPDPNLTYA

SEQ ID NO: 15425 - protein, 216 aa, Citrus sp. cv. Murcott x Citrus aurantium
YGNTLSISEIKMADIPDVDLSSLGVTNFGNFSVEVVDPVSDYLELMENVFDFPLIRSLLSRSDFRFVFDAMHAVTGAYAKPIFVEKLGAKPDSILNGVPLEDFGHGHPDPNLTYARDLVAIMYGENGPDFGAASDGDGDRNMILGKGFFVTPSDSVAIIAANAQEAIPYFKSGPKGLARSMPTSGALDRVAEKFKLPFFEVPTGWKFFGNLMDAES

SEQ ID NO: 15426 - protein, 490 aa, Medicago truncatula
MEMANDKVAETVIVGNYVEMESEGKPPQDIKSKLSNFLWHGGSAYDAWFSCASNQVAQVLLTLPYSFSQLGMLSGILFQLFYGILGSWTAYLISILYVEYRTRKEREKVNFRSHVIQWFEVLDGLLGKHWRNVGLGFNCTFLLFGSVIQLIACASNIYYINDNLDKRTWTYIFGACCATTVFIPSFHNYRIWSFLGLVMTTYTAWYLTIAAVLHGQVEGVKHSGPNKIILYFTGATNILYTFGGHAVTVEIMHAMWKPQKFKAIYLLATLYVLTLTIPSATAVYWAFGDMLLNHSNAFALLPKSPFRDMAVILMLIHQFITFGFACTPLYFVWEKTVGMHECKSLCKRALVRLPVVIPIWFLAIIFPFFGPINSTVGSLLVSFTVYIIPALAHIFTFKSSSARQNAVEQPPKFVGRWVGTFVINVFIVVWVLIVGFGFGGWASMVNFVHQIDTFGLFTKCYQCPPPTPSVPTMPPHQMNATAPSPHHHHH

SEQ ID NO: 15427 - protein, 359 aa, Hortaea werneckii
MAEFVRAQIFGTTFEITSRYTDLQPVGMGAFGLVCSAKDQLTSQAVAVKKIMKPFSTPVLSKRTYRELKLLKHLRHENIICLSDIFISPLEDMYVVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIATICSENTLRFVQSLPKRERQPLKNKFKNADPQAIELLERMLVFDPRKRVKAGEALADPYLAPYHDPTDEPEAQEKFDWSFNDADLPVDTWKIMMYSEILDFHNVDANAEQAAHNNDTVAG

SEQ ID NO: 15428 - protein, 225 aa, Arabidopsis thaliana
MVSPKIAPSMLSSDFANLAAEANRMIDLGANWLHMDIMDGHFVPNLTIGAPVIESLRKHTNAYLDCHLMVTNPMDYVAQMAKAGASGFTFHVEVAQDNWQQLVEKIKSTGMRPGVALKPGTPVEQVYPLVEGTTPVEMVLVMTVEPGFGGQKFMPDMMDKVRALRQKYPTLDIQVDGGLGPSTIDTAAAAGANCIVAGSSVFGAPEPGDVISLLRTSVEKAQPTT

SEQ ID NO: 15429 - protein, 326 aa, Arabidopsis thaliana
MAASNGEKSLIVSFGEMLIDFVPTVSGVSLADAPGFIKAPGGAPANVAIAISRLGGRAAFVGKLGDDEFGHMLAGILKQNGVSAEGINFDTGARTALAFVTLRSDGEREFMFYRNPSADMLLRPDELNLDVIRSAKVFHYGSISLIVEPCRSAHLKAMEVAKEAGALLSYDPNLRLPLWPSKEEAQKQILSIWDKAEVIKVSDEELMFLTGSDKVDDETALSLWHSNLKLLLVTLGEKGCSYYTKSFRGSVDPFHVDAVDTTGAGDSFVGALLCKIVDDRAVLEDEARLREVLRFANACGAITTTKKGAIPALPTESEVQSLLKGN

SEQ ID NO: 15430 - protein, 415 aa, Arabidopsis thaliana
  misc_feature (66)..(66): Xaa can be any naturally occurring amino acid
MGEEKSLLQFRSFPSLKTSDFALTEEPSWRLENNVSSNRRRGNKRSGGVFTNFASLSVAIRRDRRXSTFNGRNGGGGGAFASVSVVIPKEEDEFAPTSAQLLKNPIALLSIVPKDAALFFAGAFAGAAAKSVTAPLDRIKLLMQTHGVRAGQQSAKKAIGFIEAITLIGKEEGIKGYWKGNLPQVIRIVPYSAVQLFAYETYKKLFRGKDGQLSVLGRLGAGACAGMTSTLITYPLDVLRLRLAVEPGYRTMSQVALNMLREEGVASFYNGLGPSLLSIAPYIAINFCVFDLVKKSLPEKYQQKTQSSLLTAVVAAAIATGTCYPLDTIRRQMQLKGTPYKSVLDAFSGIIAREGVVGLYRGFVPNALKSMPNSSIKLTTFDIVKKLIAASEKEIQRIADDNRKKASPNTTDEQT

SEQ ID NO: 15431 - protein, 141 aa, Arabidopsis thaliana
MMNTKKLIKMAKKWQQRAALHRKRISFQRSSSATSSTAAEKGCFVVYTTDSTRFAFPLSYLSNSVFQELLKISEEEFGLPTGGPITLPFDSVFLEYLIKLVQRRMDADTEKALLMSISSARCSSQCSLKLQERSTQQLLVF

SEQ ID NO: 15432 - protein, 324 aa, Arabidopsis thaliana
MLTDEREVVCVTGASGCIGSWLVHQLLLRGYSVHATVKNLQDEKETKHLEGLEGAATRLHLFEMDLLQYDTVSAAINGCSGVFHLASPCIVDEVQDPQKQLLDPAVKGTINVLTAAKEASVKRVVVTSSISAITPSPNWPADKIKNEECWAAEDYCRQNGLWYPLSKTLAEKAAWEFAEEKGLDVVVVNPGTVMGPVIPPSLNASMHMLLRLLQGCTETYENFFMGSVHFKDVALAHILVYEDPYSKGRHLCVEAISHYGDFVAKVAELYPNYNVPKLPRETQPGLLRDKNASKKLIDLGLKFISMEEIIKEGVESLKSKGFIS

SEQ ID NO: 15433 - protein, 291 aa, Arabidopsis thaliana
MAQSCLKIVRINNLRNRVNRRILILRRFTRLLWSRIVACTPGKSRRYLLLSRALPSPTVSRPSPSPIPAVDVVVGGGGGGGEFVRRSSVVYDNDNSHRRSDSDLVSLKISLLGDPEIGKTSFLAKYVGEEKEVEMRELEKGINCTDKTLYMGGARISYSIWELEAERSRDQIPVACKDSVAILFMFDLTSRCTLNSVISWYQQARKSNQTAIPVMVGTKFDEFIQLPIDLQWTIASQARTYAKALNATLFFSSASYNINVNKIFKFVTAKLFDLPWTVERNLTIGEPIIDF

SEQ ID NO: 15434 - protein, 393 aa, Arabidopsis thaliana
MAETQGKVITCKAAVVWGPKVPLVIQEICVDPPQKMEVRVKILYSSICHTDLGCWNGTNEAERAFPRILGHEAVGIVESVGEGVKDVKEGDYVIPTFNGECGECKVCKREESNLCERYHVDPMKRVMVNDGGTRFSTTINKDGGSSQSQPIYHFLNTSFTEYTVLDSACVVKIDPNSPLKQMSLLSCGVSTGVGAAWNIANVKEGKSTAVFGLGSVGLAVAEGARARGASRIIGVDANASKFEKGKLMGVTDFINPKDLTKPVHQMIREITGGGVDYSFECTGNVDVLREAFLSTHVGWGSTVLVGIYPTPRTLPLHPMELFDGRRITGSVFGGFKPKSQLPNFAQQCMKGVVKLEPFITNELPFEKINDAFQLLRDGKSLRCILQISKLLKR

SEQ ID NO: 15435 - protein, 156 aa, Arabidopsis thaliana
MGACASRESLRSDSAKLILLDGTLQEFSSPVKVWQILQKNPTIFVCNSDEMDFDDAVSAVAGNEELRPGQLYFVLPLTWLNHPLRAEEMAALAVKASSALTKSGGVGWVSGDDDVTTSEKTYQKKNIAGVKTNGGGGRGCGKGKRRFTANLSTIAE

SEQ ID NO: 15436 - protein, 498 aa, Arabidopsis thaliana
MAMIEQRPKTKIVCTLGPASRSVPMVEKLLRAGMNVARFNFSHGSHEYHQETLDNLHQAMLNTGILCAVMLDTKGPEIRTGFLKDGKPIQLKQGQEITISTDYDLKGDENTICMSYKKLAVDVNPGMVILCADGTISLLVLSCDKENGTVRCRCENSAMLGERKNVNLPGVVVDLPTLTEKDKEDIMQWGVPNQIDMIALSFVRKGSDLVQVRKLLGKHAKNILLMSKVENQEGVANFDDILVNSDAFMIARGDLGMEIPIEKIFLAQKVMIYKCNIQGKPVVTATQMLESMIKSPRPTRAEATDVANAVLDGTDCVMLSGETAAGAYPELAVRTMAKICVEAESTLDYGDVFKRIMLYSPVPMSPLESLASSAVRTANSARATLIMVLTRGGSTARLVAKYRPGMPILSVVVPEIKTDFFDWSCSDESPARHSLIFRGLIPVLYAGSARASHDESTEEAIEFATQYGKEKELCKTGDSVVALLRVGNASVIKILTVK

SEQ ID NO: 15437 - protein, 363 aa, Arabidopsis thaliana
MSSDAARTPLLPTEKIDTMAQDFNLNSRTSSSRKRRLRRSRSAPRGDCMYNDDVKIDEPPPHPSKIPMFSDLNPNLRRVIMFLALYLTIGTLCFYLVRDQISGHKTSGVVDALYFCIVTMTTVGYGDLVPNSSASRLLACAFVFSGMVLVGHLLSRAADYLVEKQEALLVRAFHLRQSFGPTDILKELHTNKLRYKCYATCLVLVVLFIVGTIFLVMVEKMPVISAVYCVCSTVTTLGYGDKSFNSEAGRLFAVFWILTSSICLAQFFLYVAELNTENKQRALVKWVLTRRITNNDLEAADLDEDGVVGAAEFIVYKLKEMGKIDEKDISGIMDEFEQLDYDESGTLTTSDIVLAQTTSQIQR

SEQ ID NO: 15438 - protein, 332 aa, Arabidopsis thaliana
MPVDGKLVCVTGAGGYIASWIVKLLLERGYTVRGTVRNPTDPKNNHLRELQGAKERLTLHSADLLDYEALCAAIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYILAETALHRGEVVEILAKFFPEYPLPTKCSDEKNPRAKPYKFTTQKIKDLGLEFKPIKQSLYEYVKSLQEKGHLPLPQDSNQNEVIIEP

SEQ ID NO: 15439 - protein, 358 aa, Arabidopsis thaliana
MASDREEFNLCGPTHLTTVDWGNEDHQRCVAACLVQGIYIVEQDRQLKREGTEALASPWWESFNFKLIRHLKDDADFSIFGGIFEYKSLQPDVVDSGVPRYVIAFRGTLTKADSITRDIELDIHIIRNGLHRTSRFEIAMQAVRSMADSVGASSFWLTGHSLGAAMALLAGKTMGKSGVYIKSLLFNPPYVSPPIERIANERVRHGIRFAGSLITAGLALSRTLKQTQQPQQQQLQLQNLTEDPLEALSSWLPNIHVNPGDHLCSEYIGFFEHRGNMEQIGYGAGIVERMAMQHSLGGLLMDAMGVSNAVEVEEPVHVIPSANLIVNKTISEDYKDAHGIHQWWRDDQDLVSHIYMYK

SEQ ID NO: 15440 - protein, 366 aa, Arabidopsis thaliana
MRVMRSLRGNSGAGLVFRPVRLNSLRSVFTGCRAVILPRFGGPEVFELRENVPVPNLNPNEVLVKAKAVSVNPLDCRIRAGYGRSVFQPHLPIIVGRDVSGEVAAIGTSVKSLKVGQEVFGALHPTALRGTYTDYGILSEDELTEKPSSISHVEASAIPFAALTAWRALKSNARITEGQRLLVFGGGGAVGFSAIQLAVASGCHVTASCVGQTKDRILAAGAEQAVDYTTEDIELAVKGKFDAVLDTIGGPETERIGINFLRKGGNYMTLQGEAASLTDKYGFVVGLPLATSLLMKKKIQYQYSHGIDYWWTYMRADPEGLAEIQRLVGAGKLKIPVEKTFPITDVVAAHEAKEKKQIPGKVVLEF

SEQ ID NO: 15441 - protein, 486 aa, Arabidopsis thaliana
MAVQPTRIGLAGLAVMGQNLALNIAEKGFPISVYNRTTSKVDETVERAKKEGNLPLYGFHDPESFVKSIQKPRVIIMLVKAGSPVDQTIKTLSAYLEKGDCIVDGGNEWYENTERREKAVAENGFLYLGMGVSGGEEGARNGPSMMPGGSYEAYKNIEDIVLKVAAQVRDSGPCVTYIGKGGSGNFVKMVHNGIEYGDMQLIAEAYDVLKSVGKLSNEELHSVFSDWNKGELESFLVEITADIFGIKDDKGDGHLVDKVLDKTGMKGTGKWTVQQAAELSVPAPTIESSLDARFLSGLKDERVQAAKVFKAGGFGDILTDQKVDKKQLVDDVRKALYASKICSYAQGMNLIRAKSIEKGWGLKLGELARIWKGGCIIRAIFLDRIKQAYDRNAELANLLVDPEFAKEIIERQSAWRRVVCLAINSGISTPGMSASLAYFDSYRRERLPANLVQAQRDYFGAHTYERTDVEGSFHTEWFKIARQSKI

SEQ ID NO: 15442 - protein, 431 aa, Arabidopsis thaliana
MGLSLRVRRRGGSVSKKEIIPVTSCSEEVEITIPSQFQCPISYELMKDPVIIASGITYDRENIEKWFESGYQTCPVTNTVLTSLEQIPNHTIRRMIQGWCGSSLGGGIERIPTPRVPVTSHQISEICERLSAATRRGDYAACMEMVTKMKRLGKESERNRKCVKENGAGLVLCVCFDAFSENANASLLLEETVSVLTWTLPIGSEGQSKLTTTSSFNRLVELLKNGDQNAAFLIKELLELNVTHVHALTKINGVQEAFMKSINRDSTCVNSLISIHHMILTNQETVSRFLELDLVNITVEMLVDSENSVCEKALTVLNVICETKEGREKVRRNKLVIPILVKKILKISEKKDLVSVMWKVCKSGDGSEVEEALRLGAFKKLVVMLQVGCGEGTKEKVTELLKMMNKVMKMNGFVDRSYSSSIEFKHVKKPF

SEQ ID NO: 15443 - protein, 338 aa, Arabidopsis thaliana
MESKTTQNGSEVVELTEFEKTQKKYQDFIATLPKSKGWRPDEILTQYGGHWWQECLLEGLFHAKDHFEARPTDFLVCSYPKTGTTWLKALTYAIVNRSRYDDAANPLLKRNPHEFVPYVEIDFAFYPTVDVLQDRKNPLFSTHIPNGLLPDSIVNSGCKMVYIWRDPKDTFISMWTFLHKEKSQEGQLASLEDSFDMFCKGLSVYGPYLDHVLGYWKAYQENPDRILFLRYETMRANPLPFVKRLAEFMGYGFTDEEEENGVAEKVVKLCSFETLKNLEANKGDKEREDRPAVYANSAYFRKGKVGDWANYLTPEMAARIDGLLEEKFKDTGLLQHDN

SEQ ID NO: 15444 - protein, 392 aa, Arabidopsis thaliana
MEPPKEQQNTPEKSISDAPATISSAFPPSGCCTNCGGPTISEAPPPLASFPEMSPPPNYRPIRAPAINLPHNSQAIILSPVPHAEQVPVVSPPYHFQSPVKRIHSPDDIRRFHESASCKNFLGFVVSLSESIRGFKISDPCHISPTVAAIVSILETLLQWIDEIPPAQQSARYGNVSFRSWHERLRERGESLILEFLPEEFKESVIEIVPYFFDSFGNSSRIDYGTGHETNFAAWLYCLARMGIVKEEDYHGLVARVFVKYLELMRKLQMVYCLEPAGSHGVWGLDDYHFLPFIFGSSQLIDHKYMKPKSIHNDDILENFSSEYMYLSCIAFVKKVKKGLFAEHSPLLDDISGVPNWKKVNSGLLKMFRVEVLEKVPIMQHFLFGWLIKWEE

SEQ ID NO: 15445 - protein, 324 aa, Arabidopsis thaliana
MEEDRCSIKDDATQLIGNTPMVYLNNIVDGCVARIAAKLEMMEPCSSVKERIAYGMIKDAEDKGLITPGKSTLIEATSGNTGIGLAFIGAAKGYKVVLTMPSSMSLERKIILLALGAEVHLTDPSKGVQGIIDKAEEICSKTPDSIMLEQFKNPSNPQTHYRTTGPEIWRDSAGEVDILVAGVGTGGTLSGSGRFLKEKNKDFKVYGVEPTESAVISGGKPGTHLIQGIGAGLIPDNLDFNVLDEVIQVTSVEAIETAKLLALKEGLLVGISSGAAAAAAIKVAKRPENAGKLIVVIFPSGGERYLSTSLFESVRHEAENLPIQ

SEQ ID NO: 15446 - protein, 329 aa, Arabidopsis thaliana
MATNIGMMDSAYFVGRSEILAWINSTLQLNLSKVEEACSGAVHCQLMDSVHPGTVPMHKVNFDAKSEYEMIQNYKVLQDVFNKLKITKHIEVSKLVKGRPLDNLEFMQWMKKYCDSVNGGQHNYHALERREASKGGKEATKRAAATQQSGKSSSSSAPPRPSSSNGTRKHEPQSNNTGTHHSSTGNHHHSSKPSAKQSKPVPAYDEKITELKLYIDSLEKERDFYFSKLRDVEILCQNPDTEHLPLVGSIKRILYAADGEDVGAAETQTLSPIAEGSEERRNSVTESQKRKLIVNLDVDVAAITTLSPRQRLSDASDVKCSGSSPLLTC

SEQ ID NO: 15447 - protein, 436 aa, Arabidopsis thaliana
MAVLSSADRASNEKKVKSSYFDLPPMEMSVAFPQATPASTFPPCTSDYYHFNDLLTPEEQAIRKKVRECMEKEVAPIMTEYWEKAEFPFHITPKLGAMGVAGGSIKGYGCPGLSITANAIATAEIARVDASCSTFILVHSSLGMLTIALCGSEAQKEKYLPSLAQLNTVACWALTEPDNGSDASGLGTTATKVEGGWKINGQKRWIGNSTFADLLIIFARNTTTNQINGFIVKKDAPGLKATKIPNKIGLRMVQNGDILLQNVFVPDEDRLPGVNSFQDTSKVLAVSRVMVAWQPIGISMGIYDMCHRYLKERKQFGAPLAAFQLNQQKLVQMLGNVQAMFLMGWRLCKLYETGQMTPGQASLGKAWISSKARETASLGRELLGGNGILADFLVAKAFCDLEPIYTYEGTYDINTLVTGREVTGIASFKPATRSRL

SEQ ID NO: 15448 - protein, 372 aa, Arabidopsis thaliana
MENGEAKQSVPLLTPYKMGRFNLSHRVVLAPLTRQRSYGNVPQPHAAIYYSQRTTPGGFLITEATGVSDTAQGYQDTPGIWTKEHVEAWKPIVDAVHAKGGIFFCQIWHVGRVSNSGFQPNGKAPISCSDKPLMPQIRSNGIDEALFTPPRRLGIEEIPGIVNDFRLAARNAMEAGFDGVEIHRANGYLIDQFMKDTVNDRTDEYGGSLQNRCKFPLEIVDAVAKEIGPDRVGIRLSPFADYMESGDTNPGALGLYMAESLNKYGILYCHVIEARMKTMGEVHACPHTLMPMRKAFKGTFISAGGFTREDGNEAVSKGRTDLVAYGRWFLANPDLPKRFQVDAPLNKYDRPTFYTSDPVVGYTDYPFLESTA

SEQ ID NO: 15449 - protein, 299 aa, Arabidopsis thaliana
MIPYATIEEASIALSRNLTWLETLWFDYSATKSDYYLYCHNILFLFLIFSLVPLPLVLIESAQSTSDLFNRYKIQPKVKNSFSSMLKCYKDVMKMFILVVGPLQLVSYPSIQMIEIRSGLPLPSCMEIVAQFVVYFLVEDYTNYWVHRFFHCKWGYEKFHHIHHEYTAPIGYAAPYAHWAEVLLLGIPTFLGPAIAPGHMITFWLWIALRQIEAIETHSGYDFPWSLTKYIPFYGGAEYHDYHHYVGGQSQSNFASVFTYCDYIYGTDKGYRFQKKLLQQMKEKSKKSNKLVNGGEKFD

SEQ ID NO: 15450 - protein, 315 aa, Arabidopsis thaliana
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 15451 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGDCRHCKSEESNMCDLLRINTERGGMIHDGESRFSINGKPIYHFLGTSTFSEYTLVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 15452 - protein, 350 aa, Arabidopsis thaliana
MESETLTAKATITTTTLPSHDETKTESTEFKKNQKRYQDLISTFPHEKGWRPKEPLIEYGGYWWLPSLLEGCIHAQEFFQARPSDFLVCSYPKTGTTWLKALTFAIANRSRFDDSSNPLLKRNPHEFVPYIEIDFPFFPEVDVLKDKGNTLFSTHIPYELLPDSVVKSGCKMVYIWREPKDTFISMWTFLHKERTELGPVSNLEESFDMFCRGLSGYGPYLNHILAYWKAYQENPDRILFLKYETMRADPLPYVKSLAEFMGHGFTAEEEEKGVVEKVVNLCSFETLKNLEANKGEKDREDRPGVYANSAYFRKGKVGDWSNYLTPEMAARIDGLMEEKFKGTGLLEHGK

SEQ ID NO: 15453 - protein, 140 aa, Arabidopsis thaliana
MINPKKLMKLAKKWQQRAALKRKRISFQRSSITTSSQTAVEKGCFVVYTADKIRFSFPLSYLSNTIVQELLKISEEEFGLPTEGPITLPFDSAFLEYLINLIQRRMDEDTEKALLLSISSARSSFQPQQHCSATQQLLVF

SEQ ID NO: 15454 - protein, 320 aa, Arabidopsis thaliana
MWFFGSKGASGFSSRSTAEEVTHGVDGTGLTAIVTGASSGIGVETARVLSLRGVHVVMAVRNTDSGAKVKEDIVKQVPGAKLDVMELDLSSMQSVRKFASEYKSTGLPLNLLINNAGIMACPFMLSKDNIELQFATNHLGHFLLTKLLLDTMKSTSRESKREGRIVNLSSEAHRFSYPEGVRFDKINDKSSSMRAYGQSKLCNVLHANELTKQLKEDGVNITANSLHPGAIMTNLGRYFNPYLAVAVGAVAKYILKSVPQGAATTCYVALNPQVAGVSGEYFQDSNIAKPLPLVKDTELAKKVWDFSTKLTDSQSGESSS

SEQ ID NO: 15455 - protein, 394 aa, Arabidopsis thaliana
MDSSYLRISLSFLFWALLLSPAVSQSSSCSSQTFSGVKSYPHCLDLPDLKAILHYSYDASNTTLAVVFSAPPSKPGGWIAWAINPKSTGMAGSQALVASKDPSTGVASVTTLNIVSYSSLVPSKLSFDVWDVKAEEAANDGGALRIFAKVKVPADLAASGKVNQVWQVGPGVSNGRIQAHDFSGPNLNSVGSLDLTGTTPGVPVSGGGGAGNSRIHKRNIHGILNAVSWGLLFPIGAMIARYMRIFESADPAWFYLHVSCQFSAYAIGVAGWATGLKLGSESKGIQYNTHRNIGISLFSIATLQMFAMLLRPRKDHKFRFVWNIYHHGVGYSILILGIINVFKGLSILNPKHTYKTAYIAVIGTLGGITLLLEVVTWVIVLKRKSAKSTKPLKA

SEQ ID NO: 15456 - protein, 326 aa, Arabidopsis thaliana
MANSGEGKVVCVTGASGYIASWLVKFLLSRGYTVKASVRDPSDPKKTQHLVSLEGAKERLHLFKADLLEQGSFDSAIDGCHGVFHTASPFFNDAKDPQAELIDPAVKGTLNVLNSCAKASSVKRVVVTSSMAAVGYNGKPRTPDVTVDETWFSDPELCEASKMWYVLSKTLAEDAAWKLAKEKGLDIVTINPAMVIGPLLQPTLNTSAAAILNLINGAKTFPNLSFGWVNVKDVANAHIQTFEVPSANGRYCLVERVVHHSEIVNILRELYPNLPLPERCVDENPYVPTYQVSKDKTRSLGIDYIPLKVSIKETVESLKEKGFAQF

SEQ ID NO: 15457 - protein, 281 aa, Arabidopsis thaliana
  misc_feature (114)..(114): Xaa can be any naturally occurring amino acid
MAADNAYLMQFVDETSFYNRIVLSHLLPANLWEPLPHFLQTWLRNYLAGTLLYFISGFLWCFYIYYLKINVYLPKDAIPTIKAMRLQMFVAMKAMPWYTLLPTVSESMIERGWXKCFASIGEFGWILYFVYIAIYLVFVEFGIYWMHRELHDIKPLYKYLHATHHIYNKQNTLSPFAGLAFHPVDGILQAVPHVIALFIVPIHFTTHIGLLFMEAIWTANIHDCIHGNIWPVMGAGYHTIHHTTYKHNYGHYTIWMDWMFGSLRDPLLEEDDNKDSFKKAE

SEQ ID NO: 15458 - protein, 512 aa, Arabidopsis thaliana
MSPLISFTPTSLDFTFFAIIISGFVFIITRWNSNSKKRLNLPPGPPGWPVVGNLFQFARSGKPFFEYAEDLKKTYGPIFTLRMGTRTMIILSDATLVHEALIQRGALFASRPAENPTRTIFSCNKFTVNAAKYGPVWRSLRRNMVQNMLSSTRLKEFGKLRQSAMDKLIERIKSEARDNDGLIWVLKNARFAAFCILLEMCFGIEMDEETIEKMDDILKTVLMTVDPRIDDYLPILAPFFSKERKRALEVRREQVDYVVGVIERRRRAIQNPGSDKTASSFSYLDTLFDLKIEGRKTTPSNEELVTLCSEFLNGGTDTTGTAIEWGIAQLIANPEIQSRLYDEIKSTVGDDRRVDEKDVDKMVFLQAFVKELLRKHPPTYFSLTHAVMETTTLAGYDIPAGVNVEVYLPGISEDPRIWNNPKKFDPDRFMLGKEDADITGISGVKMIPFGVGRRICPGLAMATVHVHLMLARMVQEFEWCAHPPGSEIDFAGKLEFTVVMKNPLRAMVKPRI

SEQ ID NO: 15459 - protein, 1016 aa, Escherichia coli
  misc_feature (196)..(196): Xaa can be any naturally occurring amino acid
MQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARVXHGPTVASLAPTFGRGAMTNHWVDIKNANLVVVMGGNAAEAHPVGFRWAMEAKIHNRREADCDRSCFTRTAAVADYYAPIRSGTDIAFLSGVLLYLLNNEKFNREYTEAYTNASLIVREDYGFEDGLFTGYDAEKRKYDKSSWTYELDGKRLRKRDTTLQHPRCVWNLLKQHVSRYTPDVVENICGTPKDAFLKVCEYIAETSAHDKTASFLYALGWTQHSVGAQNIRTMAMIQLLLGNMGMAGGGVNALRGHSNIQGLTDLGLLSQSLPGYMTLPSEKQTDLQTYLTANTPKPLLEGQVNYWGNYPKFFVSMMKAFFGDKATAENSWGFDWLPKWDKGYDVLQYFEMMKEGKVNGYICQGFNPVASFPNKNKVIGCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPSSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 15460 - protein, 448 aa, Arabidopsis thaliana
MCSSLVPHGKRLVQFQKGRDFSVSVKLLQNVFSVFSNSFSSVATAADVSFRDSRKASKLAESISMKVSFENKGNPDTVLNLLRSHEFTDSQISSIISDYPTLLVADAENSLGPKLLLMQSRGASSSELTEIVSKVPKILGMKGDKSIGRYYDIVKEIIEADKSSKFEKLCHSLPEGSKQENKIRNVLVLRDLGVPQRLLFSLLFSNHHVCCGKEKFEESLNKVVGMGFDPTTPKFVEALCIVYGLSDKRLEENFNVYKRFGLTVNDVWELFKKCPAFLGYSENRIIQTFEALKRCGLCEDEVLSVFKKNPLCLRASEQQILNSMETFIGLGFSRDEFVMMVKCLPQCIGYSAEMVKKKTEFVVKKMNWPLKVITLFPQVLGYSMEKRTVPRCNVIKALMSKGLLGSELPPMASVLACTDQTFLKRYVVEHDEKLVLELMSIFNQDRVS

SEQ ID NO: 15461 - protein, 268 aa, Aeromonas hydrophila
MNNFLKVSLLAAAVAVSLTACQKDEKTAANTAEVKAEASKPAEAPKAEAKSFEEQSGYAIGLSMGRYIANTLERQQELGIKLDNSVILKGVTDGLGKEAKMTDEEIQKVLQQYDAKINELTKAKADKDAVENQKKGEEYLAANAKKEGVKSTESGLQYQVEKMGTGAKPKATDIVKVHYTGTLTDGTKFDSSVDRGEPATFPLNQVIPGWTEGVQLMPVGSKFKFFLPSKLAYGEHGAGSIPANAVLVFDVELLAIEKPAADGDNAKK

SEQ ID NO: 15462 - protein, 142 aa, Cicer arietinum
AQLLGSIVASLLLVFATGLSVPAFSLSAGVGVGPALVLEIVLTFGLVYTVYATAVDPKKGNIGIIAPIAIGFIVGANILVGGAFTGASMNPAVSFGPAVVSWSWSNHWIYWAGPLIGGGLAGLIYEVVFISHTHEQLPTTDY

SEQ ID NO: 15463 - protein, 346 aa, Rhodococcus ruber
MKALQYTEIGSEPVVVDVPTPAPGPGEILLKVTAAGLCHSDIFVMDMPAEQYIYGLPLTLGHEGVGTVAELGAGVTGFETGDAVAVYGPWGCGACHACARGRENYCTRAAELGITPPGLGSPGSMAEYMIVDSARHLVPIGDLDPVAAVPLTDAGLTPYHAISRVLPLLGPGSTAVVIGVGGLGHVGIQILRAVSAARVIAVDLDDDRLALAREVGADAAVKSGAGAADAIRELTGGEGATAVFDFVGAQSTIDTAQQVVAIDGHISVVGIHAGAHAKVGFFMIPFGASVVTPYWGTRSELMDVVDLARAGRLDIHTETFTLDEGPTAYRRLREGSIRGRGVVVPG

SEQ ID NO: 15464 - protein, 219 aa, Arabidopsis thaliana
  misc_feature (199)..(199): Xaa can be any naturally occurring amino acid
MALPLSGTRHLTRALLSNVTLMAPPRIPSSVHYGGSRLGCSTRFFSIRCGANRSGSTYSPLNSGSNFSDRPPTEMAPLFPGCDYEHWLIVMDKPGGEGATKQQMIDCYIQTLAKVVGSEEEAKKRIYNVSCERYLGFGCEIDEETSTKLEGLPGVLFVLPDSYVDPENKDYGAELFVNGEIVQRSPERQRRVEPQPQRXQDRPRYNDRTRYSRRRENTR

SEQ ID NO: 15465 - protein, 181 aa, Arabidopsis thaliana
MPPTNNYRISGEPPSTTPSPPPPKPKTRILSLFLVGVIMFSIFFLFLVLIGIASVLILPLLLSSLHRHHRRRRRNRRQESSDGLSSRFVKKLPQFKFSEPSTYTRYESDCVVCFDGFRQGQWCRNLPGCGHVFHRKCVDTWLLKASTCPICRARVRLWEEDPQEGELWRCFGHRRSSLLDL

SEQ ID NO: 15466 - protein, 142 aa, Arabidopsis thaliana
MINAKKLMKMAKKWQQRAALHRKRISFQRSNVFTSSSSTVEKGCFVVYTADKIRFAFPISYLSNSIVQELLKISEEEFCLPTEGPITLPFDSVFLEYFIKLIQRRMDGDTEKALLMSISSAKCSLQCSLLQQEQSTQQLLVL

SEQ ID NO: 15467 - protein, 234 aa, Arabidopsis thaliana
MSFAEEFEANLVSLAHVLQKKYALLRDLDKSLQENQRQNEQRCEKEIEDIRRGRAGNITPNTSLTKFSEEALDEQKHSVRIADEKVTLAMQAYDLVDMHVQQLDQYMKKSDEVIRKEKEAAAATLELENNGKAGNAGEGGRGGRKKTRLATAASTAAASTGMTSSNMDLDLPVDPNEPTYCICNQVSFGEMVACDNNACKIEWFHFGCVGLKEQPKGKWYCPECATVKKSRKGR

SEQ ID NO: 15468 - protein, 503 aa, Arabidopsis thaliana
MSTIEDGFPADKLFAQGYSYTYDDVIFLPHFIDFSTDAVSLSTRLSRRVPLSIPCVSSPMDTVSESHMAAAMASLGGIGIVHYNCDIAAQASIIRQAKSLKHPIASDAGVKLPEYEITSVDAFGPSSFVFVEQTGTMTTPKLLGYVTKSQWKRMNYEQREMKIYDYMKSCDSSDYCVPWDIDFEKLEFVLEDKQKGFVVLERDGETVNVVTKDDIQRVKGYPKSGPGTVGPDGEWMVGAAIGTRESDKERLEHLVNAGVNAVVLDSSQGNSIYQLEMIKYVKKTYPELDVIGGNVVTMYQAQNLIQVGVDGLRVGMGSGSICTTQEVCAVGRGQATAVYKVCSIAARSGIPVIADGGISNSGHIVKALVLGASTVMMGSFLAGSTEAPGGYEYTNGKRIKKYRGMGSLEAMTKGSDQRYLGDKTKLKIAQGVVGAVADKGSVLKLIPYTMHAVKQGFQDLGASSLQSAHGLLRSNILRLEARTGAAQVEGGVHGLVSYEKKSF

SEQ ID NO: 15469 - protein, 442 aa, Arabidopsis thaliana
MVTLTSSSSTPNVSFDFMMNNNNNSNNLYGPFSSSSTSFSYLTSKEDALTQKNLMSGITNDVLGINKKASEDLEISVFGAEKYFNGDMDSDHSPRLVSPLPDPEVPIERIFVGPKQSSKNSSETPSLRSESSWNSQSLLLQSKYVEKKKNIKNNSSCNSYFQEKDMSSNHKVSNKKSFLATLGCRCVCSNWSSVDVVDDKRRSSGLKKIKTQLSFSGDLSSEMKIHQQQQEAMLEQRKSLEIFGSPLIEKRIIQKKFPWEYSSSAKKEEHGFSVKYEEEEDGSVSDVSTDLFEIESLTGKAKPFLARQGSSDPDSPDGYAPSEVSIQWSVVTASVADFSVMSECATSPVKKNRSFQIPRIPIMAKSNREIAPQRRKSSSSGLLMGCKSHKSVRVSGDSYTSMNRTPSYVPRFPVEANPTSTETRRRISSSSVSHTQSPFLYT

SEQ ID NO: 15470 - protein, 236 aa, Arabidopsis thaliana
MGSHEQSPENNGSSTVSKKVADIWQRMNEGVPNKRVNFVSTALPAKNSANSNWKSYLGVNVKKKDTSVSDVQKSVLNHSCSEEAKSIAAAALAAVRNATVTAAAASSRGKIEITEVKDFAGQEIEVKRLVEADSKEALERGNKGSSSSSAAPSAVDAVLEHIKKKQKLSVLDKTKKDWGEYKEEHKGVEDELDKYKKSSDQYLDKVGFLERADYRQFEKERDARLALQSKRRHDDV

SEQ ID NO: 15471 - protein, 188 aa, Arabidopsis thaliana
MALEKHIEKVLFSDEVIAHRVNQLGIDITSDFSGDSEETPIFVGVATGACLFLADLVRRIDLPIAIDFIRAESYGSGTVSSGVPRVSFDLKLDITNKHVVLVEDIVDTGNTLSCLIEHMKAKKASSVSVCTLLDKPSRRKVHYKLVGKGKFYSGFECPDEFVVGYGMDFAEQYRNLSYIGVLKPEYYM

SEQ ID NO: 15472 - protein, 35 aa, Arabidopsis thaliana
MFDDQDLGFFANFLGIFIFIMVIAYHFVVAEPKFE

SEQ ID NO: 15473 - protein, 37 aa, Arabidopsis thaliana
MIDDQDLGFIANFLGIFIFALVIAYHYVTADPKYEAT

SEQ ID NO: 15474 - protein, 384 aa, Arabidopsis thaliana
MFSIHEGKPIRCKAAVSRKPGEALVIEEIHVDPPQAYEVRIKIICTSLCHTDVSFSKIDSGPLARFPRILGHEAVGVIESIGEHVNGFQQGDIVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTSFINPTLCGEKKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 15475 - protein, 334 aa, Arabidopsis thaliana
MATATSHQSVVSFASLRSSPSSTISQCGFKIDSSLSFTSKKTNFCKIKAMASSVSFNNTLLSPSKTIPDNSQKKSNEAALILIRHGESLWNEKNLFTGCVDVPLTEKGVEEAIEAGKRISNIPVDVIFTSSLIRAQMTAMLAMIQHRRKKVPIILHDESEQAKTWSQVFSDETKNQSIPVIPAWQLNERMYGELQGLNKQETAERYGKEQVHEWRRSYDIPPPKGESLEMCAERAVAYFQDNIEPKLAAGKNVMIAAHGNSLRSIIMYLDKLTCQEVISLELSTGIPLLYIFKEGKFMKRGSPVGPTEAGVYAYTKRLAQYRQKLEDDSEVLCA

SEQ ID NO: 15476 - protein, 1087 aa, Neurospora crassa
MKFAKELEQEAVPEWRVKYLNYKLGKKLIKSVTRAIQRASTTPNLARRPDSLHAAPAALFHHLHHKRTPTQHRWSDTTPGSHEGSPGADQLQSGGPELDRTPTKNNRNSKGSIEARGERSGLTTLPDNEVQYGSILPPSRSSDRTEFELPAPAMKIASRTGGRRDSIVASPTSPVSNRFGPRRTKSMMAGADGQSTATESSVELPPSATIAQRSPHRLSRVLSNSSHLSRTMSNRDSTALQNLESVRTAETEFFSFLDNELDKIETFYKQKEDQATKRLAALREQLHEMRNRRTTEIADAKQRKEMERGSGSKSHPGDGGGSNGKDSGTDWIGPLRTKFMKPGPNSKALQKMTETPVMAPQKPEEGRDYVRRPPNKDDVSYRVAKRKLKLALQEYYRGLELLKSYALLNRTAFRKLNKKYDKAVNARPTYRYMNEKVNKTWFVNSDVVDGHIRTVEDLYARYFEKGNHKVAAGKLRNILRRPGDASGSAFRSGLLIGFGAVFAVQGLIYGSELLFQDDHTLKENTSYLLQLYGGYFLMILLFALFTLACRIWTLNKINYPFIFELDTRHNLDWKQVAEFPSFFFALLGVFLWLNFSRFGHWEEMYLYYPALLIGLSLLILFFPAPIFYHRARRWFLYSHYRLLLAGLYPVEFRDFFLGDIWCSLTYSAANIPMFFCLYANEWDQPGMCNSSHSRLQGFFNALPPIWRALQCIRRYHDTKNVFPHLVNCGKYIMTITTAVILSLYRLNRSQPILAAYITFATINACYTTIWDLFMDFSLLQKNVRYPFLRDITALKSKWIYYVIMVVDPLLRFNWIFYAIFTHDTQHSTIVSFFVAMAEVIRRGLWLILRVENEHCANVSQYKASRDTPLPYQLDQFVERPSQETSAGELEAETGTTTGAVQQERRGTISSMAASIRERIRGSVGAGATSPWAASPSPATGAAHPEEEGAISPHAESGAISGEGATGTGTGFSLSGGGTFRRRHVESMGKKSILQVMAEAHKQDFEKRRPSEAVREQGLGRGGSSSLVDEDDEEDDDDDPDLRSEVEDDDEDDDDSDRRSVQQDRMEAREAEMLVKRARGEPDDSVSE

SEQ ID NO: 15477 - protein, 423 aa, Neurospora crassa
MSAKLKPAARVAGNRQDVWTIVNEAAAASPRQPIVNMGQGFFGYNPPEFILNAAKKALDRVECNQYSPTRGRPRLRKALSKAYAPHWGRELDPETEITITTGANEGMLSAFMAFIEPGDEVIVFEPFFDQYISNIEMPGGKIVYVPMHPPKEGHIKTLSASEWTIDFDELERAVTPRTKMLVINTPHNPVGKVFSRAELERIAELCVKNQIIILSDEVYDRLFYTPFTRMATLSPEVEKITLTVGSAGKNFYATGWRVGWLMGPAELIQYVAAAHTRICYSSVSPLQEACAIGFEEADQQGFWTQCIEDMQNKMSRFNAIWDELGLPYSIPEGGYFVMANLNKVEIPEGYPFPPHVAERPRDFKLAWFLIQELGVAAIPPSEFYTDVNAHIVEDWLRFAVCKPDEVLEDAKERLRGLKKFIKQ

SEQ ID NO: 15478 - protein, 325 aa, Neurospora crassa
MTKVLLTGGSGFIAAHILEQLLAKGHTVVTTVRSEDKAQNIREAYPDKASSGELKVVIVPDIAKLDAFDEVVKEPGLEVVLHTASPFHFKFTPKEDPKTELIDPAVNGTTGILKAIARSAPTVRRVVITSSFAAILDENKITDPNHTFSEASWNPVTIDDIHRNPATAYRASKTLAEKAAWDFVRDPANNVKFDLATINPPMVFGPVVHHLASLSSINTSNERIVDLLQGKWKEGVPSTGAATIWIDVRDVARAHIRAGLEVPEAGGKRLFTTAGTFSNSEIAEKVRKNFPEYGDKLPEERRSRAASCRRMISGSRSITRRRMSC

SEQ ID NO: 15479 - protein, 142 aa, Sorghum bicolor
NSLHSAFSTYGEVLESKIILDRETQRSRGFGFVTFSTEEAMRSAIEGMNGKELDGRNITVNEAQSRGGRGGGGGGGYGGGRGGGGGYGRRDGGGGGYGGGGGGYGGGRGGYGGGGYGGGGGGYGGGSRGGGGYGNSDGNWRN

SEQ ID NO: 15480 - protein, 389 aa, Butyrivibrio fibrisolvens
MDFTLDKKHEMARQLFRDFAVNEVKPLAQEIDETEQFPRETVEKMQKFGFMGIPVPKEYGGQGCDVLTYIIAVEELSKVCGTTGVILSAHTSLCCDPILTYGTEEQKQKYLVPLAKGEKLGAFALTEPGAGTDAQGAQTKAVEDGDSWILNGSKCFITNGKEADVYIIFAVTDIVEDAKGRKSKKFSAFIVEKGTPGFTFGTKEKKMGIRASSTYELIFQDCRIPKENILGPRGKGFGIAMHTLDGGRIGIAAQALGIGEGSIDATIDFVKERKQFGRAISAFQNTQFNLADMKTRMDAAKYLVYKAACTKDQYMEDHKTSYSIEAAEAKLFAAEAAMAVTTKAVQLHGGYGYTREYDVERMMRDAKITEIYEGTSEVQRMVISGSMLK

SEQ ID NO: 15481 - protein, 168 aa, Sorghum bicolor
MAAADVEYRCFVGGLAWATNNETLEQAFANFGQVIDSKVITDRETGRSRGFGFVTFSSEQSMLDAIENMNGKELDGRNITVNQAQSRGGGGGGGGYGGGGGGYGGREGGGYGGGGGGYGGRREGGGGYGGGGYGGGGGGYGGREGGGGYGGGGGYGGNRGDSGGNWRN

SEQ ID NO: 15482 - protein, 466 aa, Kolkwitzia amabilis
SAGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRGACKWSPELAAACEVWKEIKFEFEAMDTL

SEQ ID NO: 15483 - protein, 262 aa, Arabidopsis thaliana
STSSSSSPSSFKRKVSTFLPICVALVVIIEIGFLCRLDNASLVDTLTHFFTKSSSDLKVGSGIEKCQEWLERVDSVTYSRDFTKDPIFISGSNKDFKSCSVDCVMGFTSDKKPDAAFGLSHQPGTLSIIRSMESAQYYQENNLAQARRKGYDIVMTTSLSSDVPVGYFSWAEYDIMAPVQPKTEEALAAAFISNCAARNFRLQALEALMKTNVKIDSYGGCHRNRDGSVEKVEALKHYKFSLAFENTNEEDYVTEKFFQSLV

SEQ ID NO: 15484 - protein, 196 aa, Arabidopsis thaliana
QEWLERVDSVTYSRDFTKDPIFISGSNKDFKSCSVDCVMGFTSDKKPDAAFGLSHQPGTLSIIRSMESAQYYQENNLAQARRKGYDIVMTTSLSSDVPVGYFSWAEYDIMAPVQPKTEKALAAAFISNCAARNFRLQALEALMKTNVKIDSYGGCHRNRDGSVEKVEALKHYKFSLAFENTNEEDYVTEKFFQSLV

SEQ ID NO: 15485 - protein, 152 aa, Musa acuminata
MAAIASVKARRIFDSRGNPTVEVDVCLTDGTCARAAVPSGASTGVYEALELRDGGSDYLGKGVLKAVANVNTIIGPALIGKDPTEQVEIDNFMVQHLDGTSNEWGWCKQKLGANAILAVSLAVCKAGASVKKIPLYQHIANIAGNKNLVLPV

SEQ ID NO: 15486 - protein, 483 aa, Ipomoea tiliacea
MSPQTETKASVGFKAGVKDYKLTYYTPEYQTKDTDILAAFRVTPQPGVPPEEAGAAVAAESSTGTWTTVWTDGLTSLDRYKGRCYRIERVIGEKDQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEQDRSRGIYFTQDWVSLPGVLPVASGGIHVWHMPALTEIFGDDSVLQFGGGTLGHPWGNAPGAVANRVALEACVQARNEGRDLAREGNEIIREACKWSPELSAACEVWKEIRFEFKPVDTLDPGQLKYK

SEQ ID NO: 15487 - protein, 475 aa, Ipomoea alba
ETKASVGFKAGVKDYKLTYYTPEYETKDTDILAAFRVTPQPGVPPEEAGAAVAAESSTGTWTTVWTDGLTSLDRYKGRCYRIERVIGEKDQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEQDRSRGIYFTQDWVSLPGVLPVASGGIHVWHMPALTEIFGDDSVLQFGGGTLGHPWGNAPGAVANRVALEACVQARNEGRDLAREGNEIIRQACKWSPELAAACEVWKEIRFEFKPVDTLDPDGN

SEQ ID NO: 15488 - protein, 481 aa, Turbina corymbosa
MSPQTETKASVGFKAGVKDYKLTYYTPEYETKDTDILAAFRVTPQPGVPPEEAGAAVAAESSTGTWTTVWTDGLTSLDRYKGRCYRIERVIGEKDQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEQDRSRGIYFTQDWVSLPGVLPVASGGIHVWHMPALTEIFGDDSVLQFGGGTLGHPWGNAPGAVANRVALEACVQARNEGRDLAREGNDIIRQACKWSPELAAACEVWKEIRFEFKPVDTLDPDEKK

SEQ ID NO: 15489 - protein, 481 aa, Stictocardia incomta
  misc_feature (475)..(475): Xaa can be any naturally occurring amino acid
  misc_feature (479)..(479): Xaa can be any naturally occurring amino acid
MSPQTETKASVGFKAGVKDYKLTYYTPEYETKDTDILAAFRVTPQPGVPPEEAGAAVAAESSTGTWTTVWTDGLTSLDRYKGRCYRIERVVGEKDQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEQDRSRGIYFTQDWVSLPGVLPVASGGIHVWHMPALTEIFGDDSVLQFGGGTLGHPWGNAPGAVANRVALEACVQARNEGRDLAREGNEIIRQACKWSPELAAACEVWKEIRFEFKPVDTXDLEXKK

SEQ ID NO: 15490 - protein, 481 aa, Turbina oblongata
MSPQTETKASVGFKAGVKDYKLTYYTPEYETKDTDILAAFRVTPQPGVPPEEAGAAVAAESSTGTWTTVWTDGLTSLDRYKGRCYRIERVIGEKDQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEQDRSRGIYFTQDWVSLPGVLPVASGGIHVWHMPALTEIFGDDSVLQFGGGTLGHPWGNAPGAVANRVALEACVQARNEGRDLAREGNEIIRQACKWSPELAAACEVWKEIRFEFKPVDTLDPDEIK

SEQ ID NO: 15491 - protein, 481 aa, Merremia dissecta
MSPQTETKASVGFKAGVKDYKLTYYTPEYETKDTDILAAFRVTPQPGVPPEEAGAAVAAESSTGTWTTVWTDGLTSLDRYKGRCYRIERVIGEKDQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVDQDRSRGIYFTQDWVSLPGVLPVASGGIHVWHMPALTEIFGDDSVLQFGGGTLGHPWGNAPGAVANRVALEACVQARNEGRDLAREGNEIIRQACKWSPELAAACEVWKEIRFEFKPVDTLDPDEQK

SEQ ID NO: 15492 - protein, 355 aa, Trichoderma atroviride
MSRSTAPNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPEDEPTAPPIPEEFFDFDKHKDTLSKEQLKQLIYQEIMR

SEQ ID NO: 15493 - protein, 330 aa, Micromonospora echinospora
MSSLHVRLGRTGLRVSRVAIGTVNFGGRVDEADAHRLLDHAVAQGVNLVDTADIYGWRVHRGWTEEMIGRWLAKDPARRDEVVLATKVGNPMGDGPNARGLSARHVVAACEASLRRLQTDAIDLYQMHHVDREVGWDEIWQAMEQLVRQGKVRYVGSSNFAGWDLVSAQEAARRHRLLGLASEQCVYNLVSRYVELEVLPAAVAEGIGVLVWSPLHGGLLGGVLRKLADGTAVKSAQGRAAEAVERHRATLAAYETFCAEAGRDPAEVGMAWVLHRPAVTAAVVGPRTPEHLDGALRALHRPLSAAELARLDELFPPLGRGGAAPDAWMS

SEQ ID NO: 15494 - protein, 500 aa, Atriplex centralasiatica
MAFPMPVRQLFIDGEWREPLLKNRIPIINPSTEEIIGDIPAATAEDVEVAVVAARKAFKRNKGRDWAATSGAHRARYLRAIAAKITERKDHFVKLETLDSGKPLDEAVLDIDDVATCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDVDKIAFTGSSATGSKIMASAAQLVKPVTLELGGKSPVIMFEDIDIETAVEWTLFGVFWTNGQICSATSRLLVHESIAAEFVDRMVKWTKNIKISDPFEEGCRLGPVISKGQYDKIMNFISTAKSEGATILCGGSRPEHLKKGYYIEPTIITDITTSMQIWKEEVFGPVICVKTFSTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 15495 - protein, 500 aa, Atriplex centralasiatica
MAFPMPVRQLFIDGEWREPLLKNRIPIINPSTEEIIGDIPAATAEDVEVAVVAARKAFKRNKGRDWAATSGAHRARYLRAIAAKITERKDHFVKLETLDSGKPLDEAVLDIDDVATCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDVDKIAFTGSSATGSKIMASAAQLVKPVTLELGGKSPVIMFEDIETVVAVEWTLFGVFWTNGQICSATSRLLVHESIAAEFVDRMVKWTKNIKISDPFEEGCRLGPVISKGQYDKIMNFISTAKSEGATILCGGSRPEHLKKGYYIEPTIITDITTSMQIWKEEVFGPVICVKTFSTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 15496 - protein, 487 aa, Blumeria graminis
MSQVDVENITVEALPKLLETDSRVKVAGIDADGILRGKVISKDKFLGVAADGFGFCSVLFGWDMHDRMYSKELKICSARNGCNDILARPDLSTFRRIPWEDNIPFFLVTFIDPVTVKPIIACPRGLLKCTINNLKTQGIQAMAGVEIEFSQFKLPSEISGAQSKNVSIASFLKDHNINALEPLTDGMFGYSLTRMAQNKEYFYSIFDTCEKFRCGIESWHTESGPGVFEAALKFSEIQQMADKATLFKYLVKSIAIPYGITPCFMAKPRQGMLGNSGHIHISLIDNNGNNLFARAARDEGAKYQDIAHLSDLGRQFLAGILDGLTDIMPMLAPNINSYKRLVENFWAPVTVSWGLEHRAASIRVIAPPTSKSGATRIEVRVPGADINPSYALAAILALGWRGVEKKLEISIPPLQTGLNVGETSDSGIRLAKSLREATEIFMRPESIAREVFGNDFVDHYGGTRENEYRLWDEAVTDWETQRYIETV

SEQ ID NO: 15497 - protein, 382 aa, Solanum tuberosum
MASEVHAVVDAHSPPKTPTVCVTGAAGFIGSWLVMRLLERGYNVHATVRDPENQKKVKHLLELPKADTNLTLWKADLAVEGSFDEAIKGCQGVFHVATPMDFESKDPENEVIQPTVRGMLSIIESCAKAKTVKRLVFTSSAGTLDVQEDQKLFYDETSWSDLDFIYAKKMTGWMYFVSKILAEKAAMEEAKKNNINFISIIPPLVVGPFITPTFPPSLITALSLITGNEAHYGIIKQGQYVHLDDLCEAHIFLYEHPKAEGRFICSSHHAIIYDVAKMVRQKWPEYYVPTEFKGIDKDLPIVSFSSKKLMDMGFQFKYTLEDMYKGAIETCRQKQLLPFHTRSTAANGKDKEAIPIFTENYSSGKENAPVANCTGKFTNGEI

SEQ ID NO: 15498 - protein, 214 aa, Ustilago maydis
MAPAAICRKLVIVGDGACGKTSLLCVFAIGEFPQEYEPTIFENYVAEIRLDGKPVQLALWDTAGQEEYERLRPLSYSQAHVILIAFAIDTPDSLENVQVKWMEEVRQICGPSVPVLLVGCKKDLRENAIAKGKPVQGHYVKRQQAKLVAAQIGARSYHECSSLNNQGVDAVFEAATRAAMLVRNSGASSGGAISQSKTKEALHNDAGSCKCIVL

SEQ ID NO: 15499 - protein, 193 aa, Ustilago maydis
MQTIKCVVVGDGAVGKTCLLISYTTNAFPGEYIPTVFDNYSANVMVDGKPVSLGLWDTAGQEDYDRLRPLSYPQTDVFLVCFSLVSPPSFENVRTKWWPEVSHHAPNIPTILVGTKLDLREDPETIAKLRDRRMQPITYAQGNQMARDIHATKYLECSALTQKGLKGVFDEAIRSVLAPAPVQSKKKNNCLIL

SEQ ID NO: 15500 - protein, 478 aa, Arisaema tortuosum
PQTETKASAGFKAGVKDYKLTYYTPDYETKDTDILAAFRVTPQPGVPPEEAGAAVAAESSTGTWTTVWTDGLTSLDRYKGRCYHIEAVPGEETQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQSETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREMTLGFVDLLRDDYIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEIWKEIKFEFEPVDKLDVKAK

SEQ ID NO: 15501 - protein, 477 aa, Filarum manserichense
PQTETKASVGFKAGVKDYKLTYYTPDYETKDTDILAAFRVTPQPGVPPEEAGAAVAAESSTGTWTTVWTDGLTSLDRYKGRCYHIEAVVGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSMPGVIPVASGGIHVWHMPALTEIFGDDSVLQFGGGTLGHPWGNAPGAVANRVALEACVQARNEGRDLAREGNEIIREASKWSPELAAACEVWKEIKFEFEAVDKLDGQK

SEQ ID NO: 15502 - protein, 470 aa, Typhonium venosum
AGFKAGVKDYKLTYYTPDYETKDTDILAAFRVTPQPGVPPEEAGAAVAAESSTGTWTTVWTDGLTSLDRYKGRCYHIEAVPGEENQYIAYVAYPLDLFEEGSVTNMFTSIVGNVFGFKALRALRLEDLRIPPTYSKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMIKRAVFARELGAPIVMHDYLTGGFTANTSLAHYCRDNGLLLHIHRAMHAVIDRQKNHGMHFRVLAKALRMSGGDHIHAGTVVGKLEGEREMTLGFVDLLRDDYIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEVWKAIKFEFEPVDKLDVKAK

SEQ ID NO: 15503 - protein, 397 aa, Brassica oleracea
MGSYLGIYTILVLCLLGYSANAEVFTVGGPPGSDITAALLKAFTSACQAPAPSQVLIPKGDFKLGEIAMTGPCKSPVEFTLQGNVKADGGSTQGKDRWVVFEKINGFKLNGGGTFDGEGNAAWKANNCHKTFECKKLPISVRFDFVDNAEIKDVTSLDAKNFHFNVISGKNMTFDNIKIIAPAESPNTDGIHLGRCEGVKILNTKISTGDDCISVGDGMKNLLIEKVVCGPGHGISVGSLGRYGWEQDVNDIKVINCTLEGTDNGLRIKTWPSAACTTTAAGIHFENIILNKVSNPILIDQEYCPWNQCNKSKPSTIKLVDITFRNIRGTSGNKDAVKLLCSKGHPCENVEIGDINIEYTGADGPPTFECTNVTPKLVGTQNPKACVGPVVKAPGQA

SEQ ID NO: 15504 - protein, 188 aa, Oryza sativa (japonica cultivar-group)
MIIHLRTGGMYGRVEKEHLTGSVLVQKDRSRMMGDFLSRVLLLAFGYAYPAYECYKTVELNKPEIEKLIFWCQYWILVALLTVLERFGDFAISWLPLYSEAKLMFFIYLWCPRTKGTSYVYETFFRPYISQYENDIDCSILDLRVRAGDMLVVYWQKVAIIGQTTFFNILKYASAQSPAHSSRSRSTQ

SEQ ID NO: 15505 - protein, 501 aa, Aeromonas hydrophila
MRCLYLHGLITCWQEVKINMAVIPVIMAGGSGSRLWPMSREHFPKQFLNLYGNNSMLQETVNRLAEIECTAPLILCNEKHRFIVAEQLRQLDILANNIILEPVGRNTAPAIALAAIQSLKDVDDTHDPILLVLAADHLIKDQQAFTNAVNSAIPFAESGKLVTFGIVPNTPETGYGYIHRGSELKSFLNEEKAYGVNQFVEKPNLAVAKGYLASGEYYWNSGMFMFSARRYLAELKLSRPDIYQACLASMNDIRSDLDFIRINNDEFKQCPSDSIDYAIMEKTSDAVVIPMDAGWNDVGSWSSLWDISDKDACGNVSRGDVILIESHNNYVSAESILVSTIGVDNLVIIQTKDAILVSNKDKVQDVKSIVEELKRCGRKEYKTHREVYRPWGQYDSIDDGNGYQVKKILIRPGERLSTQMHHHRAEHWIVVSGTAKVTNAEREFLITENESTFIPIGAIHSLENPGKVDLELIEIRSGKYLEEDDIIRFSDKYGRVDGGEK

SEQ ID NO: 15506 - protein, 322 aa, Buchnera aphidicola str. Sg (Schizaphis graminum)
MNKIYEDNSFTIGNTPLVRLNNIGNGNILAKIESRNPSFSVKCRIGANMIWDAEKKGRLNKNIEIIEATSGNTGIALAYVAAARNYSLTLIMPDSMSIERRKLLKSLGAHLILTNGKHGMKGAISKANEIVSLNTKRYLLLKQFENPANPEIHQKTTGPEIWKDTKGNIDILISGVGTGGTITGITKYIKIKEGKKDLISVAVEPLESPVITQFLSGKKIKPGLHKIQGIGAGFIPKNLDLSLIDRIITVSSEEAIFNAKKIMKKEGILSGISSGAAIAAALKIQKENDFKNKNIVVILPSSGERYLSTELFSRSFKNENNY

SEQ ID NO: 15507 - protein, 207 aa, Buchnera aphidicola str. Sg (Schizaphis graminum)
MLSKKENLLKLDWIKTNGLIPAIIQDFASNLVLMHGYMNKEAFLKTQKEGFVTFYSRTKKRLWTKGEESGNLLKVIDIVTDCDYDTILIIVEPLGKTCHLNRKSCFFLKENTLNFLSKLEDLIEDRKNFNTDNSYTARLYKSGTKRIAQKVGEEAIETILAAMKNDGDELINESSDLIYHLIVLLHDQNLNFNLIIENLKKRKTEKL

SEQ ID NO: 15508 - protein, 473 aa, Buchnera aphidicola str. Sg (Schizaphis graminum)
MLKQQVGVIGMAVMGRNLALNIESKKYTVSIFNRTQSVTEEVINNNKEKKIFPYFSIKDFVNSLRKPRCILLMVKSGQPTDETIQFILPYLNKGDILIDGGNTFYKDSIRRSNDLMKCGINFIGMGVSGGELGALNGPSIMPGGSREAYDLVSSMLKKISAKFKNEPCVSYIGPNGAGHYVKMIHNGIEYGDMQLISESYFILKNVLNMKNEELSNTFSQWNKGELNSYLIEITKNIFLKKEKDGIHYLIDSILDHAEDKGTGKWISQDALELHEPLSLITESVFARYLSSLKDQRLIASKILKGPILKCISSQNKELFVEEVRRALYLGKIISYAQGFSQLKKASEKYSWNLQYGKIAKIFRAGCIIRADFLERITDAFKSNNVTNLLLTPYFSEISNKYEKSLRYITSYAIKYGIPVPTFASAISYYDNYRTMSSSANLIQAQRDYFGAHTYRRTDKKGYFHTNWLTKKEL

SEQ ID NO: 15509 - protein, 378 aa, Buchnera aphidicola str. Sg (Schizaphis graminum)
MAKKDYYQILGIPKSAEEREIKKAYKRLAMKYHPDRNQGDKNAENKFKEIKEAYEILINEEKRTAYDQYGHAAFENGYNQNNTYSTFTSSTDFGDIFGDVFGDIFGGSRNQRVKKGADLCYNMEISLEEAVKGTTKEIRIPTFQKCKTCYGMGTSTGTKPNGCSTCHGKGQIHIRKGFFTVQQSCPTCNGIGTVIKNPCRMCRGQGRIKTNKTLSVKIPPGIDTNDKIRLSKEGEAGTNGAQPGDLYVQMKVNKHPIFEREENNLYCEVPINFTMAALGGEIEVPTLDGRVNLKIPSETQSGKLFRIRGKGVKSVQSRSRGDLLCRVVVETPVNLNEKQKYLLSELGNSFNGFRGDKNSPRSKRFFDGVKRFFDDLTK

SEQ ID NO: 15510 - protein, 177 aa, Buchnera aphidicola str. Sg (Schizaphis graminum)
MKHTIKVIISEKELDIRVRELGEEITKKYKNSKNKIILIALLRGSFVFIADLCRRIKIEHEIDFMTTSSYGRGMISTGDVKIIKDLDEDIYNKNVLIVEDIIDSGKTLSKVLGILKLRNPKSLSICTLLDKPECREVNINIDFVGFSIPDEFMVGYGIDYAQSYRYLPYIGKVIFKK

SEQ ID NO: 15511 - protein, 349 aa, Buchnera aphidicola str. Sg (Schizaphis graminum)
MRIEEDIKLGFKDVLIRPKRSTLKSRSEVNLIRCFSFKYSTMKWFGIPLIAANMDTIGTFRMAEALSKFNILTAVHKYYSFDEWKNFISVSSKEILEHVIVSIGTSNLDFFKIKKIFSLSSELKYICIDVANGYSEHFVSFLKKIRSFFPDKIICAGNVVTGEMVEELILSGADIVKVGIGPGSVCTTRLKTGIGYPQLSAIIECADAAHGLNGQIISDGGCTVSGDIAKAFGGGADFVMLGGMFAGHTECLGEIIQEKSKKFMLFYGMSSTSAMKRYTGKIPGYRASEGKIVKIPFRGNVDVTVRDILGGLRSSCTYVGAQKLKELTKRTTFIRVSEQENCIFNNFKN

SEQ ID NO: 15512 - protein, 476 aa, Buchnera aphidicola str. Sg (Schizaphis graminum)
MHQEIQSEVVIIGSGPAGYSAAFRCADLGLETVLIEHQERLGGVCLNVGCIPSKSLLHIAKIIKDASELSESGVFFNKPIIDIKKINNWKEKIIKKLTTGLSNMGEKRKVRIVQGKALFNTDHSVLVKNKKNDFTIFFKHAIIATGSKPIKIPSLPNEDNRIWNSTDALSLKSIPNRFLIIGGGIIGLEMATIYSALGSKVDIVDRFNAFLPSVDKDITDIYIKSIKKRFKLLLNTHVKSVEKSKDNDLIVKIAEENSDENVCCYDNILVAIGRSPNVDFLGLEKIGLKLNESGFIEINQQLKTNISHIYAIGDVTGFPMLAHKAVQQAHIAAEVISGKKHYFEPKVIPSVAYTDPEIAWVGLSEKEAENNDIDYEVSLFPWSASGRAHASNCTLGMTKLIFNKNTNKIIGGSIIGTNASELISEIGLAIEMGSDAEDISLTIHPHPTLSESISLASEVFQGTITDLLNLKKSLLN

SEQ ID NO: 15513 - protein, 286 aa, Buchnera aphidicola str. Sg (Schizaphis graminum)
MINEKIWHEKLHRHVGQYFSIDKILYQKKNKYHDIIIFQNSIMGRIMAIDGVVQTTEKDEFIYHEMLTHVPIFYHGLIKNVLIVGGGDGGILREICRHKSIENITMVEIDLNIIDLCKQFFPKHNNNAYKDPRLKIVIDNGLNFVQKTKEKFDLIISDSTDPIGCGKDLFLSDFYFHCKNCLVKNGIFVGQNGVFFLQKNDINQSYKNLKKNFHDVSFYQATIPSYYGGTMMFSWGTDNIDFRQINIKNLEKRIKDKKLTFNYYNSNIHISSFYLPQYIINTLDKS

SEQ ID NO: 15514 - protein, 432 aa, Buchnera aphidicola str. Sg (Schizaphis graminum)
MSQSDIFFDHKHIWHPYSSMVNPLPCYSVISAKGVYLKLKNGKNIIDGMSSWWSTIHGYNHPILNKSLKKQIRKMSHVMFGGITHPSAILLCRKLLKLTPKKLDCVFLSDSGSIAIEVAIKMLIQYWEALGQKRTQILTIKNGYHGDTFSAMSISDPNNSMHKIYNKFLPKNLFAETPTSSFHKEWNSIDIQSFKKIIEKKSKKIAGVILEPIVQGVGGMNFYHPTYLKEIKKLCKAYSIPLVFDEIATGFGRTGKFFAFQHANVIPDILCLGKAMTGGTITLAATLTSRNIAHTISSSKVSCFMHGPTYMGNPLACAVANANIKILEKNEWKKQVINIEKQLCQSLLPLIHHPRVVDVRVLGAIGVVECFHFVNMALIQKFFVKNGVWIRPFKKIIYIVPPYIISMNCLKKLINVIEKSLDNDTLFNVENI

SEQ ID NO: 15515 - protein, 230 aa, Buchnera aphidicola str. Sg (Schizaphis graminum)
MKTNKLVLIRHGQSKWNKLNKFTGWHDIELSDNGINEALKAGSLLKKEKFFFDYAHTSMLKRAIHTLRYILDTLDQSWLPVQKSWRLNERHYGALEGLNKDEMISKYGEEQVNLWRRSFEIIPPQIRLNDKRFPGNDIRYSNIDNNELPLGESLELTAKRVIPYWNKFILPQIKKRNRVLIVAHGNSLRALIQFLNKIDNKKILELNIPTATPIILEFNEEYNSIKWYYL

SEQ ID NO: 15516 - protein, 254 aa, Buchnera aphidicola str. Sg (Schizaphis graminum)
MKKKIIAANWKLNGSIKTISYFLTFLKSQISSFLKNNIIIIAPPTVFLERVYKDINSINIHLAAQNIDVNLTGAFTGENSALMMKDIGVKYIIIGHSERRLLHNENNEIIAKKFCLVKNLNLVPILCIGETEAEKKSNKTEKILKEQLNSIFNSFGEKAFRNAVIAYEPIWSIGTGVSADPKNVQLIHKFIKNYIKKYDIVSAENLIVQYGGSVTSLNAGNFLKQPDIDGLLIGSASLKHEEFLKIIKISDSFL

SEQ ID NO: 15517 - protein, 481 aa, Buchnera aphidicola str. Sg (Schizaphis graminum)
MLNRVRRTKIVATLGPSTDKANNLEKIILSGANVLRLNFSHGSSEEHKKRAKKAKEIMFKLNCHIALLGDLQGPKIRISKFKKNSIFLKVNDVFILDANLNEKNGNNERVGIDYKKLPNDLNVNDILLLDDGRIQLKVIKIEKCAIFTKVIIGGILSNNKGINKLGGGLSADALTEKDKKDIILASEIDVDYLAVSFPRCADDLIKARELLKKSGSNAQIIAKIERAEAVFDQNAIENIILSSDAIMIARGDLGVEIGDAELVGIQKKLIRTARKLNKVAITATQMMESMILNPLPTRAEVMDVANAVLDGSDAVMLSAETASGKYPSETVISMAKVCKGAEKVPSINVSRHRLNVEFQSIEEAIAMSSMYAANHLKGITAIITMTESGKTALMTSRITSGLPIFALSKHKKTLNLTALYRGVIPIYFDSDKDGVEAANEAIILLCKKKFLFNNDLVIVTQGDIMGKIGKTNTSRILRVTY

SEQ ID NO: 15518 - protein, 385 aa, Buchnera aphidicola str. Sg (Schizaphis graminum)
MPSKNDLLSFRSEINNIDKNIVQLLAKRKKLVLNIAESKIKNNQPIRDIEREKILLEKLTNLGKKNNLNTNYITRLFQLIIEESVLTQKKLLNKFCNDNNLDLASFSFLGPKGSYSHIAASQYAEQNFKTCIENACLSFNEVIQSVENNQTDYAVLPIENSCSGFINEIFDILKKTNLFIIGEINISINHCLLAIKKIELNKIKAVYSHPQPFQQCSYFIKKFPNWKIQYTNSTADAMKKIVKYNITTNAALGSELGSKIYGLKVLYKNLANKKKNITRFILLSRKPVSISSKIPTKTTLIFNTGQESGALAEVLLILKKNKLIMKKLTSQNIYKNPWEEMFYIDVQANLSSSLMQETLEKIGKITKFIKILGCYPSENITPIIP

SEQ ID NO: 15519 - protein, 434 aa, Buchnera aphidicola str. Sg (Schizaphis graminum)
MSKILKIIGREIIDSRGNPTIECEVLLEGGFVGLASVPSGASTGSFETWELRDQDKNRFMGKGVQKAVEIINNKIFYSLKNKNAIDQFDIDQTMINLDGTENKSNLGSNSILSVSLATAKAAASSKGMPLYQHIAEINNTPGVFSMPLPMINIINGGKHANNNIDIQEFMIQPISAKSITEAIRIGAEIFHSLGNLLKDKGMSTTVGDEGGYAPNFKSNEEALNVIQDAVHKTKYKLGKDITLAIDCAASELYNKTRKKYQFIGEGTEFSSQELTHYLKKLSNKYPIISIEDGQDESDWEGFLYQTKELGNSLQLVGDDLFVTNKNILKKGIKKGVANAILIKLNQIGTLTETIETIKIAKKFNYGVIISHRSGETEDTSIADLSVGTASGQIKTGSMSRSDRTSKYNQLIRIEEILNKKRAPFYGLKEVKSSF

SEQ ID NO: 15520 - protein, 388 aa, Buchnera aphidicola str. Sg (Schizaphis graminum)
MNLRKMTELNITGKKILIRTDLNVPIKNGVIQSDARILAALPTIEIAIEKKAKIIILSHLGRPKEGCYTKKYSLFPIFEYLKKKLKKTKIYFSDNHLKKVEINSGEILILENVRFNVGELKNDENLSKEYANLCDIFVMDAFGSAHRMQSSTYGIGKFVKIACAGPLLISEINNLKKALKNPKRPMVAIVGGAKVSTKFNVLNKLAAISDTIIVGGGIANTFLAIDNKIGKSLHEPKFILKAKKLRDKYNNIVIPIDSRVGKNFSHKEKCTIKLSSNIEKNEEIMDLGDKTIKKIIKILKKSKTILWNGPVGVFEFPNFRKGTEMIAKAIAENNGFSIAGGGDTLSVIDMFQIKDKISYISTGGGAFLEFIEGKKLPAMKMLEENFHK

SEQ ID NO: 15521 - protein, 214 aa, Buchnera aphidicola str. Sg (Schizaphis graminum)
MRIILLGAPGTGKGTQAKLITENYNIPKISTGDILRENIQKKNTIGKKIHNILKNGELVSNRIVCNLIGERIQKKDCIHGFLLDGFPRTQKQAEYISNLKIKIDYVLELIVPYELILKRICGRRVHTPSGRIYNINYNPPREEGKDDLTQEKLTIREDDTIEIVKKRLENYEKNSFLLNKYYLREKKLKKLQYFKIDGKQSIYKIQREIKMMLK

SEQ ID NO: 15522 - protein, 252 aa, Buchnera aphidicola str. Sg (Schizaphis graminum)
MIVFLLKRILLLYLIFFVPKSFSENLPFFKIKSYSEKKEFFQNDNEKVGYSLGVSLGNYVNESFERQKKMGINLDKYNILLGVQDAISGNLKLSNEEISTILQKLEKNLKNAAKIEFEKSEKENLIQGKLYMKKFSEMKGVSKTSSGLLYIIDKLGEGEEIKTKNAEITVHYKGSLINGTEFDSSYKRGKPITLMLKDVILGWQEGLKYIKKGGKIKLIIPPNLGYGSNRINEIPANSILIFDIELLDIKNI

SEQ ID NO: 15523 - protein, 404 aa, Buchnera aphidicola str. Sg (Schizaphis graminum)
MIGKIKLITRDSFNKLILPVYNPAFFIPVKGKGSRLWDQKGKEYIDFSGGIAVTSLGHCHPVLNKVLRQQSKKLWHISNIFTNEPALRLADKLISSSFASRVFFANSGAEANEAAFKLARYYSSKIYNLKKNKIISFYNSFHGRTFFTVSVGGQAKYSDFFGPKPPAIMHAKFNEINSVKSIIDDNTCAVVMELIQGEGGIVPADVAFVREIRDLCYKYNALLIFDEIQTGIGRTSKLYAYEHYEVQPDILTIAKSLGSGFPISATLTTNGIASVIKPGIHGTTYGGNPLACSIAESVVNIVNTKKFLLGVEKKSKKIISELNIINKRFGLFTEIRGKGLLIGIVLRPELSEEIHNILNALFLEGVIVLTAGKNVIRLAPSLIISKRDIVEGMKRFYCALEKCL

SEQ ID NO: 15524 - protein, 228 aa, Buchnera aphidicola str. Sg (Schizaphis graminum)
MKKFFLASSILSADFARLGEDTKKAIDAGSDWIHFDVMDNHYVPNLTMGPMILKALRNYNITVPIDVHLMVKPVDNLIPQFAEAGADFITFHPESTDHIDRTLNLIKECGCKAGLALNPATSLNFLDYVMEKLDLILLMSVNPGFGNQSFLPTSFNKLREVRKKIELNSSNILLEVDGGVKLENISEVAFSGANVFVIGSGIFGYTDYNVIIKKIRKKLKNVYSTSIH

SEQ ID NO: 15525 - protein, 165 aa, Buchnera aphidicola str. Sg (Schizaphis graminum)
MDYFALFNLPKKYIIDKFLLSKNFYKLQLKFHPDLFIHHSESKKRIVLQKSIEINKGYKILQDSLNRAIHLLFLNGFKISKEKVLSEDNSFLKKYFFLYEELDFLLKNNCDEVQIDIFFKKIRNKIDNYEKIIEIKFNEKKWDDIIKLITKLLFFKKIQTRLKQS

SEQ ID NO: 15526 - protein, 426 aa, Chlorobium tepidum TLS
MTIDLDFDRCHLWHPYTSMADPLPVWPVKRASGVMIELEDGRKLIDGMSSWWAAIHGYNHPVLNRAVTEQLGRMSHVMFGGLTHEPAIELGKILTSLLPDPLDRIFFCDSGSVAVEVAIKMALQYWLAAGKPGKKRLLTVRSGYHGDTFMAMSVCDPVTGMHSLFSGAVPEQLFVEAPACGFNEPWREEAIDKMRQALEDHANTIAAVIIEPIVQGAGGMRFYSPHYLRRLRELCTEHGVLLIFDEIATGFGRTGKLFAMEYASVTPDIVCLGKALTGGYMTLAATVTTGHVADTISGGNPGLFMHGPTFMANPLACAVAVASLKLLLSGDWQSTVWRIERQLAEELAPCTGMTGVRDVRVLGAIGVVELDRPVDMAKIQQAFVERGIWVRPFGRLVYLMPPFIIRDNELTRLTSVICEVIGAEYR

SEQ ID NO: 15527 - protein, 437 aa, Chlorobium tepidum TLS [sequence omitted]

SEQ ID NO: 15528 - protein, 460 aa, Chlorobium tepidum TLS
MQVKFGTDGWRAIIAKEYTYDNLKLAALASGKYFLSHPDKSNGVCVGYDTRFMSKEFARYTAEVLSSMGLKVFLSSSFVSTPAVSLYTREHKLAGGVMITASHNPPIYNGFKVKASYGGPAHPEVIDEIEKNLSGIDPSTLVKPAENLITMTDIKSEYIAYLESKLDLKLIRESGLKIAHNAMYGAGQDIVTRLLDESMVNCYHCSVNPGFDGINPEPIPPYITDFVEFFKEVETDVAIINDGDADRIGMLDEKGEFVDSHKLFAIVLKYLVEQKGQRGEVAKTFALTDIIDRICQKHDLKMHLLPVGFKYVSRLMTTNDILIGGEESGGIGITSFLPERDGVYTGLLMLEIMARRQKTLTGLVEELYDEYGFFSYNRLDLRVAESKKAAIIEAASGGKLKSIAGYPVTSFNDLDGFKYHFEGGWLLIRASGTEPVLRIYCEADSTEKVEKVLAFASRLA

SEQ ID NO: 15529 - protein, 470 aa, Chlorobium tepidum TLS
MMIMPVILSGGSGTRLWPLSRAMYPKQLLPLFGEKTMLQDTVLRVGSIEGVGPVICVCNDEHRFLVAEQLRQIGVAEQAIILEPFGRNTAPAAAIAALVIAATHPGALMLLLPADHVILDRQGFVASIESARSAAESGSLVTFGIVPSTPETRYGYIRAVAGSTGVTRPVAEFVEKPSLERAEGYVVSGDYFWNSGMFLFRPEIYLAELEASSPEILDACRKSLENARRDLDFLRLDPEAFAACPANSIDYAVMEKTSNAVVVPMQAGWRDVGAWSALWEAQERDAEGNIKRGDVLTHGVRNSYIHATSRLVAAVGLEEHVIVETADAVLVASKERVQEVKAIVEQLKLQKREEPLIHRRVYRPWGSYETVDEGERFKVKRITVKPGAALSLQMHSRRAEHWIVVTGRALVTVGKKQVPLEANQSIYIPVEELHRLENPGDEPLELIEVQSGGYLGEDDIVRFEDHYGRL

SEQ ID NO: 15530 - protein, 244 aa, Chlorobium tepidum TLS
MIELRNVTLRYGEKVILDKVSLTVQDNTIKAILGPSGVGKSTIIKLMLGLIKPNSGQVFVDGVDITPLKEADLYPIRRKMGIVFQGNALFDSMTISQNMSFFLRENLQLPDDEIDRRVAEQIRFAGLEGYEDQLPESLSGGMQKRVAIGRALIFNPKMILFDEPTAGLDPVSSHKILNLIASLKKSNDLGAVFVTHIIDDVFAIADEVAVLYQSKIIFDGPTGQLHDSQHPFIKSILSDKILEL

SEQ ID NO: 15531 - protein, 400 aa, Chlorobium tepidum TLS
MNTPAINLETEKQLFFHNYARLPLDIASGKGSFLYTASGERYLDMIAGVGVNAIGYGDKRLEQAITEQASKYIHVSNLFMQKPQFDLAAKLLEISRMSKVFFCNSGTEAIEAAIKLARRFAARNGDTDKTQVLSLTNCFHGRTYGALSLTAKPKYVDGFEPLVPETGMIDFNDVEDLERKVSNRTAAVFVEFVQGEGGIHKVSEAFIAKLKELAKEHDFLIVADEIQAGCGRTGAFFSYMPFDIQPDLVCVAKPLGGGLPLGAIIGSEKVAEVFTPGSHGTTFGGNPVACAAGLAMIEAILADGLMQNALEVGSMMRTAFEKMAEKHAQILEIRQYGLMIGVTVHREAKYYVEEALKRGVLVNATSNNVIRLLPPLSISKEEAQLCLDTLDAIFTEEAKA

SEQ ID NO: 15532 - protein, 247 aa, Chlorobium tepidum TLS
MKKLVLLRHGESQWNRENRFTGWVDVDLSEKGREEARTAGQLLKDEGFVFDLAYTSVLKRAIRTLWTVLDEMNLMWIPVTKNWRLNERHYGALQGLNKAETAQRHGDEQVLIWRRSYDTPPPALTESDEFWPGKDPRYASLSSQELPATECLKDTVARFLPYWHETIAPQIRDGKNVIITAHGNSLRALVKYLDNISDEDIVGLNIPTGIPLVYELDDDLKPLKSYYLGDQEELKKKVEVVVKQGKA

SEQ ID NO: 15533 - protein, 490 aa, Chlorobium tepidum TLS
MGKLKGFMEYRRALPVDREPLERIKDWNEFHEEMSAEQLSDQGARCMDCGTPFCHSGFMLNGMTAGCPIHNLIPEWNDHVYRGFWRDAWERLMKTNNFPEFTGRVCPAPCEGSCVLGIIQPPVTIKNIEYSIIEHAFAEGWVEPKQIAVRTGKKVAIVGSGPSGLACADQLNKAGHTVTVFERDDRVGGLLMYGIPNMKLDKRLVVQRRVDLMKEEGVSFVTGTEVGVNYPVDKLLSEYDAVVLCIGATNPRDLNADGRNLDGIHFAMEFLRASTKAVLDGTEPVLSAKGKDVVVIGGGDTGTDCVATSLRQGCKSVIQLEIMPKPADFRQEDNPWPEWPKVFKVDYGQEEAAAVQGGDPRRYLMMTKKFIGENGRLSAVEVSKVEWIKQEGRTIPVPVSGSEEIIPAQLVLLAMGFLGPEAQLLQSLGVEQDSRSNIKADEKSYRTSVDKVFAAGDARRGQSLVVWAINEGRAAARECDRFLMGCTSLP

SEQ ID NO: 15534 - protein, 137 aa, Chlorobium tepidum TLS
MGENQETQKSFLETVKFDSNGLVPAIVQDHETGKVLMMAWMNLESLKMTLEKKKACYWSRSRNKLWLKGESSGNMQEVHDILIDCDGDTLLLKVSQKGGACHVGYHSCFYRRTVDGESMEICDTLMFDPEEVYGKQS

SEQ ID NO: 15535 - protein, 472 aa, Chlorobium tepidum TLS
MAIPRQKMPAQDPVERVGNFKEVNLGLTPEQAQQEALRCIQCKDPVCIAGCPVNIKIDQFIKLIAEGDFMGAVRKIKEDNVLPSICGRVCPQEDQCEKVCVIGKKHEPVAIGNLERFVGDYERTSGQKIDPKIAPPTGKKVAVVGSGPAGLSCANDLAQYGHKVVVFEALHELGGVLMYGIPEFRLPKEIVREELDGLRRMGIEFRTDVVVGRTITIDELMEEEGFDAVFIGVGAGLPWFMGIPGENLVGVLAANEFLTRVNLMKAYDFLKSSDTPVFDCKGKNVAVFGGGNTAMDAVRTAKRLGAEHAYIVYRRSEKEMPAREEEIHNAKEEGIEFLLLTTPLEFVGDEKAWLTGAKCQKMELGEPDDSGRRRPVPVEGSEYILPIDMAIISIGNGPNPLIHQTTPDIEVSKRETIVVDVNTMQTSKENVYAGGDIVTGGATVILAMGAGRKAAAAINEKLGGTAKNFNEW

SEQ ID NO: 15536 - protein, 267 aa, Chlorobium tepidum TLS
MKENRITRLVKQDKKLLIAYYMPEFPVPGATLPVLEALQESGVDLIELGMPYSDPIGDGSVIQDAAHKAISHGVHVGSIFELVRRARNGEGCKKITTPILLMGYCNPLIAYGGDCFMADAVKAGVDGLLIPDLPPEESEDFLERAKHFGLSVIYLISPVTPPDRIELIDSMSTDFSYCLAVNATTGTGKLDVAGMDEKIAEYLKRVRQHTKKKFVVGFGIKDRERVRKMWELADGAVVGSALLQHVATAKTPEETAELAAGFWKSLR

SEQ ID NO: 15537 - protein, 239 aa, Chlorobium tepidum TLS
MSGSVIIKASNLVKWFGEGEARTVAVKQASFEAQYGEMLYIVGPSGSGKTTLLSMISGILRPNEGSVVVENQDIWTMKDDDLADLRLNKIGFVFQDYHLFPRLTTVENVAIPLILKKMEWNAAMKLARDYLDIVGLKDRADLQPVKLSGGEQQRVAIARAIAGQPDILIFDEPTASLDGDTGRKIVEFVKTNILNEKRAIIIVTHDSRIYEYADRIMKMEDGKVVGYESGYENSQRHEK

SEQ ID NO: 15538 - protein, 310 aa, Chlorobium tepidum TLS
MATIANITNTIGRTPLVRLNKLAKGLDADILLKLEYFNPLGSVKDRIGRAMIEAAEAEGKIDARTLIVEPTSGNTGIALAFVCAQRGYRLLLTMPETMSIERRKLLRYLGAELVLTPGAQGMKGAIEEAARIVEAEKNSFNPGQFRNPANPLIHQATTGPEIWNDTEGRVDMLVSGVGTGGTITGTSRFIKALKPNFKSIAVEPKDSAVLSGGQPGPHKIQGIGAGFVPDVLDVSLLDEVVTVSNDDAISTARALASQEGILCGISSGAAVHAAIEVAKRSSSAGKTIVAIIPSTGERYLSTALFEDIEA

SEQ ID NO: 15539 - protein, 146 aa, Chlorobium tepidum TLS
MIARLVDRADFMEAQEHFARNIVIGFARIQGRSVDIVANQPAVMAGELDIDASDKTARFIRFCNALNIPLVTLVDVPGFLPGVEQEYGGIICHGAKMLFAYSAATVPKFTVVMRKAYGGAYLAMSLDILHSKREFRPQNKHGLIPL

SEQ ID NO: 15540 - protein, 441 aa, Chlorobium tepidum TLS
MKSFLSKSGAIAAGLLLAAATFSPPIQAATPTPDAVNAFAIDNFFLFICAVLVLFMQAGFALVETGLNSAKNAVNILFKNLMDMAIGGIIYYFVGYGLMYPGEAFSGGFFGFGGPGISTAMPEIAGGTLYPAVDFLFQVAFAATAATIVSGAVAGRMQFRAYLIYSAVISAVVYPISGFWLWGGGWLKALGFHDFAGSLLVHALGGFAGLAGAIVLGPRIGRFNEDGTPNAMPGHNLALSTLGVFILLIGWYGFNPGSQLAIVGGDNTAAVMKIAVNTTLAACAGAVVAMIFAWGLFKKPDLTMALNGMLAGLVAITANCDVVSYNASLIIGAVGGILVVLGIMLLDKLRIDDPVGAWPVHGLNGIWGGVAAWIFGGQPMVAQLVGSLVVPFWGFVTMMVLFLILKAMGILRVHKDEEMKGLDISEHEEEAYYGFDIYTTQ

SEQ ID NO: 15541 - protein, 398 aa, Chlorobium tepidum TLS
MAKILEGPAMKLFNKWGIPVPNYVVIMDPKRLAQLGEANKWLRESKLVVKAHEAIGGRFKLGLVKIGLNLDEAIQASREMLGAKVGTAEVRQVIVAEMLDHDAEFYVSIIGNRDGAELLISKYGGVDIEDNWDSVRRIQIPLDEHPTIEQLTALAKEAGFEGEIAERVGKICSRLVLCFDNEDAQSIEINPLVIRKSDMRFAALDAVMNVDWDARFRHADWDFKPVSEIGRPFTEAEQQIMDIDSRIKGSVKFVEVPGGEIALLTAGGGASVFYADAVVARGGTIANYAEYSGDPPDWAVEALTETICRLPNIKHIIVGGAIANFTDVKATFSGIINGLRESKSKGYLEGVKIWVRRGGPNEAQGLAAIRKLQEEGFDIHVYDRSMPMTDIVDLALKS

SEQ ID NO: 15542 - protein, 218 aa, Chlorobium tepidum TLS
MRIILLGAPGAGKGTQAQYISEAFGIPQISTGDMLRAAVKAATPLGLAAKKIMDEGGLVPDDLIISLVKERIAQPDCANGCLFDGFPRTLAQAEALRAGGIRIDHIIEMNVPDEEIIKRMSGRRVHLASGRTYHVTFNPPAVPDKDDLTGEPLVQRNDDCEETVRKRLKAYHELTEPLVGYYRNLSMNGSADAPKYSRIAGIGTVEQIKDEIIATLNG

SEQ ID NO: 15543 - protein, 456 aa, Chlorobium tepidum TLS
MAKSTVRYVCSACGAVSLKYQGRCFECQSWGTLVETHLEEPDAKVRKKRPAGSMPEVQNLDDDAPSGFHRTLTGIGELDRVLGGGLMEASAILVGGEPGIGKSTLMLQLVPRLAGKKVLYVAGEESPNQIRERARRLSIKAPNLRLVSEVALERILDAIANEQPEMVIVDSIQTVYSSDYQSSAGTITQIRECAASLIRAAKEQNFILLIIGHITKEGSLAGPKALEHMVDTVVQFEGENYQRYRIIRSVKNRFGPTNEIGVFKMGEEGLTEVSNPSEFFISDRRTDVPGTAVLAGIEGSRALMVEVQALVSRTGYSMPQRISTGFDLKRIAIILAVLEKRLQFQTAGQDVFVKIAGGLKLVEPAADLAIAAAVASGLQDKPCNPTACCCGEIGLSGELRAISDGERRIREAVHLGFTSIVLPESNTRELKPSLKKLPIRIAGCRTLHEALEAMGV

SEQ ID NO: 15544 - protein, 404 aa, Chlorobium tepidum TLS
MFDEIEFDRIKRLPKYVFAAVNELKMAERRAGRDVIDFSMGNPDGPTPQHIVDKLVESVSKPKTHGYSVSKGIYKLRGAIGGWYRDKYNVDLDLDREVVVTMGSKEGYVHLVQAITNPGDLAIVPDPCYPIHSQAFILAGGNVHRMKLEMNEDYTLDEEAFFHNVETALRESSPKPKYLVVNFPNNPTTATVELPFYERLVELARRERFYIISDIAYAEITFDGYVTPSILQVSGAKDVAVESYTLSKTYNMAGWRMGFMVGNAKLVGALEKIKSWLDYGTFTPIQVAATIALTGDQSCVREIREVYRKRRDVLISSFANAGWDIVSPKASMFVWARIPEQMRAMGSLEFSKKLLIEGKVAVSPGIGFGTYGDEYVRVAMIENEERIRQAARNIKRFLKNNAGS

SEQ ID NO: 15545 - protein, 338 aa, Chlorobium tepidum TLS
MVLERVVDLLHETQPLVLRELPVPEPGPGEILLRVATCGVCHTELDEIEGRTPPPRFPVIPGHQVIGRVVACGDGVAGIETGSRRGVAWIYSSCGHCDLCRSGNENLCAEFSATGRDADGGYAEYMVAPAAFTYSIPDVFSDAEAAPLLCGGAIGYRSLMLANLKDGQILGLTGFGASGHQVLKLARYLYPKSPVFVFARSEKDCDFARSLGADWAGGTTDNSPSPCDSIIDTTPAWLPVLSALERLRPGGRLVINAIRKESHDSELLAGISYERHLWMEKEIKSVANITRADVSAFLDIAARMGLKPEVRSYPLEEANRVLLDLRHGKARGAAVLIP

SEQ ID NO: 15546 - protein, 494 aa, Chlorobium tepidum TLS
MDKILYDALTFDDVLLVPAYSNVLPKETVVKSRLTRQIEVNIPLVSAAMDTVTEAELAIALARAGGIGIIHKNLSIDEQARQVAKVKRFESGIIRNPIHLFEDATIQDAIDLMIRHSISGIPVVEHPTPEGCLLLKGIVTNRDLRMTASSDEKITTIMTTNLVTAKEGIDLLTAEDILMRNKIEKLLIIDDNGYLKGLITFKDIQKRKQCPDACKDSQGRLRAGAAVGIRANTMSRVDALVAAGVDVVAVDTAHGHSQAVLDMVATIKQKYPELQVIAGNVATPEAVRDLVKAGADAVKVGIGPGSICTTRIVAGVGMPQLTAIMKCAEEAKKTDIPLIADGGIKYSGDIAKALAAGADSVMMGSVFAGTDESPGETILYEGRRFKAYRGMGSLGAMSEPEGSSDRYFQDVSAETKKYVPEGIEGRIPAKGKLDEVVYQLIGGLKSAMGYCGVRTITELKENTRFVRITSAGLRESHPHDVMITKEAPNYSTSA

SEQ ID NO: 15547 - protein, 469 aa, Chlorobium tepidum TLS
MQQADTLAAQFDVAVIGSGPGGYEAAIHAARYGLKTCIVEKAVLGGVCVNWGCIPTKALLRSAEVFDLAKNPETFGVNVGNVSFDLAQAVKRSRNVALKSSKGVAYLLKKAAVEVLAGEAVLTGGAGVMVTMPDGSVRMLGAKNIIVATGSTPRVIPGLEPDGKKIITSREALILKEVPKSMIVVGGGAIGVEMAWFYAKAGSKVTIVELMPRMLPAEEAEVSEALKRSFEKAGITVHCGAKLDNVAVSESGVSAELVVEGSAPQTLNASCLLVAVGVTGAIDGLGLDAVGVETERGFIRTDGQCRTSAPGIYAIGDVRGGMLLAHKASAEAAIAVEAIAGKSPEPLSEPLIPRCVYAQPSVASVGLTEEAAVNAGYQVAVGRSQFAASGKANAYGQLEGFVKLVFDAATGKMLGGHLIGHDAVELIGELGLACRYGVTAGGLVNTVHAHPTLSETVREAAFDALQSMG

SEQ ID NO: 15548 - protein, 245 aa, Chlorobium tepidum TLS
MVGNWKMNNTIAESVDLATAIAEKVGADGVQCEVGIAPTFPALYEVCKVIEWSGIRLCAQNCHYESDGPFTGEVSTRMLAAAGCSYVILGHSERRQLFGETNATVNLKVKKALAEGLSVILCVGETLDERERGVTGQIVTAQVVEGLIDVTDISKLVIAYEPVWAIGTGKTATKEQAQEVHALIRAKVTELYGQKAADHLRIQYGGSVKPSNAAELFAMPDIDGGLIGGASLNADDFMAIVEAAG

SEQ ID NO: 15549 - protein, 268 aa, Chlorobium tepidum TLS
MVSGNDNNHHAAQRARMLLTQIAPNFLDPKHEWQRIFAELWGTFLLVLVAAGGPVAATSSGNHAGDALLPVAPGLMVMAIIYFMGTVSGAHLNPAVTLAFAMRRNFPWVRVPGYILAQVAGGWLAALFLGFMFGNAAVAPGMTLPGHEVTPLKALVMEMVLTAALVNTILGTSSGARNIGTNGAIAVGGYIALAGMWAAPVSGASMNPVRSLAPALVCGDTTLAWVYVAGPIAGALIGVVFEWILKGPPTTAGTVAAQGTLDIDDREG

SEQ ID NO: 15550 - protein, 433 aa, Chlorobium tepidum TLS
MRNFFEFDRHGTSYQQEVLAGLTTFFTLSYIIVVNPAILEATGMPRGASMTATILTAVFGTVLMGLYAKRPFAVAPYMGENAFIAYTVVKTLGYSWQTALGAILVSGVLFTLITLTGARKWLAEAIPMTLKHSFTVGIGLFLAFLGLSNMGVVALGVPGAPVKLGDLTTIPALCGLGGLALTGALLVRKVTGALVIGMAATTMLMLSFGLLQLPQTLFSLPPSIAPLWLQVDITGALTWGFVGVILSVLVMDFVDTMGTLIGLSARARLLDENGNLPEIEKPMLVDALSTTAAALFGTTTAGVFIESASGIEQGGKTGFTALVVAGLFLLALFFAPILTIVPPQAYGPVLVLVGMFMIESAGYFDFNDYTELLPAFLTIVMMLFTFNIGVGITMGFISWVVIKALAGRFREINAGMTALAILSATFYIFYPYH

SEQ ID NO: 15551 - protein, 176 aa, Chlorobium tepidum TLS
MIENVPFTELISAERIAARVAELGAEISRDLAGIDELTVVCVLKGGFIFTADLVRHITIPCRIEFIRASSYGTHRASTGKVMLDHHHDPHVEGKNVLLVEDILDTGLTITRVLEELRGHNPASLHVCTLLDKPSARTTPVKADFTGFTIPDVYVVGYGLDAAGKHRELPYVASLNA

SEQ ID NO: 15552 - protein, 457 aa, Chlorobium tepidum TLS
MIVTINPATGEQLAEYPVMIAGQIDSVLRQADADFRRWRSTSFGERRTCMKRLAELLREQAEKHGRIITLEMGKPFSQAVAEVNKCAWVCDYFADHAEEFLQPEQSEIDGAKGIVAFEPLGVILGVMPWNFPYWQVLRFAAPILMAGNGIVVKHAPNVTGCAIAIEKLFRDAGFPEHLYRAVHIDLDEVDRLTGFMIDHPVIKAVSVTGSTGAGQAVAAKAGKALKRSVLELGGSDPYIVLEDADLAQAVDACVAGRLLNAGQSCIAAKRFIVRKEIIGEFTKKIVQRMQTAVMGDPFAKSTEVGPIAREDLRDLVHSQVQRSVEAGAELLWGGHVPNAPGWYYPPTVLSGVKPGMPAYSEEIFGPVATIIEVADDDEAVAIANDSEFGLGSAVFSQDVERALGIARRLEAGSCFINTMVKSDPRLPFGGVKQSGYGRELSHHGIREFVNIKTFYLP

SEQ ID NO: 15553 - protein, 280 aa, Chlorobium tepidum TLS
MTNWLIAYQGEPGAYSEIAALRFGEPLPCESFDDVFSAVTEQKADYAVIPIENSLGGSIHQNYDLLLRRPVVILAETFVKVEHCLLGLPGASVETATKAMSHPQALVQCHNFFATHPQIRAEAAYDTAGSAKMVAESRDKSALAIASKRAGELYGLDILKENLADEEWNITRFFCIAHENNPDISHLKVRPDVARQKTSIVFALPNEQGSLFRALATFALRGIDLTKIESRPSRKKAFEYLFYADFIGHREDQNVHNALENLREFATMVKVLGSYGVVNP

SEQ ID NO: 15554 - protein, 220 aa, Chlorobium tepidum TLS
MPGKTTLLAPSILSADFTNLKASVELAEKAGADWMHCDVMDGIFVPNITFGSFIVQAIKQCTSIVIDTHLMIVDPDKYIEDFAKAGSDQITVHLEACPHLHRTIQLIKSLGVKAGVSINPATPVSLLEPVLADLDLVLLMSVNPGFGGQKFIPGAIKKIMQLDAMRMEMNPEMVIAVDGGVTEENAAMIVDAGADALIAGTAFFRAPDPVAAAKKLKGLE

SEQ ID NO: 15555 - protein, 458 aa, Chlorobium tepidum TLS
MELVTQAAQTFGDQPALITDERRWSFADLDGDTARIATAFEASSIRRGDIVALVAPNSPALVLSLMALMRMGAVAAPVNHRFPANHIEGVLARLNPAMTLDAAKLDAFVADAIARTGATFTAATEMERPVSVIHTSASSGKPKAAVHSLSNHYHSAMGSAQNLPFGPGDCWLLSLPLYHVGGYSMLFKCLLGGGALAVPSPDAALAESLTHFPVTHLSLVPTQLYRMLRADGGPERLRSLRALLLGGSAVSAPLLREAICERVPLYLTYGSTEMSTQVTTSPTPVTKARGDSGVVLPYREVAISVDGEILVKGECLFMGYLDNGELREARDKNGWFHTGDMGELSGDARLTVLGRKDNMFISGGENIHPEEIEKALTSIVGIEEAVVVPAPDAEYGMRPVAWIKARSDSPDDATIIASLKSTIGKLKTPVAFHRIQEWQTIPGSAKIDRSWYRKLAEK

SEQ ID NO: 15556 - protein, 295 aa, Chlorobium tepidum TLS
MGSNMVEHLLELGHEVVAFDLSAEAVKAIAAKGATAASSLQHLVGELAAPRVVWMMVPAGRPVDAVIDGLTPFLRAGDIVIDGGNSRYTDSVARAEKLRKQGIRMLDIGTSGGLDGARHGACMMAGGDREAYEHVEPVLRDLCVENGYGYMGASGSGHFVKMVHNGIEYGMMQAIGEGFELLRASGYDLDNQNVARVWSNGSVIRGWLMDLAGKAFAQGNDLGWLGGKVADSGEGRWTVEAAIELGVAVPIISGSLFRRFQSQNEEHFSDKVVAALRHEFGGHAYEKPGEGEGKA

SEQ ID NO: 15557 - protein, 460 aa, Chlorobium tepidum TLS
MTYDASTHAGLRCYFDSGQTRPFEWRRAQLRGLDAFLREREHEIAAAVHADLRKPVAETWLTETAWLRSEIRFVLKRLHRWMRPKKVGVPLHYQPARAFVERDPLGVVLIIGAWNYPLQLCLAPLIGALAGGNVSVVKPSEMAPATSALLASELGRYVDPQAVRIVEGDGEASARLLEHCFDHIFFTGSRRTGQAVMQSAARHLTPVTLELGGKSPVIVTEKADLRLAARRIAWAKFLNAGQTCVAPDYLLVQEGVKEPLQGLMKEALRLYYGSDPEASADYGRIVDDRNFRRLEALLCEGSLVEGGGSNKASRYIAPTILHDVPEDSDLMKEEIFGPVLPVRSFTTLEEAVSMVRALDAPLAVYLFSRDRSELRYLIEQTRSGGVCCNDLLFQASIPGLPFGGRGMSGMGRYHGKAGFDTFTTERSVLDRGGFPDPDLRYPPYSSGRFDLLKKIVTLFS

SEQ ID NO: 15558 - protein, 142 aa, Chlorobium tepidum TLS
MAQAKKGDKVLVHYTGTYDDGTVFDSSVERGPLEVTIGTGMVIPGFDRALLDMEPGQKKTVNIPVDDAYGPRAEELIAEVPRERIPAEIPLEIGQQLQLSLADGGEVIVMIVDLTDTTVTLDANHPMAGLDLNFELELVEIL

SEQ ID NO: 15559 - protein, 456 aa, Chlorobium tepidum TLS
MTNDIFDISDNTPLVLMKQLTRQKRARFMAKLEYMSPCFSHYCRVSGAIVRDAEERGAIHPGMTLVDWTFGTSGIALAMAAVSRGYKVLLAAPESICREKQEVLRALGAELVLTPSEALPGDLQSCVDVAENLVRTLPNAWFANMYQNPVSRQVHQDGTGPEIFRQTEGKVTHLFVPMASGAMISGIGRYFKSVNPEVQIIGVEPEGSVYGDLHGGKSQGTPSAFQLEDIGAVRPTSFWDPNVIDRIVQVSDADAFNCGRELLRAEAVFAGGASGAAMAAALREGEAYGDDALVVVMMTDFGGYDLSRMYNDDWMRRQGFYRKSKTALDQITADDILQRKAHKDLIFAQPEQTLAEVFETMKQNDVSQMPIVSFGAPIGSISENRILSILIENDSAMNAKVVAFMEKPFPVCQPDATISELSEKLQTNASGVLISLSDGRLQLINKSDLIDVLTRK

SEQ ID NO: 15560 - protein, 467 aa, Chlorobium tepidum TLS
MSTKFDVIIIGGGPGGTPAAMQLASQGKTVLLVEESGKLGGACLFVGCIPSKIIRHWADEYAVKLKYSAQEALSPEDREAAWNEIMRKMQTILSQRSGAAMQMLKHLSNLRFVAGHAKFVSNNELVINEKDTGRKEKYTFNKAIIATGSHSFIPPFKGNGVQDVLTSEVLFSQDKLPESLLIIGGGPIGIELAQMLTKLGTKCTIIELLDSILYGVVETEFVSIISNQLSSLGVNIYTSSQVQEINKSDGHFDVTFTDANGSEHKENFEDVLVVTGKVPNIESLNLDSTDIKYDRKGIIVDEYLETSVKGIYATGDVTHGPKFAHTATYEAHIASANISAGNNQKVDFSKNTWVLFSEPEIVAAGFTEAQAVQEGYDIITGVYDYKIDAAAQVMNSPFGYLKYVVNKKNSEIIGVHICMNNASSLAGEASLIIANRLILKNVAETIHPHPTLTEAFGILAQKMLSKS

SEQ ID NO: 15561 - protein, 427 aa, Chlorobium tepidum TLS [sequence omitted]

SEQ ID NO: 15562 - protein, 452 aa, Chlorobium tepidum TLS
MNKQVDVLVIGGSAAGIVAATTGKAFYASKSFLIVRKEPEAVVPCGIPYIFGTLDGVHQNIVPTAPLANADVELLIDEVVSIDREAKSATTAGGVVISWDKLVLATGSEPKTPDWLEGRDLDGVFVIPKNRDYLCRLRSRLEEPRRVAIIGGGFIGVELADELAKKGHDVTLVEILPHVLSMAFDSDLSLKAEELLVKRGVKLKTGEKLKKLAGQASVSKVILESGEEIEVDIVILATGYAPNVELARSAGIKINELGAIRVDEYMRTEDKNIFAVGDCAEKFSFITRIVKGLMLASTACSEARIAGMNLFGLSRLRTFSGTIAIFSTAIGGTTFAAAGVTEQLARERGFEVVSAGFTGIDKHPGTLPETSNQYVKLIVNSENGLVLGGAVMGGQSAGELINVIGVIIETKMTVNELLTLQFGTHPLLTGPPTAYALIKAAEAVEMKLRHFK

SEQ ID NO: 15563 - protein, 1108 aa, Chlorobium tepidum TLS
MPKKQAVTSYQPESLWYKDAIIYELHVKTFCDSDNDGIGDFRGLKSRLGYLESLGVTAIWILPFYPSPLRDDGYDIADYKSVNPDYGTIEDFRDFLEEAHRRGIKVITELVVNHTSDQHEWFKKARKAPKGSPERDFYVWSDDPTKYGEARIIFQDFEASNWTWDPVAGQYYWHRFFHHQPDLNFENPAVHQALFDVLDFWLGMGVDGLRLDAVPYLYEAEGTNCENLPQTFEFLRKLRSYVDEHYPNRMLLAEANQWPEDSAAYLGKGDMCHMNFHFPLMPRMYMALATEDRFPIIDILAQTPEIPESCQWASFLRNHDELTLEMVTDEERDYMRRVYAHDVKARINLGIRRRLAPLMSNDRRRIELMNIMLLSLPGTPVLYYGDEIGMGDNYYLGDRDGVRTPMQWNADRNAGFSRANPQRLLLPVIIDPEYHYEAVNVEVQESNPNSLLWWMRHTIATARRFRAFSRGTIEFLNANNPKVLMFIRSYEDETILTVINLSRNAQVINVDLSAYEGCVPEEIFSMNRFPRVHKTPYMVALGPYGYFWLRLIREESPADRSALLEKVALRAGSWQELFVGRSLDQFETAILPPYYKSVRWFGGKARNIIRIRVTDTVPVAGMENTAFAMTEVNYPSGENERYQLPLTFVPVERGNLADELFYRHAIARVELDGLEGFLIDASADETFRSRLLDLILHRETWSGAAGKITADAGKMLENSCLSTAGEEPPASHLMGLEQSNTSIRYGEQLCLKLYRKIDSGMAPEIEISRVLTDQTEYRNIPVYLGSFDYGKSYRERCSLGILQNFVPNESDGWQLSLGHVRRYYEDVLSRCSQGVLPPTLPELSGTTSKLPELIHELIGEFYFQMVGKLAERTAGMHRALGSVDTDAAFSPEPFTTLYQRSIYQAMTDQVKRSMIFLRESIHAVPKEARPLAHKLLDMQKEILEQFEPIRKEKIDTVKIRIHGDYHLGQVLYTGNDFVILDFEGEPARSLSERKIKRSVYRDLAGMLRSFDYAAFNVLMQNQAIRPEDRKALEPWAELWSYYVGQHFIDVYTQQTEGSGLIPKEPRQRELLLRSYLMNKAIYELNYELNNRPEWLPIPMNGILRLIRN

SEQ ID NO: 15564 - protein, 431 aa, Chlorobium tepidum TLS
MPVLTRSAELFEKAKKFIPGGVNSPVRAFKSVGGTPIYMAKGQGAYMTDVDGNTYLDYVGSWGPFILGSMHPRVTAAIEYTLRNIGTSFGTPIELEIEIAELLCKIVPSLEMVRMVNSGTEATMSAVRLARGYTGKDKIIKFEGCYHGHGDSFLIKAGSGVLTLGDPDSPGVTKGTANDTLNATYNDIESVKAIVNENKGQVAAIIIEPVAGNTGVIPAKKEFLVALRELCDAEGIVLIFDEVMCGFRVALGGAQELYGVTPDLTTMGKIIGGGLPVGAFGGKRHIMENIAPLGSVYQAGTLSGNPLALTAGLETLKILMEENPYPELERKAAFLEAGFKANMEKLGLNYTQNRVGSMACLFFTETPVVDYKSAITADTAKYGKYFHSMLDQGIYLAPSQFEAMFTSFAHTDEDLEKTVKANYNALVAATK

SEQ ID NO: 15565 - protein, 374 aa, Chlorobium tepidum TLS
MKQIADKHVYAVVMAGGIGSKLWPLSRKKSPKQFLHFFDGGTMIRKTVERIAGAVRRENILIITGKQHRRLVNDSLPDFDVDNIIIEPTIKDTATCIALATTFIRKRDPDAVTIVLPADHLVLDEEHFLKTVSKGVRLARKQRGLITVGIHPDRPETRYGYIQVEPSVMIGEENDDPDDDDIALFRVKTFAEKPDLATAEHFLQSQDFWWNSGVFIWHVDDISREYSRSLPDLYEDMQNVHAFIGTERQESVIEDVYSWVHPVSIAYGIMEKAEKVYMLAGNFGWTDLGCWDEVIKIGLGLEGRDMDGSESIMIDSKNVFVRKPHGKAVVSIGVDDIIVVDTPDALLICKAGESQKVVKAVEMMRREPGLEGFL

SEQ ID NO: 15566 - protein, 393 aa, Chlorobium tepidum TLS
MAKESYKRDKPHVNIGTIGHVDHGKTTLTAAITSVLAKQGMATLREFSDIDKAPEERERGITISTAHVEYQTAKRHYAHIDCPGHADYIKNMITGAAQMDGAILVVAGTDGPMPQTREHILLARQVNVPALVVFLNKVDIADPELLELVEMELRELLTEYGFPGDDIPIIKGSALKALEGDPEAEKQIMELMDAVDSYIPQPVRDIDKPFLMPVEDVFSISGRGTVGTGRIERGRIKVGDEVEIVGIKPTAKSVVTGIEMFQKTLDEGQAGDNAGLLLRGVDKNALERGMVIAKPGSITPHTKFKAEVYILKKEEGGRHTPFFNGYRPQFYFRTTDVTGSVTLPEGVEMVMPGDNLSIDVELIAPIAMEESLRFAIREGGRTVGAGSVTKIVE

SEQ ID NO: 15567 - protein, 397 aa, Chlorobium tepidum TLS
MQKKTLSDISLQGKRVLMRVDFNVPLDQDRNITDEKRIVEALPSIRKVIDNGGRLILMSHLGRPKGKVNPAFSLSPVAKRLSELLDCPVTMAGDCIGTEVMQQVLALQDGDVLMLENLRFHPEEEANDPDFARELASLGEIYVNDAFGTAHRAHASTEGITHFMQTAVAGYLIEKELRYLGTALNDAQRPFVAILGGAKISGKIDVLESLFEKVDTVLVGGAMVFTFFKAQGLDVGNSLVEENKLELAVSLLEKAKAKNVRLLLPEDVVVAGEISADAPSRVEPVSAISAGMIGLDIGPATIETYRKEILDAKTVLWNGPMGVFEIDQFARGTFAVAQALADATAEGAITIIGGGDSAAAIAKAGLSDKVTHVSTGGGASLEFLEGKELPGIAALND

SEQ ID NO: 15568 - protein, 469 aa, Luzula multiflora
IGFKAGVKDYKLTYYTPDYETKDTDILAAFRMTPQPGVPAEEAGAAVAAESSTGTWTTVWTDGLTSLDRYKGRCYHIEPVAGEDNQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAFYCRDNGLLLHIHRAMHAVIDRQKNHGMHFRVLAKALRMSGGDHIHSGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIRKAAKWSPELAAACEVWKEIKFEFEPVDKLDKAK

SEQ ID NO: 15569 - protein, 346 aa, Bacillus thuringiensis serovar israelensis
MMLRENIVDAIGNTPLVQLQLDSSARGNVFAKLEMLNPFGMKDRAAKKVILEAKKNGVLKDGAPIIESSSGTMALGLAMVGTYLGHPVHIVTDKRTDQMTLAKLKSLGCKLEIVTEMTHLGWQSARLDRLEEILKENKEAFCPRQYENSDNPNAYESLADEALEELGHIDILVASVGSGGSLCGTARALKKANPDLRVVAVDAVGSVIFNQPDIPGRLQGGHGNSVIPKNVDFSIIDEVHWLNDEECYAANLELAKCEKLFAGNSSAASYAVSRFLSSRCSEETNILTIFPDRGDRYYKTVYNEEYRKEKGMTNLNLHKQPKKVSYGMTVTSWSYASLQDNKMLTF

SEQ ID NO: 15570 - protein, 226 aa, Cucumis melo
MVCLETEARENLQIKEKFGHCLSYILPSTGNPVVHWPSYSKLYQQLCEGITLNNGTKIYWFDKKGKGNGYFLLPKSLSIAWIDDRRYWKWIFVELSGKKLEVAELIRVSWLDARGKIKEYMLSPGIVYEVLCHLLLKPGASGWHEPINFGLTFPDGKTYVNQESLECRPRDVWFTVKVGEFKVDDRHGCDSTKEYEFSMYNHGGHWKTEMILKGYEIRPKQSSCGC

SEQ ID NO: 15571 - protein, 154 aa, Cucumis melo
MAGQSTHYVAYPRAASITWSDDTRYWSWAPADFCGYPIEEARLLQVSWLDCRWSMDSSSFKQDLWYNVSIEVMMANTASGWDIPLNLEIDMPDGSKQESQIVLAGKQPNVWFKIPLGKFIISGSVTSGILRFGFYNHGGHWKRGLTVRALSIQA

SEQ ID NO: 15572 - protein, 268 aa, Populus alba
RATMIMRLKTKIQTLDEQMAAVSEKSSKYGQIAAEEIPKGLYCLGIRLTTEWFGNSNLHRRMNERMHIETKLRDDSLYHFCVFSDNILATSVVVNSTTLNSKNPDMVVFHLVTDEINYAAMKAWFSMNTFRGVTIEVQKFEDFKWLNASYVPVLKQLQDSETQSYYFSGHNNDGQTPIKFRNPKYLSMLNHLRFYIPEVFPALEKVVFLDDDVVVKKDLSGLFSIDLNSNVNGAVETCMETFHRYHKYLNYSHPLIREHFDPDACGCA

SEQ ID NO: 15573 - protein, 270 aa, Arabidopsis thaliana
MSSSPDIAGILDNTKELDRLRKEQEEVLVEINKMHKKLQATPEIVEKPGDISLSKLKNLYIQAKELSESEVTVSNILLTQLDSLLPSGPTGQQRRKLEGNEQKRKRMKVDTDVTRVSPSMRNQIEAYASLKGEQVAARVTAEDAEKDEWFVVKVIHFDRETKEVEVLDEEPGDDEEGGGQRTYKLSMSCILPFPKRNDPSSTQEFIPGKHVLAVYPGTTALYKATVISTPRKRKSDEYLLEFDDDEEDGALPQRTVPFHKVVALPEGHRQ

SEQ ID NO: 15574 - protein, 384 aa, Nicotiana tabacum
MCVQESEEVSEEMENLDISKSDENIKIGSLQVEDELGNTQKENCEKNTSSSFSVIRNSFPMESISEDTTIADRKQILSNKFLPTLRSGEWSDIGGRLDMEDTHICIADLAKNFGQSILGEEEAVSFYGVFDGHGGKGAALFVRDFLPRIIVEDADFPLKLEKVVSKSFLETDAAFAKSCSADSDLSSGTTALTAMIFGRSLLVANAGDCRAVLSRGGLAIEMSKDHRPCCVSERTRVESLGGFVDDGYLNGQLGVTRALGDWHIKGLKEVEKGGPLSAEPELKLLTLTKEDEFLIIGSDGIWDVFRSQNAVDFARRRLQEHNNAKLCCKEVVDEAKKRGAIDNLTVVMVCFHSEPPPTIVFQRSRIRKCISAEGLQNLRSLLDG

SEQ ID NO: 15575 - protein, 204 aa, Citrus unshiu
KLGDDEFGHMLVNILKQNNVKTEGVCFDNHARTALAFVTLKKNGEREFMFYRNPSADMLLKDSELNMGLIKQAKIFHYGSISLISEPCRSAHMAALKAAKDAGVLLSYDPNVRLPLWPSQDAARDGIKSIWNHADLIKVSDDEVNFLTKGGDAEKDDVVMSLWHDNLKLLLVTYGAKGCGYFTKKFKGRVPGFSVKTVDTTGAG

SEQ ID NO: 15576 - protein, 150 aa, Narcissus pseudonarcissus
KGRWEKPGHSPLFGYDFWYQPRHKTMISSSWGAPAAFTKGFNLQHVSDGLYGRHLNVYSWPDGELKQTMDLGNTGLLPLEIRFLHDPSKDTGFVGCALTSNMVRFFKTSDGSWSHEIAISVKPLKVKNWILPEMPGLITDFLISLDDRFL

SEQ ID NO: 15577 - protein, 395 aa, Fusobacterium nucleatum
METKKYGLGTTAIHAGTLKNLYGTLAMPIYQTSTFIFDSAEQGGRRFALEEAGYIYTRLGNPTTTVLENKIAALEEGEAAVATSSGMGAISSTLWTVLKAGDHVVTDKTLYGCTFALMCHGLTRFGIEVTFVDTSNLDEVKNAMKKNTRVVYLETPANPNLKIVDLEALSKLAHTNPNTLVIVDNTFATPYMQKPLKLGADIVVHSVTKYINGHGDVIAGLVITNKELADQIRFIGLKDMTGAVLGPQDAYYIIRGMKTFEIRMERHCKNAKKVVEFLNKHPKIERVYYPGLETHPGHEIAKKQMKDFGAMISFELKGGFEAGKTLLNNLKLCSLAVSLGDTETLIQHPASMTHSPYTKEEREAAGITDGLVRLSVGLENVEDIIADLEQGLEKI

SEQ ID NO: 15578 - protein, 333 aa, Nicotiana tabacum
MSKARVYTDINVLRPREYWDYESLTVQWGDQDDYEVVRKVGRGKYSEVFEGINVNSNEKCIIKILKPVKKKKIKREIKILQNLCGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLHKYRLELDPQLEAMVGRHSRKPWSKFINADNQHLVSPEAIDFLDKLLRYDHQSRLTAKEAMAHTYFLQVRAAETSRMRTQ

SEQ ID NO: 15579 - protein, 333 aa, Nicotiana tabacum
MSKARVYTDINVLRPREYWDYESLTVQWGDQDDYEVVRKVGRGKYSEVFEGINVNSNEKCIIKILKPVKKKKIKREIKILQNLCGGPNIVKLLDIVRDQHSKTPSLIFEYVNSTDFKVLYPTLTDYDIRYYIYELLKALDYCHSQGIMHRDVKPHNVMIDHELRNLRLIDWGLAEFYHPGKEYNVRVASRYFKGPELLVDLQDYDYSLDMWSLGCMFAGMIFRKEPFFYGHDNQDQLVKIAKVLGTDELNAYLHKYRLELDPQLEAMVGRHSRKPWSKFINADNQHLVSPEAIDFLDKLLRYDHQSRLTAKEAMAHTYFLQVRAAETSRMRTQ

SEQ ID NO: 15580 - protein, 312 aa, Nicotiana tabacum
ESLTVQWGDQDDYEVVRKVGRGKYSEVFEGINVNSNEKCIIKILKPVKKKKIKREIKILQNLCGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLHKYQLELDPQLEAMVGRHSRKPWSKFINADNQHLVSPEAIDFLDKLLRYDHQSRLTAKEAMAHPYFLQVRAAETSRMRTQ

SEQ ID NO: 15581 - protein, 222 aa, Phanerochaete chrysosporium
TLTFVIYFLTQHPDVLQRLRQEILDVVGPSNLPTYDDIKQMKYLRAVLNETQRLYPPVPWNMRYAVEDSIVPNSEPEGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRAHLTLYSEGGMWVKMREAQAMGQVA

SEQ ID NO: 15582 - protein, 205 aa, Citrus unshiu
KLGDDEFGYMLANILKENNVDTSGVRYDSTARTALAFVTLRADGEREFLFFRHPSADMLLCESELDKNLIKQGSIFHYGSISLIAEPCRSTQLAAMNLAKESGSILSYDPNLRLPLWPSEEAARKGIMSIWDQADIIKVSDDEITFLTGGDDHNDDNVVLEKLFHPNLKLLIVTEGSKGCRYYTKEFKGRVPGVKTKAVDTTGAG

SEQ ID NO: 15583 - protein, 323 aa, Arabidopsis thaliana
MEDRCLIKNDITELIGNTPMVYLNNVVDGCVARIAAKLEMMEPCSSVKDRIAYSMIKDAEDKGLITPGKSTLIEPTAGNTGIGLACMGAARGYKVILVMPSTMSLERRIILRALGAELHLSDQRIGLKGMLEKTEAILSKTPGGYIPQQFENPANPEIHYRTTGPEIWRDSAGKVDILVAGVGTGGTATGVGKFLKEQNKDIKVCVVEPVESPVLSGGQPGPHLIQGIGSGIVPFNLDLTIVDEIIQVAGEEAIETAKLLALKEGLLVGISSGAAAAAALKVAKRPENAGKLIVVVFPSGGERYLSTKLFDSIRYEAENLPIE

SEQ ID NO: 15584 - protein, 443 aa, Thermotoga neapolitana
MKYDVVIVGGGPAGLVAAFTTKRFYKDKKILVVKKTEKETVPCGIPYIFHTLSGVENDYMGIEERFKSAGIDLLIDVVVDGNTDEKKLLTKTGKEIFYEKLIIATGSTPNVPNIPGVDLEGVFTVPKDANYLKMLYEKIKDSKNVVIIGGGFIGVEVADELKKSGKNVTLVEIMDSLLPVSFDPDFGEIARKEIEAENLKVLTGRKVTEIYGSKRVEGVRLDNAETILADAVILATGYRPNSDLARKLGLKVTEYGFIETDEYMRTSKPDVFAAGDCVQHRDFLTGRPSRLMLASAAVLDARIAASNLYGLKVIRANKGSLNAYSTVIGSKAFGSVGITERVAKEEGFEIVVGRAEAPDRHPGKFEDTTKLIVKLIFSEDSKILLGAQVCGGKSVGEIVNILSLGMQKGITANDLFTMQIGTHPLLTSAPTVYPLAKAAEMVL

SEQ ID NO: 15585 - protein, 261 aa, Psidium guajava
NWGFFELVNHGIPPEMMDTIERMTKGHYKKCMEQRFRELVVSKGLEYVQKEVHDLDWESTFHLKHLPESNISQISDLDDDYRKVMKEFAVKLEKLAEQLLDLLCENLGLEKGYLKKAFYGSNGPTFGTKVSNYPPCPKPDLIKGLRAHTDAGGIILLFQDDKVSGLQLLKDGQWVDVPPMHHSIVVNLGDQLEVITNGKYKSVLHRVVAQTDGNRMSIASFYNPSTDAVIYPAPALVEREEEEAGKGTYPKFVFEDYMKLR

SEQ ID NO: 15586 - protein, 474 aa, Synechococcus sp.
MAYTQSKSQKVGYQAGVKDYRLTYYTPDYTPKDTDILAAFRVTPQPGVPFEEAAAAVAAESSTGTWTTVWTDLLTDLDRYKGRCYDIEPLPGEDNQFIAYIAYPLDLFEEGSVTNMLTSIVGNVFGFKALKALRLEDLRIPVAYLKTFQGPPHGIQVERDKLNKYGRPLLGCTIKPKLGLSAKNYGRAVYECLRGGLDFTKDDENINSQPFQRWRDRFLFVADAIHKAQAETGEIKGHYLNVTAPTCEEMLKRAEFAKDWNAIIMHDFLTAGFTANTTLSKGCRDNGMLLHIHRAMHAVMDRQKNHGIHFRVLAKCLRMSGGDHIHTGTVVGKLEGDKAVTLGFVDLLRENYIEQDRSRGIYFTQDWASMPGVMAVASGGIHVWHMPALVDIFGDDAVLQFGGGTLGHPWGNAPGATANRVALEACIQARNEGRDLMREGGDIIREAARWSPELAAACELWKEIKFEFEAQDTI

SEQ ID NO: 15587 - protein, 306 aa, Fusobacterium nucleatum
MLANSVIDLIGNTPLVKINNINTFGNEIYVKLEGSNPGRSTKDRIALKMIEEAEKEGLIDKDTVIIEATSGNTGIGLAMICAVKNYKLKIVMPDTMSVERIQLMRAYGTEVILTDGSFGMKACLEKLEELKKQEKKYFIPNQFTNVNNPKAHYETTAEEILRDMDNKVDVYICGTGTGGSFSGTAKKLKEKLPNIKTYPVEPASSPLLSKGYIGPHKIQGMGMSIGGIPVVYDGSLADGILVCEDDEAFKMMRELSFKEGILAGISTGATLKAALDYSKENANKSLRIVVLSTDSGEKYLSSSHGL

SEQ ID NO: 15588 - protein, 463 aa, Delftia acidovorans
MNTVDITEIIEKQKPNRKVLALLILSFLIMFCDGYDLQAIAFASPTIIADWGIQKASFGFIFSGGLFGVMVGGFLFGYVADRIGRRPALLWGTLLFGVFTLAAVLATNITQLAVLRFVAGLGIGGITPIAIALNVEYAPKRFRASVVGLVMIGYVVGTSSGGIFAAWLVPTFGWQVLFYIGGLAPLLLLPFLAMSLPESIKYLVLSGQKAEAVARVVNAIDPSIRASSQTRFVLGTAEESARIAGWKDSVKALFGGQLSKITPALWGAFVCSSVTVFFLASWIPVLTVGTGRSASLAAVGLALFSAGGAFGGIFSSRIIDRFGIGAMASIPLIAAVFVVSVGSFEFSDTGFLSMLCLIGFFVLGGHVGLMGAMGLFYSNANRANGVGWAISIGKFGSIIGPAIAAVLIAANTAISYLFMAAAAPLLMAGMGILVLGRLQKAADHEHRMSADRANDPEARPIVA

SEQ ID NO: 15589 - protein, 326 aa, Dunaliella salina
MAFALRTGVAPSVLPRGQSRRQMVCRAGKFDEELMKTARTIASPGRGILAMDESNATVGKRLDSIGLENSEANRQAYREMLVSTKGLGQYISGAILFEETLYQSGSNGKRMTDILVENGIVPGIKVDKGLAPLANSNNEQWAMGLDGLDTRCAEYYKTGARFAKWRSVVSIPNGPSPIAVRETAYGLARYAAICQNNGLVPIVEPEILLDGDHDINRCLAVFEDVWAETFKYLADNKVLFEGILLKPSMVTPGAESPARATPQQVAEMTLIGLKRRVPPAVPGIMFLSGGQSELEATLNLQEMNPPNPTLGQVSFLLTPVPCRTPC

SEQ ID NO: 15590 - protein, 304 aa, Anabaena sp.
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 15591 - protein, 377 aa, Pseudomonas putida
MPDTSFSNPGLFTPLQLGSLSLPNRVIMAPLTRSRTPDSVPGRLQQIYYGQRASAGLIISEATNISPTARGYVYTPGIWTDAQEAGWKGVVEAVHAKGGRIALQLWHVGRVSHELVQPDGQQPVAPSALKAEGAECFVEFEDGTAGLHPTSTPRALETDGIPGIVEDYRQAAQRAKRAGFDMVEVHAANACLPNQFLATGTNRRTDQYGGSIENRARFPLEVVDAVAEVFGPERVGIRLTPFLELFGLTDDEPEAMAFYLAGELDRRGLAYLHFNEPDWIGGDITYPEGFREQMRQRFKGGLIYCGNYDAGRAQARLDDNTADAVAFGRPFIANPDLPERFRLGAALNEPDPSTFYGGAEVGYTDYPFLDNGHDRLG

SEQ ID NO: 15592 - protein, 361 aa, Erwinia chrysanthemi
AELVSDKALESAPTVGWASQNGFTTGGAAATSDNIYIVTNISEFTSALSAGAEAKIIQIKGTIDISGGTPYTDFADQKARSQINIPANTTVIGLGTDAKFINGSLIIDGTDGTNNVIIRNVYIQTPIDVEPHYEKGDGWNAEWDAMNITNGAHHVWIDHVTISDGNFTDDMYTTKDGETYVQHDGALDIKRGSDYVTISNSLIDQHDKTMLIGHNDTNSAQDKGKLHVTLFNNVFNRVTERAPRVRYGSIHSFNNVFKGDAKDPVYRYQYSFGIGTSGSVLSEGNSFTIANLSASKACKVVKKFNGSIFSDNGSVLNGSAVDLSGCGFSAYTSKIPYIYDVQPMTTELAQSITDNAGSGKL

SEQ ID NO: 15593 - protein, 469 aa, Salmonella typhimurium
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 15594 - protein, 448 aa, Bacillus subtilis
MTHDLIEKSKKHLWLPFTQMKDYDENPLIIESGTGIKVQDINGKEYYDGFSSVWLNVHGHRKKELDNAIKKQLGKIAHSTLLGMTNVPATQLAETLIDISPKKLTRVFYSDSGAEAMEIALKMAFQYWKNIGKPEKQKFIAMKNGYHGDTIGAVSVGSIELFHHVYGPLMFESYKAPIPYVYRSESGDPDECCDQCLRELEQLLKEHHEEIAALSIESIVQGASGMIVMPEGYLAGVRELCTTYDVLMIVDEVATGFGRTGKMFACEHENVQPDLMAAGKGITGGYLPIAVTFATEDIYKAFYDDYENLKTFFHGHSYTGNQLGCAVALENLALFESENIVEQVAEKSKKLHFLLQDLHALPHVGDIRQLGFMCGAELVRSKETKEPYPADRRIGYKVSLKMRELGMLTRPLGDVIAFLPPLASTAEELTEMVAIMKQAIHEVTSLEN

SEQ ID NO: 15595 - protein, 337 aa, Oryza sativa (japonica cultivar-group)
MSAVEMKTACVTGGNGYIASALIKMLLQKGYAVNTTVRNPGDDMKKTSHLKDLEALGPLEVFRADMDEEGSFDDAVAGCDYAFLVAAPVNFQSQNPEKELIEAGVQGTMNVMRSCVRAGTVKRVILTSSAPAVSGRPLQGDGHVLDEDSWSDVEYLTKEKPPAWAYSVSKVLMEKAACKLAEENNISLITVFPVFTLGAAPTPTAATSVSAMLSLLSSDETQLKTLKGLAATGPIPTVHVDDLCRAEVFVAEKESASGRYICSSLSTTVVAFARFVAGKHPRYNVKTDGFQGFPEKPRVCYSSEKLVREGFEFKWTDLDEVFDDLIEYGNVLGILPQ

SEQ ID NO: 15596 - protein, 337 aa, Oryza sativa (japonica cultivar-group)
MSAVGMKTACVTGGNGYIASALIKMLLQKGYAVNTTVRNPDDMRKNSHLKGLEALGTLKVFRADLDEDGSFDEAVNGCDYAFLVAAPVNLQSENPEKEMIEAGVQGTLNVMRSCLRAGTVKRVILTSSAAAVALRPLQGGVGHVLDESSWSDVDYLTREKPPSWAYGVSKVLLEKAACKFAEENDISLITVLPVFTLGAAPTPLTTTSIPTTLSLLSGDEAQLKTLKGLAATGSIPVVHVDDVCRAEIFLAEKESASGRYICSSLSTTVMALARFAAAKYPQYNVQTDCFEGFPEKPRVCYSSEKLTREGFEFKWTDLDEIFGDLVEYGKALGILPH

SEQ ID NO: 15597 - protein, 352 aa, Lagenaria siceraria
MVPPYALDSLYCSEDHWENDDEEEERGFHEQPYSNLTTESSSPILAVAEQDLFWENDELISLFSREKPNELFKTIQIDPSLAAARRSAVGWMLKVNAHYSFSALTAVLAVDYLDRFLSCFHFQRDKPWMSQLAAVACISLAAKVEETQVPLLLDLQVEDSRYLFEAKTIKKMELLVLSTLQWRMNPVTPFSFVDYISRRLGFKEHICWEILWQCERTILSVILESDFMSFLPSVMATATMLHVFKAMEEPTLSVEYDSQLLNILGIDKGNVEECCKLISNASRRNGNQFKKRKIGSIPGSPNGVMDVSFSSDSSNDSWSVASSVSSSPEPLTKKNRANGSMSGDCETFRTLS

SEQ ID NO: 15598 - protein, 380 aa, Lagenaria siceraria
MKKMALHSNKHRTQRLHNSLFFFDFLHCTEQQHLQTEHPIFLNNGGTNDFPLFQQTTTHFLVYEDEELNHLLSKEKDQNLQTGAVLKTLVQTDNALSLARTEAIDWLLKVNAFYGFSSLTALLAINYLDRILSGPYFQRDKPWMLQLAAVTCISLAAKVEEIRVPLLLDLQVEDSKYIFEAKTIQRMELLVLTALQWKMHPVAPVSFLGIITKGLGMKNQYIQREFLRRCERILLSLVSDSRSVGILPSIMAVSAMVSVVEEMGNCNPLEEFQDQLLNALKINKGRVKECCKVIMEAKIKGSGKRKHVEEEAEAEAESESSEAETEGEAEAEAGSPNGVMEANFSCESSNDSWEMGTIVSEYTHFSSSSSSSSKRIRPTR

SEQ ID NO: 15599 - protein, 154 aa, Cucumis melo
MAGQSTHYVAYPRAASITWSDDTRYWSWAPADFCGYPIEEARLLQVSWLDCRWSMDSSSFKQDLWYNVSIEVMMANTASGWDIPLNLEIDMPDGSKQESQIVLAGKQPNVWFKIPLGKFIISGSVTSGILRFGFYNHGGHWKRGLIVRALSIQA

SEQ ID NO: 15600 - protein, 154 aa, Cucumis sativus
MAGQSTHYLAFPRASTITWGDDTRYWSWATVDFCSYAIEEARLLQVSWLDCRWSMDASDFKQDIWYNASVEVMLTSNASGWNVPLHLEIELPDGSTQKSQIVLAGRQPNVWFKIPIGKFILSGSLTSGTIRFGFYNHEGNWKRGLNIRALAIQA

SEQ ID NO: 15601 - protein, 155 aa, Cucumis sativus
MAGQSTHYLAFPRASTITWGDDTRYWSWATVDFCSYAIEEARLLQVSWLDCRWSMDVSDFKKDIWYNASVEVMLTSNASGWNVPLYLEIELPGSEQQSQIVLEGRQPNVWFKISLGKFILSGSLTSGTIRFGFYNHEGNWKRGLNIRALAIQAQK

SEQ ID NO: 15602 - protein, 154 aa, Cucumis sativus
MAGQSTHYLAFPRASTITWGDDTRYWSWATVDFCSYAIEEARLLQVSWLDCRWSMDASDFKQDIWYNASVEVMLTSNASGWNVPLHLEIELPDGSKQESQIVLAGRQPNVWFKIPIGKFILRGSLTSGTIRFGFYNHEGNWKRGLNIRTLAIQA

SEQ ID NO: 15603 - protein, 1501 aa, Candida dubliniensis
MSDSKMSSQDESKLERATSQDSSSENHSINEYHGFDAHTSENIQNLARTFTHDSFKDDSSAGLLKYLTHMSEVPGVNPYEQEEINNEQLDPDSENFNAKFWVKNLRKLFESDPEYYKPSKLGIGYKNLRAYGVANDSDYQPTVTNALWKLATEGLRHFQKDDESRYFDILKSVDAIMRPGELTVVLGRPGAGCSTLLKTIAVNTYGFHIGKESQITYDGLSPKDIEHHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFEKMGWKCPQRQTTADFLTSLTNPAEREPLPGYEDKVPRTPQEFEAYWKNSPEYAELIQEIDEYFVECEKSNTRETYRESHVAKQSNNTRPASPYTVSFFMQVRYGVARNFLRMKGDPSIPIFSVFGQLVMGLILSSVFYNLNQTTGSFYYRGASMFFAVLFNAFSSLLEIMSLFEARPIVEKHKKYALYRPSADALASIISELPVKLAMSMSFNFVFYFMVNFRRNPGRFFFYWLMCVWCTFVMSHLFRSIGAVSTSIAGAMTPATVLLLAMVIYTGFVIPTPSMLGWSRWINYINPVGYVFEALMVNEFHGREFQCAQYVPSGPGFENVSRSNQVCTAVGSIPGNEMVSGTNYLAGAYQYYNSHKWRNLGITIGFAVFFLAIYIALTEFNKGAMQKGEIVLFLKGSLKKHKRKTAAAKKGDIEAGPVSGKLDYQDEAEAVSNEKFTEKGSTGSVDFPENREIFFWKDLTYQVKIKKEDRVILDHVDGWVKPGQITALMGASGAGKTTLLNCLSERVTTGVITDGERLVNGHALDSSFQRSIGYVQQQDVHLPTSTVREALQFSAYLRQSNKIPKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVRDEISRMEVELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVVVGTIAFFCWYYPLGLYSNATPTDSVNPRGVLMWMLVTSFYVYTSTMGQLCMSFSELADNAANLATLLFTMCLNFCGVLAGPSVLPGFWIFMYRCNPFTYLIQAMLSTGLANTFVRCADREYVSVQPPNGQTCSSYLDPYIKMAGGYFETNNDGSCSFCQMSSTNTFLKSINSLYSERWRNFGIFIAFIAINIILTVLFYWLARVPKGNREKKNKK

SEQ ID NO: 15604 - protein, 1500 aa, Candida dubliniensis
MSTTSNTSLSQQLDEKPWVDVSDDSSVQEYQGFDATASHNIQDLARKLTHDSTKGDHHAANNLARYLSHMSDIPGVSPFNGNINHEQLDPDSENFNAKYWVKNLKKLFDSDSEYYKPSKLGVAYRNLRAFGVANDSDYQPTVTNALWKFTTEAINKLKKPDDSKYSDILKSMDAIMRPGELTVVLGRPGAGCSTLSKTISANTYGFNIGKESHITYDGLTPKDIESNYRGDVIYSAETDYHFPHLSVGDTLEFAARLRTPQNRGEGIDRETYAKHMANVYMATYGLSHTRNTKVGNDFVRGVSGGERKRVSIAEASLSGANIQCWDNATRGLDSATALEFIRALKTSAVILDTTPLIAIYQCSQDAYDLFDNVVVLYEGHQIFFGRASKAKEYFEKMGWKCPQRQTTADFLTSLTNPAEREPLPGYEDKAPRTAQEFEVYWKNSPEYAALVGEIDNHLIECEKSNTKSYYHETHVAKQSNNTRPSSPYTVSFFMQVRYVMARNFLRMKGDPSIPLVSILTQLVMGLILASVFFNLRKSTDTFYFRGGALFFSVLFNAFSSLLEILSLYEARPIVEKHRKYALYRPSADALASIISELPVKLLMTMSFNIVYYFMVNLRRTPGNFFFYWLMCALCTLVMSHLFRSIGAVTTTIATAMSISTVFLLAMIIYAGFVLPIPYILGWSKWIRYINPVTYIFESLMVNEFHGREFKCGQYIPSGPGYESLSVENKVCTTVGSTPGSTVVQGTEYIKLAYQFYSSHKWRNFGITVAFAVFFLGVYVALTEFNKGAMQKGEIVLFLRGSLKKHKRKTAASNKGDIEAGPVSGKLDYQDEAEAVSNEKFTEKGSTGSVDFPENREIFFWKDLTYQVKIKKEDRVILDHVDGWVKPGQITALMGASGAGKTTLLNCLSERVTTGVITDGERLVNGHALDSSFQRSIGYVQQQDVHLETTTVREALQFSAYLRQSKKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPEEANPAEWMLQVVGAAPGSHSKQDYFEVWRNSSEYQAVKDEISRMEVELSKLPRDNDPEALLKYAAPLWKQYLLVSWRTIVQDWRSPGYIYSKIFLVVSSSLFIGFSFFKSKNNLQGLQSQMLAVFMFFIPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISFNELIDNAASLATTLFTLCLMFCGVLAGPDVIPGFWIFMYRCNPFTYLIQAILSTGLANAKVTCAPRELVTLKPPMGETCSSFIGPYTKAAGGYFSTNSDGTCSVCRIDSTNQFLESINAMFSQRWRNFGIFVAFIAINIILTIFFYWLAKVPKGNREKKMKK

SEQ ID NO: 15605 - protein, 283 aa, Clostridium perfringens
MELWYTEEHTDKVRFSIKVDEQLYSGKSDFQRIDVFKSQEFGTFFTLDGLMMVTEKDEFIYHDMIVHVPMATNPNIKNVLVIGAGDGGTVRELTRYETIEKIDMVEIDKLVVDVCREYLPQTANKLDDPRVSLFFEDGLKFVRSVENKYDLIIVDSTDPFGPGEGLFTREFYGNCFKALKEDGILVNQHESPYYEEYARGMKRAHKRIKECFPVCRVYQAHIPTYPSGHWLFGFASKKYDPLNADIEKWNDLGLKTKYYNTDLHKGCFALPNYVKEMLENVDE

SEQ ID NO: 15606 - protein, 499 aa, Aspergillus oryzae
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEYCWLGDNTVSLLDLDTTKDVVKNEWYDWVGSLVSNYSIDGLRIDTVKHVQKDFWPGYNKAAGVYCIGEVLDVDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 15607 - protein, 499 aa, Ipomoea batatas
MAPIPGVMPIGNYVSLYVMLPLGVVNADNVFPDKEKVEDELKQVKAGGCDGVMVDVWWGIIEAKGPKQYDWSAYRELFQLVKKCGLKIQAIMSFHQCGGNVGDAVFIPIPQWILQIGDKNPDIFYTNRAGNRNQEYLSLGVDNQRLFQGRTALEMYRDFMESFRDNMADFLKAGDIVDIEVGCGAAGELRYPSYPETQGWVFPGIGEFQCYDKYMVADWKEAVKQAGNADWEMPGKGTGTYNDTPDKTEFFRPNGTYKTDMGKFFLTWYSNKLIIHGDQVLEEANKVFVGLRVNIAAKVSGIHWWYNHVSHAAELTAGFYNVAGRDGYRPIARMLARHHATLNFTCLEMRDSEQPAEAKSAPQELVQQVLSSGWKEYIDVAGENALPRYDATAYNQILLNVRPNGVNLNGPPKLKMSGLTYLRLSDDLLQTDNFELFKKFVKKMHADLDPSPNAISPAVLERSNSAITIDELMEATKGSRPFPWYDVTDMPVDGSNPFD

SEQ ID NO: 15608 - protein, 499 aa, Ipomoea batatas
MAPIPGVMPIGNYVSLYVMLPLGVVNADNVFPDKEKVEDELKQVKAGGCDGVMVDVWWGIIEAKGPKQYDWSAYRELFQLVKKCGLKIQAIMSFHQCGGNVGDAVFIPIPQWILQIGDKNPDIFYTNRAGNRNQEYLSLGVDNQRLFQGRTALEMYRDFMESFRDNMADFLKAGDIVDIEVGCGAAGELRYPSYPETQGWVFPGIGEFQCYDKYMVADWKEAVKQAGNADWEMPGKGAGTYNDTPDKTEFFRPNGTLQDGYGQVFLTWYSNKLIIHGDQVLEEANKVFVGLRVNIAAKVSGIHWWYNHVSHAAELTAGFYNVAGRDGYRPIARMLARHHATLNFTCLEMRDSEQPAEAKSAPQELVQQVLSRQVKEYIDVAGENALPRYDATAYNQMLLKLRPNGVNLNGPPKLKMSGLTYLRLSDDLLQTDNFELFKKFVKKMHADLDPSPNAISPAVLERSNSAITIDELMEATKGSRPFPWYDVTDMPVDGSNPFD

SEQ ID NO: 15609 - protein, 496 aa, Oryza sativa (japonica cultivar-group)
MAKRHLLLVTTCLWALSCALLLHASSDGFLRVNLNKKRLDKEDLTAAKLAQQGNRLLKTGSSDSDPVPLVDYLNTQYYGVIGLGSPPQNFTVIFDTGSSNLWVPSAKCYFSIACYLHSRYNSKKSSSYKADGETCKITYGSGAISGFFSKDNVLVGDQVVKNQKFIEATRETSVTFIIGKFDGILGLGYPEISVGKAPPIWQSMQEQELLADDVFSFWLNRDPDASSGGELVFGGMDPKHYKGDHTYVPVSRKGYWQFNMGDLLIDGHSTGFCAKGCAAIVDSGTSLLAGPTAIVAQVNHAIGAEGIISTECKEVVSEYGEMILNLLIAQTDPQKVCSQVGLCMFDGKRSVSNGIESVVDKENLGSDAMCSVCEMAVVWIENQLRENKTKELILNYANQLCERLPSPNGESTVSCHQISKMPNLAFTIANKTFILTPEQYIVKLEQGGQTVCISGFMAFDIPPPRGPLWILGDVFMGAYHTVFDFGKDRIGFAKSA

SEQ ID NO: 15610 - protein, 413 aa, Thauera sp. DNT-1
MIKSIVIVGAGLAGTTAARALRARGYAGRIHLIGNESQLPYDRPSLSKGVLGGAQEIPPLLMEAAWFESEGIELHLGDPVFAINAKERLVTLHSGLSLDFDRLLFATGMRPRKLSIPGGNLEGVFSLRNFADCAALRQAFTAAKSLVIIGGGLIGCEVATSARKAGLEVTILECADELLTRVLGRQIGAWCREQLEAMGVRIELNAHISHLSGERSVRSLVFADGREVEAELVLVSIGGDPEDTLLNAAGVACNQGVVVDACGQTSSPDIYAAGDVAVWPLRHGGRRALETYINSQQQAEAAVAAMLGEYNPVPQVATSWTEIAGHRIQMIGDMQGPGEYVQRGEFEPNQQTVLFRVLDGKALAAVAINSTKDFGGVSRLVMSEIEIVPDHLADTDISIRELLKGNAARTVTA

SEQ ID NO: 15611 - protein, 483 aa, Pseudomonas putida
MKTKLFINNAWIDSSDQQTFERKHPVNSEVMTESANATVTDAIKAAQVAEEAFKTWKDVGPSERRRLLLKVADVMESKTPKFIEVMAMEVGASALWAGFNVHASANVFREAASLATQIQGETIPTDKAETLSMTLRQPVGPILSIVPWNGTAVLAARAIAYPLVCGNTVVFKGSEFSPATHALITQCVQEAGLPAGVLNYLNSSPDRSPEIADALISAKEIRRINFTGSTRVGSIIAQKAAQHLKRCLLELGGKSPLIVLDDANIDAAVKAAVFGSFLFQGQICMSTERLVVDEKIADEFVAKFVEKTKRLSVGDPCVTGDCIIGPMVSPNSGERINGLFKDAIDKGAKVVCGGMAQGAVMPATILDHVKSDMRIYDEETFGPITVVIRCKGEAEAIRIANDSVYGLSSGVFGRDINRALRVGMSIEYGCVHINGSTVQNEAQAPYGGTKNTGYGRFDGRAVVDEFTELKWLTIEPFEQQYPF

SEQ ID NO: 15612 - protein, 338 aa, Streptococcus pyogenes MGAS315
MKAVVVNQASTGVEVVEHDLPNVGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADIVVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVVPVVEKVPVDTAPEVFDEMERGLIQGRKVLDFIS

SEQ ID NO: 15613 - protein, 467 aa, Streptococcus pyogenes MGAS315
MNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVNFINFTGSTPIGEGIGKLAGMRPIMLELGGKDSAIVLEDADLVLAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAIKISNESEYGLQASIFTTNFPKAFGIAEQLEVGTVHLNNKTQRGTDNFPFLGAKKSGAGVQGVKYSIEAMTTVKSVVFDIQ

SEQ ID NO: 15614 - protein, 244 aa, Streptococcus pyogenes MGAS315
MTEAIISIKDLHKYYGHNEVLKGIDLDIMPGEVVVIIGPSGSGKSTLLRTMNLLEVPTKGQIRFEGIDITDKKNDIFSMREKMGMVFQQFNLFPNMTVLENITLSPIKTKGMAKAEADKTALSLLDKVGLSEKAKAYPASLSGGQQQRIAIARGLAMDPDVLLFDEPTSALDPEMVGEVLAVMQDLAKSGMTMVIVTHEMGFAKEVADRVIFMDGGVIVEEGSPNQLFDLTKEERTKDFLSRVL

SEQ ID NO: 15615 - protein, 307 aa, Petunia x hybrida
MDQYEKVEKIGEGTYGVVYKARDRVTNETIALKKIRLEQEDEGVPSTAIREISLLKEMQHANIVRLQDVVHTVKSDCILSFEYLDLDLKKHMDSSPEFSKDPRLVKMFLYQILRGIAYCHSHRVLHRVLHRDLKPQNLLIGRRTNALKLADFGLARAFGIPVRTFTHEVVTLWYRAPEILLGSRHYSTPVDVWSVGCIFAEMVTQRPLFPGDSEIDELFKIFRVMGTPNEDTWPGVTTLPDFKSALPKWPSKDLATIVPNLDGAGLDLLDKTVRLDPSKRITARNALEHEYFKDIGYVFRSKGSSRV

SEQ ID NO: 15616 - protein, 459 aa, Streptococcus pyogenes MGAS315
MSIKEQTDNNELENGMVRGLENRHVQLIAIAGTIGTGLFLGAGRSIALTGPSIIFVYMITGAFMFMMMRAIGEMLYYDPDQHTFINFISKYIGPGWGYFSGLSYWISLIFIGMAEITAVGAYVQFWFPSWPAWLIQLVFLVLLSSINLIAVRVFGETEFWFAMIKILAILALIATAIFMVLTGFETHTGHASLSNIFDHFSMFPNGKLKFFMAFQMVFFAYQAIEFVGITTSETANPRKVLPKAIQEIPTRIVIFYVGALVSIMAIVPWHQLPVDESPFVMVFKLIGIKWAAALINFVVLTSAASALNSTLYSTGRHLYQIANETPNALTNRLKINTLSRQGVPSRAIIASAVVVGISALINILPGVADAFSLITASSSGVYIAIYALTMIAHWKYRQSKDFMADGYLMPKYKVTTPLTLAFFAFVFISLFLQESTYIGAIGATIWIIVFGIYSNVKFK

SEQ ID NO: 15617 - protein, 247 aa, Streptococcus pyogenes MGAS315
MITIRNLSKTFSGQKVLDSLALDIEKGQVIALVGASGAGKSTFLRSLNYLEKPDSGSISIGDFTVDFETITTEQVLILRRKLAMVFQQFNLFERRTALENIKEGLKVVKKLSDQEATKLAQAELTKVGLADRKHHYPRHLSGGQKQRVALARALAMKPDVLLLDEPTSALDPELVGEVEKSITDAAKSGQTMVLVSHDMNFVYQVADRVLFLDQGKILEQGTPEEVFRHPQKERTKEFFASYSKTYI

SEQ ID NO: 15618 - protein, 486 aa, Streptococcus pyogenes MGAS315
MEKFFKLSENGATVSTEIMAGLTTFFAMSYILFVNPSILGAAGMPSNAVFLATIIAAAISTLIMGLFANVPYALAPGMGLNAFFTYTVVFALGFSWQEALAMVFICGLFNIFITVTKFRKSIIKAIPVSLQHAIGGGIGVFVAYLGFKNANIITFSISAENIVMVNGVEPAKASAKTFADGLLFVDANGGVVPTISSFTDSSVLLAIFGLLLTTALVIRNFRGAILIGIVATTLVGIPLGIVDVSNLNFGIGHIGEAWTELGTTFLAAFDGLSSLFSDSSRLPLVFMTIFAFSLSDTFDTIGTFIGTGRRTGIFSQDDENALENSIGFSSKMDRALFADAIGTSIGALVGTSNTTTYVESAAGIAEGGRIGLTAVSTAVCFLLSILLLPLVGIVPAAATAPALIVVGVMMVSSFLDVNWSKFADALPAFFAAFFMALCYSISYGIAAAFIFYCLVKVVEGKTKDIHPIIWGATFLFIVNFIILTIL

SEQ ID NO: 15619 - protein, 396 aa, Streptococcus pyogenes MGAS315
MSDFLFFIESFYGLVSYIMNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYNLDISFTQAALGDTVEIPTVHGDVEMAIPAGTQTGKTFRLKGKGAPKLRGGGQGDQHVTVNIVTPTKLNDAQREALQAFAEASGEKMLHPKKKGFFDKVKDALEDI

SEQ ID NO: 15620 - protein, 404 aa, Streptococcus pyogenes MGAS315
MKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISISLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 15621 - protein, 464 aa, Arabidopsis thaliana
MVSLIVVKLFHWIYQSKNPKPNEKLPPGSMGFPIIGETFEFMKPHDAFQFPTFIKERIIRYGPIFRTSLFGAKVIISTDIELNMEIAKTNHAPGLTKSIAQLFGENNLFFQSKESHKHVRNLTFQLLGSQGLKLSVMQDIDLLTRTHMEEGARRGCLDVKEISSKILIECLAKKVTGDMEPEAAKELALCWRCFPSGWFRFPLNLPGTGVYKMMKARKRMLHLLKETILKKRASGEELGEFFKIIFEGAETMSVDNAIEYIYTLFLLANETTPRILAATIKLISDNPKVMKELHREHEGIVRGKTEKETSITWEEYKSMTFTQMVINESLRITSTAPTVFRIFDHEFQVGSYKIPAGWIFMGYPNNHFNPKTYDDPLVFNPWRWEGKDLGAIVSRTYIPFGAGSRQCVGAEFAKLQMAIFIHHLSRDSQSFYLHVIYLIYGLKVVNEDRNHNTSKLCTHVSKWM

SEQ ID NO: 15622 - protein, 354 aa, Arabidopsis thaliana
MSAESCFGSSGDQSSSKGVATHGGSYVQYNVYGNLFEVSRNAATNSETGEEVAIKKIGNAFDNIIDAKRTLREIKLLKHMDHENVIAVKDIIKPPQRENFNDVYIVYELMDTDLHQIIRSNQPLTDDHCRLLRGLKYVHSANVLHRDLKPSNLLLNANCDLKLGDFGLARTKSETDFMTEYVVTRWYRAPELLLNCSEYTAAIDIWSVGCILGETMTREPLFPGKDYVHQLRLITELIGSPDDSSLGFLRSDNARRYVRQLPQYPRQNFAARFPNMSAGAVDLLEKMLVFDPSRRITVDEALCHPYLAPLHDINEEPVCVRPFNFDFEQPTLTEENIKELIYRETVKFNPQDSV

SEQ ID NO: 15623 - protein, 291 aa, Ustilago maydis
MGESRTELIHWINELLGFSYTKVEQCGSGAAYAQIIDSIYYNVPLAKIKFDAKHDYEYINNFKVLQEAFKRNRIDKPIPVDRLIRCKMQDNLEFLQWLKRYWDQNFSGEMYDAEARRGGVGAAPPPLVGAVSVGAARSTGAARAAPSAQAATSRSSARAPPAAASTTRRPLGGAPARAPAASAASVPNETIQALTAQMDEMKVSVDSLEAERDFYFAKLRDIEILVQERLGVLAEQFPAPSEDDDPEGLHVGSEEQESLKQIQAILYSTEEGFELPEGGDELVQPDEDEMF

SEQ ID NO: 15624 - protein, 201 aa, Chlamydomonas reinhardtii
  misc_feature (75)..(75): Xaa can be any naturally occurring amino acid
MLLTRKNVAVRPARAARRDVRAMSLLGNLFGGGSKPTSSTSNFHQLSALDIDKKNVDFKSLNNRVVLVVNVASKXGLTAANYKEFATLLGKYPATDLTIVAFPCNQFGGQEPGTNAEIKAFASARGFSGAGALLMDKVDVNGANASPVYNFLKVAAGDTSDIGWNFGKFLVRPDGTVFGRYAPTTGPLSLEKYIVELINSR

SEQ ID NO: 15625 - protein, 319 aa, Metasequoia glyptostroboides
MAAAAALKTPISLGRSEWFGQTLRPTSSSSLSLQTHSLSTSPALNVRASAYSDELVKTAKTVASPGRGILAMDESNATCGKRLASIGLENTEANRQAYRQLLVSAPGLRQYISGAILFEETLYQSTTDGKKIVDVLVSQNIVPGIKVDKGLVPLAGSNDESWCQGLDGLASRCAAYYQQGARFAKWRTVVSIPNGPSALAVKEAAWGLARYAAISQDNGLVPIVEPEILLDGDHGIDRTFEVAKKVWAEVFFYLAENNVMFEGILLKPSMVTPGAEHKERASPTTVSEYTIKLLRSRVPPAVPGIMFPLWRAIRGGRRR

SEQ ID NO: 15626 - protein, 397 aa, Leptosphaeria maculans
MRSAILLAAAAAGTASAGVHKMPLKKVSLDEQLKYASIQEQVSALSQKYMSGFKPTSHMEQVFKAPYIADGTHPVPVSNFLNAQYFSEISLGTPPQTFKVVLDTGSSNLWVPSSECNSIACYLHTKYDSSASSTYKKNGTSFEIRYGSGELSGFVSNDVFQIGDLKVKNQDFAEATSEPGLAFAFGRFDGIMGLGYDTISVNHIVPPFYNMLDQGLLDEPVFAFYLGDTNEQQESEATFGGIDESHYSGKLIKLPLRRKAYWEVDLDAITFGKETAEMDNTGVILDTGTSLIALPSTMAELLNREIGAKKGFNGQYSVECDKRDGLPDLTFTLTGHNFTISAFDYILEVQGSCISAFMGMDFPEPVGPLAILGDAFLRKWYSVYDLGNSAVGLAKSK

SEQ ID NO: 15627 - protein, 487 aa, Arabidopsis thaliana
MESVALSRIGLAGLAVMGQNLALNIADKGFPISVYNRTTSKVDETLDRASNEGKLPVAGQYSPRDFVLSIQRPRSVIILVKAGAPVDQTISALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAAKVLEEAGLKEDIGSASRGVDKKRLIDDVRQALYASKICSYAQGMNLLRAKSLEKGWDLNLGEMARIWKGGCIIRAVFLDRIKKAYQRNPNLASLVVDPDFAKEMVQRQAAWRRVVGLAISAGISTPGMCASLAYFDTYRRARLPANLVQAQRDLFGAHTYERTDRPGAYHTEWTKLARKSQ

SEQ ID NO: 15628 - protein, 306 aa, Mycobacterium leprae
MLCLKMRRFWRTVVEVTSQNSQALAQASGAFTLGGDLKVNRLGFGAMRLTGKGVWGPPVDRYEAVRVLRRAVELGVNFIDTADSYGPYVSEEIIAEALHPYKGLVIATKAGLLRTGRDVWIPLGNPSYLRQELEMSLRRLNVDTIDLFQLHRIDPNFPLADQVGELFTLKNEGKIRHIGLSEINLDQLTAAQQITEIVSVQNMYNLSARAAEPLLDAVTSRGIGFIPWSPLAAGPLAAPDGPLQRIAVNHHATPSQLALAWLLKRSPVMLPIPGTSRVAHLEENVAAAEISLSDDEFEMLSAAGAQ

SEQ ID NO: 15629 - protein, 303 aa, Nostoc sp. PCC 7119
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 15630 - protein, 380 aa, Trifolium repens
MSNTAGQVIKCRAAVAWEAGKPLVIEEVEVAPPQAGEVRLKILFTSLCHTDVYFWEAKGQTPLFPRIFGHEAGGIVESVGEGVTHLKPGDHALPVFTGECGECPHCKSEESNMCNLLRINTDRGVMINDNKSRFSIKGQPVHHFVGTSTFSEYTVVHAGCVAKINPDAPLDKVCILSCGICTGLGATVNVAKPKPGSSVAIFGLGAVGLAAAEGARMSGASRIIGVDLVSSRFELAKKFGVNEFVNPKDHDKPVQQVIAEMTDGGVDRAVECTGSIQAMISAFECVHDGWGVAVLVGVPKKDDAFKTHPMNFLNERTLKGTFYGNYKPRTDLPNVVEQYMKGELELEKFITHSIPFSEINKAFDYMLKGESIRCIIRMEE

SEQ ID NO: 15631 - protein, 213 aa, Cucumis sativus
QIQESYGHCLTYILPKTLNVTVHWPTYAKLYQQLIAGITLNKGTKLYWFDKKGKGNRYVLLPKSLTISWIDDCQYWKWIPGEIYGKKIDVAELIKVCWLDISGKLKQYALSSGVLYEVICHVGVTPCASGWQEPVTFAITLPDGKKIEIKESIQCKPRDVWITIKIGEFKVDKHDCNSDKEYEFRVYSHSSQWKTGLKFKGFEIRPKQSSCGC

SEQ ID NO: 15632 - protein, 216 aa, Cucurbita argyrosperma subsp. sororia
MNHKEKEAREKLGGEVKLGHCLDVILKNADVALHYPSFLKLYDQLVAGILLNKGAIKYIFDKKSNSNWYFIFARALSIAWIEDKRYWKWGSCNKIAELIQVSWLDIRGKINESMLSPNIVYEVALQVQLNSGASGWNHPMNIELKKPNGSKIERQECLLGKPKNQWFEIVIEFKVDNHGCGSSGEIEFSFFEHGGHWKRGLLVKGVRIGAKGCGCA

SEQ ID NO: 15633 - protein, 218 aa, Cucurbita digitata
MDNKEKEAREKLGGEVKLGHCLDVILKNADVALHYPSFLKLYDQLVAGILLNKGAIKYIFDKKSNSNWYFIFARALSIAWIEDKRYWKWGSCGDSNVAELIEVSWLDIRGKINESMLSQNVVYEVALQVQLNSRASGWNAPLNIELKKPDGSRIARQECLLGKPQNQWFEIVVEFKVGNHGCGSSGEIEFAFFEHGGAWARGLLVKGVRIGAKGCGCA

SEQ ID NO: 15634 - protein, 343 aa, Pseudonocardia autotrophica
DPIPPRDRPTALANVASLFHLREGATTLVPAPLYHSAPNAHAVFSLAMGMDVHVMPRFDAEGFLRLVEQHRVTTVQMVPTMFVRLLQLPEPVRRSYDLSSLTAIVHAAAPCPPQVKAAMIDWLGPIVHEYYGGAEIGAFTACDSTEALTRPGTVGRPVLDADVRILDEHGTELPTGEDGIVYGRPFSGWPDFTYIDDDAKRRGMEQEGYLTLGDIGHLDVDGYLYLADRQNDMVISGGVNIYPAEIEACLHDLDGVPDVAVFGIPDSDMGEAIAAHVQPLPGATLAAEDIRDHVSSRLARYKVPREVVLVEELPREDTGKIFKRLLKEKYLSPDRPLTDRSST

SEQ ID NO: 15635 - protein, 324 aa, Arabidopsis thaliana
NLTFWRDGSLVRERNAMLPTISSKDWLDIDFGIAEGVDFIAVSFVKSAEVINHLKSYLAARSRGGEIGVIAKIESIDSLTNLEEIILASDGAMVARGDLGAQIPLEQVPAAQQRIVQVCRALNKPVIVASQLLESMIEYPTPTRAEVADVSEAVRQRSDALMLSGESAMGQFPDKALTVLRTVSLRIERWWREEKRHESVPLQAIGSSFSDKISEEICNSAAKMANNLGVDAVFVYTTSGHMASLVSRCRPDCPIFAFTTTTSVRRRLNLQWGLIPFRLSFSDDMESNLNKTFSLLKSRGMIKSGDLVIAVSDMLQSIQVMNVP

SEQ ID NO: 15636 - protein, 491 aa, Aspergillus oryzae
MADQAVADFGLIGLAVMGQNLIMNVADHGFTVCAYNRTTSKVDRFLENEAKGKSIVGAHSIEEFCAKLKRPRRIMLLVMAGKPVDQFIESLLPHLEKGDIIIDGGNSHFPDSNRRTKYLAEKGIRFVGSGVSGGEEGARYGPSLMPGGNEEAWPFIKDIFQSIAAKSEGEACCDWVGDEGAGHYVKMVHNGIEYGDMQLICEAYDILKRGVGMPVNEIAEVFDKWNKGVLDSFLIEITRDVLRFNDDDGTPLVEKILDKAGQKGTGKWTAINALDLGMPVTLIGEAVFSRCLSALKDERVRASSLLPGPTPQFTGDKQAFVDDLEQALYASKIISYAQGFMLMQEAAKEYGWKLNKPSIALMWRGGCIIRSVFLKDITNAYRQNPDLENLLFDKFFNEAIAKAQNGWRNVVSKGALWGIPTPAFSTALSFYDGYRTRDLPANLLQAQRDYFGAHTFRVKPEHANETYPEGKDIHVNWTGRGGNVSASTYIA

SEQ ID NO: 15637 - protein, 428 aa, Pfiesteria piscicida
MKWGDVGGSGSKDVPIAKDAARGAEIGGRGAAVAPSIGQSESSGSFQKLCGEVLLDLPKHLVAVKQVGKGAYGEVFLCKDERTQGQVAVKVIRDFTKDLLFGKRIFREVKILMALQHENLMRLIDLPAVPSPDFNVVYMVMPYMLADLHRMIYSSLKLVESHCQAFTCQILRGLKYLHSAGIVHRDLKPANIMVNKNCTLRITDFGLARGRCDDEEVLTDYVVTRWYRAPELMLVPSSYFEAIDLWSVGCIHFECVARTVLFPGEHHFDMLKKIADTLGMFTPEGVAWCPQDQKGEVDTMLNKLEDLRSKELNSLASRLPEASEVCLDLLLKLLDKVPSTRISAAEALEHPYLQHLRDPAGETVAKRPFAWDFDVFEPSERALKDRIYAECARIHPEIITRDAKYLMDRGFKVPAQRPSPADEKPDGS

SEQ ID NO: 15638 - protein, 367 aa, Geotrichum klebahnii
MLFSKSAIFAMAALAVAAPTEGDLQARGSACVFKDAKSAIAGKKSCSSITLENIAVPAGQTLDLTGLAKGTVVTFAGTTTFGYKEWAGPLISVSGDSITVKQASGGKIDCGGSRWWDGKGSNSGGKQKPKFFYAHKLQNSNIQGLQVYNTPVQAFSILSDHLTLSNILVDNRAGDKAGGHNTDAFDVGTSTYITIDHATVYNQDDCLAINSGDHITFQNGFCSGGHGLSIGSVGGRSLNTVSNVNILNSQVVNSDNGVRIKTISGATGSVSGVKFQDITLSNIAKYGIDVQQDYRNGGPTGNPTNGVKITGIEFINIHGSVKSSGTNAYLLCGSGSCSNWTWSKINVKGGKDSGACKNVPSGATCKL

SEQ ID NO: 15639 - protein, 310 aa, Pseudonocardia sp.
MIPQRTALISAAVLVLGAVSIPQATAAPFGLVGWATQGGGTTGGGSATPITVTSASAFVDAAKSSSAAVIRVSGTISLPSMTKVASNKTIEGVGSSSVITGQGLNIANASNVVVRNLTFRNWGDDAINVQYSTRVWIDHNSFSNGYDGAVDVKRASDYVTVSWNKFSSHNKTMLLGHSDDNGSEDRGKLRVTYHHNWFDGTQQRHPRVRFGNPVHVYNNYYGGVTSYGVASTMEAGVLVEGNYFENTGDPFHRGEGSSPGGALVARGNHFVNSGTGDQGGSVKSLPYSYPLDSASTVKSVVTAGAGAGRG

SEQ ID NO: 15640 - protein, 387 aa, Sclerotinia sclerotiorum
MVNLSAPLILGGLSALASALPAAAPAPTAAPDLAKRATTCTFSGSSGAASASKSKASCATIVLSALAVPSGTTLDLTGLTQGTKVSVYQRVVIFEGITTFGYEEWSGPLVSVSGTDITVTQSGSAYLDGKGASYWDGEGSNGGKTKPKFFAAHNLISSTIENIYILNPPVQVFSIDNANGLTINNVTINASAGDTGSLGHNTDGFDIGDSTSVTITGANVYNQDDCVAINSGTGITFSGGVCSGGHGLSVGSVGGRDDNIVQTVNFENSEIKNSQNGVRIKTISGDTGTVSGVTYSGITLSGITDYGIIVNQAYNGNAGSPTNGVAISKFILDNVTGTVESGATNIYIECGSGSCTNWTWSGVSVTGGKTSTSCLNVPTSGGVSCSL

SEQ ID NO: 15641 - protein, 116 aa, Streptococcus pneumoniae
PWLAVNPNYEMINVQEALANPDSIFYTYQKLVQIRKENSWLVRADFELLDTADKVFAYIRKDGDRRFLVVANLSNEEQDLTVEGKVKSVLIENTAAKEVLEKQVLAPWDAFCVELL

SEQ ID NO: 15642 - protein, 509 aa, Zea mays
MATVSLTPQAVFSTESGGALASATILRFPPNFVRQLSTKARRNCSNIGVAQIVAAAWSDCPAARPHLGGGGRRARGVASSHAAAASAAAAASAAADVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMENELPKRGISMTVIRPADMDALQNALDNNNVSLFFTETPTNPFLRCIDIEHVSNMCHSKGALLCIDSTFASPINQKALTLGADLVIHSATKYIAGHNDVIGGCVSGRDELVSKVRIYHHVVGGVLNPNAAYLILRGMKTLHLRVQCQNDTALRMAQFLEEHPKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 15643 - protein, 286 aa, Brassica rapa
MEGKEEDVRVGANKFPERQPIGTSAQSDKDYKEPPPAPLFEPGELASWSFWRAGIAEFIATFLFLYITVLTVMGVKRSPSMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 15644 - protein, 1169 aa, Streptomyces sp. GERI155
MGRQVCAVGSLRREEGGLRRFLTSAAEAFVQGVDVTWPALFDDTGARAIDLPTYPFQHQNYWYIDPARRKGDVSSFGMAEAGHPLLDAGTELPEGGEHLYTARLTADSHPWLLEHTLLGTPLLPGAAFVDLVLWAGGELGCELVEELTLTSPLLLSDSAAVQLRLVVGATDAEGRRTITIHSRPDAHPGTTRTPAAPPEAGSEAEVRRDAADWTKHAQATVAPAPAAPASVVGADGNPGLPAAEWSSAATESDTFRAEDFYASFAARGYGYGPLFQGVRSGRQDGSDVYAEVALDQGALPPGERFGLHPALLDAAFQTMRLGSFFPDDGQARVPYTFRGIRLYAPGAERLRVRVSAVGDDAVRVECADEQGRLVCEIDALVVSPVSPAQLRPAGQDATQDMLHRVEWPVLPSPAGRATSTAAFRWIVVGPEDDGLGLAEVLSGTGTGIERHRNLADALTALRTPADTPGSPAAADKTPLIAVPVSPSPTMDAVSVRHAVHQALESVQGWLSADEAAGEGGSGAAGADGRLVLITSGAVSTGDADPLRDPVASAVWGLVRSAQSEQPDRFVLVDLDEGAVDGAALSAAIASGEPQLALREGKVHVPRLASLSARDSRMLLPPAGARAWHLVGARTGTLSDLALVPAQADTVPLAPGQVRIAVRAAGLNFRDTLIALGMYPGEGVMGAEGAGVITEVGPDVAGFAVGDRVLGMWTDGFGPYAVADHRMVAPMPRDWSYAEAASVPAVFLSAYYGLKHLAGLRAGQSVLVHAAAGGVGMAAVQLARYFGAEVFGTAGPAKWDVLRAQGLDDRHIASSRTLDFAARFLDATGGRGVDVVLNSLAGDFVDASLRLLPRGGRFVELGKADVRDAAQVAADRPGTGYRAFELMEAGPELIGRMLTELLELFESGALRLLPVTPYDIRRAPDAFRTLSQAGHVGKLVLTMPPAFDPPRPGRPACSCRPRHRTRRRGTRSAARPGAPARRCRTLVRCGHAGPCGGPGAPDHGRGIRHPGRTARREAARRTARRPQGARAHRNRLGARARGRPTRPTPVLLQGSRIRLAHRRRTPQQAHRRHRNEASRHTGLRPSDAGGTRRPPGTGTAEGRSETSRGRPGRSGGTRSDPGRTGHRCHRRQRPRPRRGTPSGTARHARPAGGGRPPGQRLERSRRAGPR

SEQ ID NO: 15645 - protein, 488 aa, Lycopersicon esculentum
MACSVDTLAPFLGPNTTNAVAAASYICNQFSGVSDRFVDTGYAIDSTYLLFSAYLVFSMQLGFAMLLAGSVRNTMNIMLTNVLDAAAGGLFYYLFGFAFALGGPSNGFIGRHFFGLKEIPSNSFDYMNFLYQWAFAIAAAGITSGSIAERTQFVAYLIYSSFLTGFVYPVVSHWFWTPDGWASPTNSNLLFGSGVIDFAGSGVVHMVGGIAGFYGALIEGPRIGRYDHTGRSVALRGHSASLVVLGTFLLWFGWYGFNPGSFNKILVTYGASGGYYGQWSAVGRTAVTTTLAGCTAALTTLFGKRILSGHWNVTDVCNGLLGGFAAITAGCSVVEPWAAIICGFVAALVLIGFNMLAEKFKYDDPLEAAQLHGGCGAWGIIFTGLFAKGEFVDQVYPGKPGRPHGLFMGGGGKLLGAHIIQILVIIGWVSATMGPLFYILHKFKLLRISSEDEMAGMDLTRHGGFAYYHEEDPKLGMQMRRIEPTTST

SEQ ID NO: 15646 - protein, 304 aa, Helicodiceros muscivorus
MGGHDSGRSDISFGGRFASSAFAACFAELCTIPLDTAKVRLQLQKKSVAGDGVSLPKYRGMLGTVATIAREEGLSALWKGIVPGLHRQCLFGGLRIGLYEPVKSFYVGEGFVGDVPLSKKILAGLTTGALAITVANPTDLVKVRLQAEGKLSPGIPRRYSGALNAYSTIVKQEGLGALWTGLGPNIARNAIINAAELASYDQVKQTILKIPGFSDNIFTHILAGLGAGFVAVCIGSPVDVVKSRMMGDSTYKSTLDCFIKTFKNDGPLAFYKGFIPNFGRLGSWNVIMFLTLEQVKKVFIKEAP

SEQ ID NO: 15647 - protein, 479 aa, Synechococcus elongatus PCC 7942
MSSEFDYDVIVIGAGYGGFDAAKHACEKGLKTAIVEARDLGGTCVNRGCVPSKALLAASGRVREITDTDHLQNFGIQVQGVSFDRQAIADHAANLVDTVRTNLGNTLKRLGAEILMGRGRLAGSQRVTVTAADGTEKTYSARDVILATGSDPFVPPGIEIDGKTVFTSDDALKLETLPQWIAIIGSGYIGLEFSDVYTALGCEVTMIEALDRLLPTFDPDVAESCPAIAAGWSRHRNPHGCFGAQNYAGSPVVIELADFETKELVEVLEVDACLVATGRIPSTKNLGLETVAVEVDRRGFIPVDDGMRVLRDSKPVPHLFAVGDATGKLMLAHAAAAQGVVAIENITGHPRSVDYRSIPAATFTHPEISSVGLSEADAKALGGQEGFEVGSVRSYFKANSKALAEADADGFAKVLFRKDTGEVLGAHIFGLHAADLIQEVANAIARRQSVKELAFEVHTHPTLSEVIESAYKQAATAIA

SEQ ID NO: 15648 - protein, 464 aa, Klebsiella aerogenes
MKTFPTDFLWGGATAANQVEGAYLEDGKGLSTSDVQPHGVFGEVVERVPGDNGIKDVAIDFYHRYPEDIALFAEMGFNCLRVSIAWTRIYPNGDDAEPNEAGLAFYDKLFDEMAKHNITPLVTLSHYEMPWALVKNYGGWGSREVIGFFERYARTVFSPYKNKVKLWLTFNEINMSLHAPITGVGLPAGSSKGEVYQAIHHQLVASALAVKACHELVPEGKIGNMLLGGLMYPLSCKPEDVFETLQENRSWQFFGDVQARGAYPGYMFVYFRDNGITLTITDADREALKTTVDFISFSYYMTGCVTADERLNQQARGNILSMVPNPHLASSEWGWQIDPLGLRTLLNVLWDRYQKPLFIVENGLGAKDKVEADGSINDDYRISYLNDHLMQAREAIDDGVELMGFTSWGPIDLVSASKAELSKRYGFIYVDRHDDGTGTLARSKKKSFGWYKEVIASRGASLKA

SEQ ID NO: 15649 - protein, 386 aa, Candida dubliniensis
MDIVLEICDYYLFDKVYADVFPKDGPVHEYLKPAIQSFSEINFPKLQNWDSFDTNSTLISSNNFNISNVNPATIPGYLLSKIASYQDKSEIYGLAPKFFPATEFIDTSFLSRSNIFREVLSLFIITTLFGWLLYFIVAYLSYVFVFDKKIFNHPRYLKNQMSLEIKRATSAIPVMVLLTIPFFLLELHGYSFLYEEINESTGGYKAILWQIPKFILFTDCGIYFLHRWLHWPSVYKALHKPHHKWIVCTPFASHAFHPVDGFFQSLPYHLYPLLFPLHKVLYLLLFTFVNFWTVMIHDGSYWSNDPVVNGTACHTVHHLYFNYNYGQFTTLWDRLGNSYRRPDDSLFVKDQKKEEEKKIWKEQTRQMEEIRGEVEGKVDDREYIDQ

SEQ ID NO: 15650 - protein, 225 aa, Cucumis sativus
MVCIETEARESLQIQESYGHCLTYILPKTINVTVHWPTYAKLYQQLIAGITLNKGTKLYWFDKKGKGNRYVLLPKSLTIIWIDDCQYWKWIPGEIYGKKIDVAQLIKVCWLDISGKLKQYALSSGVLYEVLCHVCVTPCASGWQEPVIFVITLPDGKKIETKESLQCKPRDVWFTIKIGEFKVDKHDCNSDKEYEFRVYNHSSQWKTGLKFKGFEIRPKQSSCGC

SEQ ID NO: 15651 - protein, 361 aa, Cryptococcus neoformans var. neoformans
MSSDSSSSQVPRFHVHPHGAHLDHPAPPIQAGESSLALEEEEEHDYESLPVGSGWAVNMAAGAMAGISEHSAIFPIDSIKTRMQILAPVLHPVTGTTSATITGTIAPQLNTISQHVRSISTTEGLRSLWRGVASVILGAGPAHAAHFGMYEFVREISGGRNDGWQGVMGTAVAGAAATVSSDALMNPFDVIKQRMQIANSPYSNVLHCARTVYAREGLTAFYVSYPTTLTMSVPFTAVQFSAYEYLKTLLNPSGSYSPSTHVIAGGIAGGLAAAVTTPLDVAKTLLQTRGSSADERIRGARGMGEALRIIWERDGWKGLRRGMAPRVLTVAPSTAISWMSYEFFKVLIRQHGSLPETGQSL

SEQ ID NO: 15652 - protein, 407 aa, Terrabacter sp. YK3
MTAPHHVIVGGSAAGVAAALAMRRNGFEGRITLVEAASEEPYERPPLSKSFTDLDAPRRILPPSTYVEEDIDLLLGMPVAALDVDRKVVRLPDGEGLGADAVLVATGVNARRLGVPGEYLEHVLVLRGLADARALAARLDVGGPWVIVGGGFIGLEAAAVARGRGIDVTVVEAMPVPLAGVLGPALAAHVQRMHEREGVRILGGRTVTEFVGEREVEKVVLDDGSVLDAATVLVGCGVEPNDELARDAGVYCNGGIVADRHGRTSVPWIWAAGDVATFVSPFTGRRQRIEHWDVANRLGTVTGANMVGVPAVNTDAPYFWSDQYGHRLQMYGRHQPGDQFVVRPGVTTAQFVAFWVRDGRVTAAAAIDSPKELRATKPLIEGRVPVMASDLIDPAVSLRALGRVAHP

SEQ ID NO: 15653 - protein, 313 aa, Pyrobaculum calidifontis
MPLSPILRQILQQLAAQLQFRPDMDVKTVREQFEKSSLILVKMANEPIHRVEDITIPGRGGPIRARVYRPRDGERLPAVVYYHGGGFVLGSVETHDHVCRRLANLSGAVVVSVDYRLAPEHKFPAAVEDAYDAAKWVADNYDKLGVDNGKIAVAGDSAGGNLAAVTAIMARDRGESFVKYQVLIYPAVNLTGSPTVSRVEYSGPEYVILTADLMAWFGRQYFSKPQDALSPYASPIFADLSNLPPALVITAEYDPLRDEGELYAHLLKTRGVRAVAVRYNGVIHGFVNFYPILEEGREAVSQIAASIKSMAVA

SEQ ID NO: 15654 - protein, 263 aa, Physcomitrella patens
MARHNATKPVTLILAALMVLSATDNVEGRHHVRDGKNWRKAHATFYGGADASGTMGGACGYGNLYSTGYGVDSTALSTALFNNGAKCGACFAIQCYRSQYCVPGSPVITVTATNFCPPNHKGDGTPGWCNPPMRHFDLAQPSFTKIAKYRAGIVPVLFRRVPCEKKGGVRFTINGNKYFNLVLVHNVGGKGDVHAVDIKGSNTEWIPMKRNWGMNWQTDAVMTGQALSFRVTTSDGKTIVSMNATPSHWSFGQTFEGGQFAMN

SEQ ID NO: 15655 - protein, 181 aa, Apium graveolens var. dulce
MAQLNSSHEIINSCARDLEGLKQNIAQSCAAVLSAKELSIVWGSDSRYWTTATETAPNSNQSVDVSELIEVCWLQIDGKYSASKLNQGVKYGVYFIVKLKTNLRLNGKVTLKLTRPDGRTVVTRDDLDKRPKNTWVALKVGEFMTNARTCHRNVKFSMNGCDGTSWKSGLVVIGAVIVPVC

SEQ ID NO: 15656 - protein, 179 aa, Apium graveolens var. dulce
MAQVQRDDIVSLWTQGFQALKDKSSCAAVLTAKELSIVWGSDPRYWKWVSKTSPVNFEALDAAELIEVCWLQIDGTYNARNLNKGVKYGVYFVVELNSNPCMNGPVTLKLTRPNGSPEEHKEDLQTKPRNKWVGLKVGEFTNTASGCDNTVKFSMNGCDGTTWKTGLTVIGAAIVPVIC

SEQ ID NO: 15657 - protein, 209 aa, Coffea arabica
DQYEKVEKIGEGTYGVVYKARDRLTNEMIALKKIRLEQEDEGVPSTAIREISLLKEMQHNNIVRLQDVVHSEKRIYLVFEYLDLDLKKHMDSCPELAKDPCLIKTFLYQILHGIAYCHSHRVLHRDLKPQNLLIDRRTNALKLADFGLARAFGIPVRTFTHEVVTLWYRAPEILLGSRHYSTPVDIWSVGCIFAEMVNQRPLFPVDSEI

SEQ ID NO: 15658 - protein, 394 aa, Rickettsia parkeri
MAKAKFERTKPHVNIGTIGHVDHGKTSLTAAITIVLAKTGGAQATAYDQIDAAPEEKERGITISTAHVEYETKNRHYAHVDCPGHADYVKNMITGAAQMDGAILVVSAADGPMPQTREHILLAKQVGVPAMVVFLNKVDMVDDSDLLELVEMEVRELLSKYGFPGDEIPIIKGSALQALEGKPEGEKAINELMDAVDSYIPQPVRATDKPFLMPIEDVFSISGRSTVVTGRVESGIIKVGEEIEIVGLKDTQKTTCTGVEMFRKLLDEGQAGDNVGILLRGTKREEVERGQVLAKPGSIKPHDKFEAEVYVLSKEEGGRHTPFTNDYRPQFYFRTTDVTGTIKLPADKQMVMPGDNATFTVELIKPIAMQEGLKFSIREGGRTVGAGVVTKINN

SEQ ID NO: 15659 - protein, 394 aa, Rickettsia sibirica
MAKAKFERTKPHVNIGTIGHVDHGKTSLTAAITIVLAKTGGAQATAYDQIDAAPEEKERGITISTAHVEYETKNRHYAHVDCPGHADYVKNMITGAAQMDGAILVVSAADGPMPQTREHILLAKQVGVPAMVVFLNKIDMVDDPDLLELVEMEVRELLSKYGFPGDEIPIIKGSALQALEGKPEGEKAINELMDAVDSYIPQPVRATDKPFLMPIEDVFSISGRGTVVTGRVESGIIKVGEEIEIVGLKDTQKTTCTGVEMFRKLLDEGQAGDNVGILLRGTKREEVERGQVLAKPGSIKPHDKFEAEVYVLSKEEGGRHTPFTNDYRPQFYFRTTDVTGTIKLPADKQWVMPGDNATFTVELIKPIAMQEGLKFSIREGGRTVGAGVVTKINN

SEQ ID NO: 15660 - protein, 394 aa, Rickettsia montanensis
MAKAKFERTKPHVNIGTIGHVDHGKTSLTAAITMVLAKTGGAQATAYDQIDAAPEEKERGITISTAHVEYETKNRHYAHVDCPGHADYVKNMITGAAQMDGAILVVSAADGPMPQTREHILLAKQVGVPAMVVFLNKVDMVDDSDLLELVEMEVRELLSKYGFPGDEIPIIKGSALQALEGKPEGEKAINELMDAVDSYIPQPVRATDKPFLMPIEDVFSISGRSTVVTGRVESGIIKVGEEIEIVGLKDTQKTTCTGVEMFRKLLDEGQAGDNVGILLRGTKREEVERGQVLAKPGSIKPHDKFEAEVYVLSKEEGGRHTPFTNDYRPQFYFRTTDVTGTIKLPADKQMVMPGDNATFTVELIKPIAMQEGLKFSIREGGRTVGAGVVTKINN

SEQ ID NO: 15661 - protein, 443 aa, Pyrococcus sp.
MNEIKGIERAVQVEVPRPRFLLLAFTDINGSLKGMEIPMERYEEAVEDGVSFDGSSIPGFEGIEDSDLIFKADPSTYAEIPWEGIGRVYGYIYKGDEPYQADPRGILKRVLERLEKEGLKAHIGPEPEFYIFKKNGTWELHIPDSGGYFDLVGLDKAREIRREIALYMPYLGLKPEVLHHEVGKAQHEIDFRYDEALRTADNIVSFKHVVKAVAELHGYYATFMPKPIYGFPGNGMHLHISLWKDGENVFIGEDGLSDTALHFIGGILKHAKALAALTNPTVNSYKRLVPGYEAPVYISWGYRNRSALIRVPAFKGSGARIEYRCPDPSANPYLALAGILMVGLDGIKKKVEPDSYVETNVYEMDDAERERLGIDTLPGSLGEALEELKKDKTVREALGGANKNFIDYKEREWEEYIEYLSSRDIPIDTKKVTEWELERYFYV

SEQ ID NO: 15662 - protein, 344 aa, Rhodobacter sphaeroides
MRIQRDLAEAIGNTPLIRLRKASELTGCEILGKCEFLNPGQSVKDRAALYIIRDAVAKGLLQPGGTIVEGTAGNTGIGLSLVGASMGFRTVIVIPETQSQEKKDMLRLAGAHLVQVPAGPYRNPNNYVRYSGRLAEALARTEERGAILANQFDNTANRQAHVETTGPEIWEQTDGKVDGFICAVGSGGTLAGVAMALQPRGVKIGLADPEGAALHSFYTEGTFEAPGSSITEGIGQGRITANLEGLTPDFSYRIPDAEALPIIFDLMQEEGLCLGGSSGVNIAGAIRMAREMGPGHRIVTVLCDYGNRYQSKLFNPQFLRDKGLPVPQWLDEAPPAIPAVFEDL

SEQ ID NO: 15663 - protein, 156 aa, Haemophilus influenzae
NRTNTPVLVDGKDVMPEINAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 15664 - protein, 159 aa, Haemophilus influenzae
MFRAAIKAGTELGKQAKALMDEGKLVPDELTVALVKDRIAQPDCANGFLLDGFPRTIPQADALKDSGVKIDFVLEFDVPDEVIVERMSGRRVHQASGRSYHIVYNPPKVEGKDDVTGEDLIIRADDKPETVLDRLAVYHKQTSPLIDYYQAEAKAGNTQ

SEQ ID NO: 15665 - protein, 233 aa, Flavobacterium johnsoniae
MITKKVNNVQEAIAGIETGMTIMFGGFGLCGIPENTIAALVNTQISDLTCISNNAGVDDFGLGLLLQKKQIKKMISSYVGENAEFERQMLSGELEVELTPQGTLAERCRAAQAGIPAFFTPAGYGTEVAEGKEVREFNGKMHIMEEAFKADFAIVKAWKGDEAGNLIFKGTARNFNACMAGAGKITIAEVEELVPVGTLDPNQIHIPGIMVQRIFQGEKFEKRIEQRTVRTRN

SEQ ID NO: 15666 - protein, 472 aa, Yersinia pestis KIM
MSQNVYQFIDLQRVDPPKKPLKIRKIEFVEIYEPFSETQAKAQADRCLSCGNPYCEWKCPVHNYIPNWLKLANEGRIMEAADLAHQTNSLPEVCGRVCPQDRLCEGSCTLNDEFGAVTIGNIERYISDKAIAMGWKPDMSHVHPTGKRVAVIGAGPAGLACADVLARNGVQAVVFDRHPEIGGLLTFGIPAFKLEKEVMIKRRKIFSEMGIEFQLNTEVGKDITMEALLKDYDPVFLGVGTYQSMRGGLENEEANGVYDALPFLIANTKQLMGYEATAHEPYINMQGKRVVVLGGGDTAMDCVRSSIRQGATDVVCAYRRDEVNMPGSKREVKNAREEGVEFKFNLQPLSIEVNSNGKVCGVRMVRTQLGAPDAQGRRMAEQIPGSEHVLPADAVVMAFGFRPHSMEWLAAHDVKLDKQGRVIAPESTDNAFQTSNPKIFAGGDIVRGSDLVVTAIAEGRKAADGIMNYLEV

SEQ ID NO: 15667 - protein, 377 aa, Yersinia pestis KIM
MPAQNPLQHQRQHDGIYHIGYFVGGKWSQAQEQFDVYNPATGELVARVAKSGKQETEAAIKAASEAFPAWRKTPAKQRAEILQRWYLLIMEHQQSLAELMVSEQGKPLKEALVEVAYAASFIQWFSEQAKRANGEIIPSAKEGARILATREPIGVVAAITPWNFPLAMLTRKLGPALAAGCTGLIKPANNTPLSAFALLALAEQAGVPAGVLNGVVGDTHAISDAIMASSDVRKISFTGSTNVGKTLMRNAAATMKRISMELGGNAPYIVFDDADLEAAVAGAMACKFRNAGQVCVCVNRFYIQDAIYDEFVNRLAAEVKKLKVGNGMDKDVNMGPLINLAGLEKVEEHVKDALEKGGRLLAGGIAMRWAVISSSQR

SEQ ID NO: 15668 - protein, 451 aa, Yersinia pestis KIM
MSSSNPQAQPKGTLDAFFKLSERGSNVRQEVLAGLTTFLAMVYSVIVVPSMLGKAGFPPTAVFVATCLVAGLGSLLMGLWANLPMAIGCAISLTAFTAFSLVLGQQISIPVALGAVFLMGVLFTIISVTGIRSWILRNLPMGVAHGTGIGIGLFLLLIAANGVGLVIKNPIEGLPVALGAFTSFPVIMTLLGLAVIFGLEKLRVPGGILLVIVAISVIGLIFDPSVTYQGLFAMPSLADANGDSLIFSLDIMGALQPVVLPSVLALVMTAVFDATGTIRAVAGQANLLDKDGQIISGGKALTTDSVSSIFAGLVGAAPAAVYIESAAGTAAGGKTGLTATVVGILFLLILFLSPLSYLVPAYATAPALMYVGLLMLSNVSKLDFEDFVDAMSGLLCAVFIVLTCNIVTGIMLGFSSLVIGRVCSGEWRKLNVGTVIIAVALVAFYAGGWAI

SEQ ID NO: 15669 - protein, 487 aa, Yersinia pestis KIM
MKTLNVDVAVIGGGTAGLGAYRAAKLLTPNVVMIEGGEYGTTCARVGCMPSKLLIAAAEAVHQIEKAPGFGIHPQGKPLINGREVMDRVKRERDRFVGFVLESVETIPAADKIQGYARFIDDNTLQVDDHTQLTSQKIIAQRIVIATGSRPSWPASWNELGDRLIINDDVFNWDDLPESVAVFGPGVIGLELGQALHRLGVQVKMFGVGGAVGPLTDSIVRDYAAKTLGDEFYLDPDVKVELMQREGDKVFIRYLDKSGRPQEIMVDYVLAATGRRPNVDKLGLENTSLILDERGVPQADRLTMQTNVPHIFIAGDASNQLPLLHEASDQARIAGVNAGGFPEVVPGLRRSPISVVFSDPQIAMVGATFRELAQKFSACGCFEIGEVSFENQGRSRVMLKNKGILRIYGEQGTGRFLGAEMMGPSAEHIAHLLAWAHQQQMTIDQMLDMPFYHPVIEEGLRTALRDLQSKLKLGADEAERCLRCPGE

SEQ ID NO: 15670 - protein, 444 aa, Yersinia pestis KIM
MGLVKQGARVAVIERYNNVGGGCTHWGTIPSKALRHAVSRIIEFNQNPLYSDNARTIKSSFADILNHADRVINQQTRMRQGFYDRNHCHMFSGDASFIDANTVNVRYADGTSDTLQADNIVIATGSRPYRPVNVDFNHERIYDSDTILQLSHEPQHVIIYGAGVIGCEYASIFRGLSVKVDLINTRDRLLAFLDQEMSDALSYHFWNNGVVIRHNEEFEQIEGTTDGVIVHLKSGKKVKADCLLYANGRTGNTSGLGLENIGLEADSRGLLKVNSMYQTALSHVYAVGDVIGYPSLASAAYDQGRIAAQAMIKGEANVHLIEDIPTGIYTIPEISSVGKTEQELTAMKVPYEVGRAQFKHLARAQIVGMDTGSLKILFHRETKQILGIHCFGERAAEIIHIGQAIMEQKGEGNTLEYFVNTTFNYPTMAEAYRVAALNGLNRLF

SEQ ID NO: 15671 - protein, 504 aa, Yersinia pestis KIM
MTDHSKKQTRVSLPHSVFSADWVRQNEAAAAAHFSLTLFDLMVRAGNAAFELAHKQYPIARHWLILCGHGNNGGDGYIVANRALAAGIDVTLIACPGNRPLPAEAKEAQSQWLAIGGVIHQPDTQWPQDIDLIIDGLLGIGLRAAPQGIYETLIDMANRHRAAKVALDIPSGLCADNGAALGSVLRADHTLTFVALKPGLLTGQARDWVGQLHYDDLGLATWLDTQSAQIERITADHLPQWLKPRRPCAHKGDYGRLLLVGGDRGFGGAIRMAGEAALRSGAGLVRVLTHFEHVAPILAARPELMVQALTAETLEQSMQWADVLVVGPGLGQSDWSRNALKRLQQSDKPTLWDADALNLLALNPHRRQNWVLTPHPGEAARLLGCRVVDIESDRLLSARNIVKQYGGVVVLKGAGTLIANEQGEMAIADVGNAGMASGGMGDILSGIIGGLIAQKLALYDAACAGCVVHGVAADKLAEVQGTRGLLATDLLPVIPKYINPELAK

SEQ ID NO: 15672 - protein, 206 aa, Yersinia pestis KIM
MTTPSFDSVEAQASYGIGLQIGQQLQESGLQGLLPEALLAGLRDAMEGNTPTVPVDVIHRALQEVHEKADKVRIERQQALVDEGKTFLEENAKRDDVTTTESGLQFSVLQAGDGPIPSRQDRVRVHYTGRLVDGTVFDSSVERGQPADFPVSGVIPGWIEALSMMPVGSKWKLYIPHNLAYGERGAGATIPPFSALMFEVELLEIL

SEQ ID NO: 15673 - protein, 347 aa, Yersinia pestis KIM
MRIEEGLKLGFKDVLIRPKRSTLKSRSEVALERQFTFKHSGWNWSGVPIIAANMDTVGTFRMAEVLASFDILTAVHKHYTLEQWAEFVKRSPESVLLHVMVSTGTSSADFDKMKQILALSPSLKFICIDVANGYSEHFVSFLQRAREACPDKVICAGNVVTGEMVEELILSGADIVKVGIGPGSVCTTRVKTGVGYPQLSAVIECADAAHGLGGQIVSDGGCSVPGDVAKAFGGGADFVMLGGMLAGHDECEGRVVEENGEKFMLFYGMSSESAMKRHVGGVAQYRAAEGKTVKLPLRGSVDNTVRDIMGGLRSACTYVGASHLKELTKRTTFIRVAEQENRVFGTD

SEQ ID NO: 15674 - protein, 466 aa, Yersinia pestis KIM
MMSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKVTK

SEQ ID NO: 15675 - protein, 324 aa, Yersinia pestis KIM
MTVQPQAELAMILPPIFHGCYCEGEAPNMSQKELWYETLHANFGQYFSVENVLFREKTEHQDLVIFENPELGRVMALDGVVQTTERDEFIYHEMMTHVPLLAHGQAKKVLIIGGGDGAMLREVSRHKNIEQITMVEIDAGVVEFCRQYLPNHSAGAYDDPRFKLVIDDGVNFVNQTTEKFDVIISDCTDPIGPGESLFTSVFYEGCARSLNEGGIFVAQNGVCFLQQDEAVNSHNKLSHYFSDVSFYQAAIPTYYGGIMTFAWATQNPALRQLDLATLQNRFAQAGLACRYYNPAIHVGSFALPQYLLDALTTIPKVIGVDSSE

SEQ ID NO: 15676 - protein, 181 aa, Yersinia pestis KIM
MLAVKHTVEVMISEQEVKTRIAELGRQISEHYRDSGSDMVLVGLLRGSFMFMADLCRAIDVSHEVDFMTASSYGNGMSTTRDVKILKDLDEDIRGKDVLIVEDIIDSGNTLSKVREILQLRGPKSLAICTLLDKPERREVHVPVEWVGFTIPDEFVVGYGIDYAQRYRHLPYVGKVVTLDE

SEQ ID NO: 15677 - protein, 426 aa, Yersinia pestis KIM
MSKSENLYAQAQQLIPGGVNSPVRAFTGVGGIPLFIERADGAYLFDVDGKAYIDYVGSWGPMILGHNHPAIRQAVIEAVERGLSFGAPTEMEVKMAQLVTDLVPTMDMVRMVNSGTEATMSAIRLARGYTGRDKIIKFEGCYHGHADCLLVKAGSGALTLGQPNSPGVPTDFAKHTLTCTYNDLASVRQAFEQYPQEVACIIVEPVAGNMNCIPPLPEFLPGLRALCDEFGALLIIDEVMTGFRVALAGAQDYYHVIPDLTCLGKIIGGGMPVGAFGGRREVMNALAPTGPVYQAGTLSGNPIAMAAGFACLTEISQVGVYETLTELTDSLATGLRHAAKEENIPLVVNHVGGMFGLFFTNADTVTCYQDVMNCDVERFKRFFHLMLEEGVYLAPSAFEAGFMSLAHSNEDIQKTVNAARRCFAKL

SEQ ID NO: 15678 - protein, 431 aa, Yersinia pestis KIM
MSKIVKVIGREIIDSRGNPTVEAEVHLEGGFVGLAAAPSGASTGSREALELRDGDKSRFLGKGVLKAVAAVNGPIAQAVIGKDAKDQANIDKIMIDLDGTENKSQFGANAILAVSLAAAKAAAASKGMPLYEHIAELNGTPGKFSMPLPMMNIINGGEHADNNVDIQEFMIQPVGAKTLKEAVRIGSEVFHHLAKVLKAKGLNTAVGDEGGYAPNLGSNAEALAVIAEAVKAAGYELGKDITLAMDCAASEFYKDGKYVLAGEGNKAFTSEEFTHFLEDLTKQYPIVSIEDGLDESDWAGFKYQTEVLGDKIQLVGDDLFVTNTKILKEGIEKGVANSILIKFNQIGSLTETLAAIKMAKDAGYTAVISHRSGETEDATIADLAVGTAAGQIKTGSMSRSDRVAKYNQLIRIEEALGDRAPFNGLKEVKGQ

SEQ ID NO: 15679 - protein, 463 aa, Yersinia pestis KIM
MELPVKNKLKRGLTTRHIRFIALGSAIGTGLFYGSADAIRMAGPSVLLAYLIGGVVAFVIMRALGEMSVNNPQASSFSRYAQDYLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMLLSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 15680 - protein, 346 aa, Yersinia pestis KIM
MTNTWVKNAINEIEADFQRSADTHLIRLNLSAFPGIYLYLKDESTHPTGSLKHRLARSLFLYGLCNGWITEGTTIIEASSGSTAVSEAYFARLIGLPFIAVMPSGTTRRKVEQITFYGGRCHFVDHAGQIYAASEQLARDLNGHYMDQFTYAERATDWRGNNNIADSIFRQMAREPFPTPDYIVMSAGTGGTSATLGRYIRYQGHDTQLVVVDPENSVFYDCFCTRDRTVTGRCGSRIEGIGRPRAEPSFIPEVIDSMLRVPDAASIATLHWLESILSRKVGASTGTNVWGALQLAKQMREQGKSGAIVTLLCDSGERYLDTYYNEEWVSNNIGDLTPFTNELNNL

SEQ ID NO: 15681 - protein, 470 aa, Yersinia pestis KIM
MLMLLPVIMAGGAGSRLWPLSRALYPKQFLALTSDLTMLQETLLRLDGLPHLAPLVICNEEHRFIIAEQLRQKNLVHSGIVLEPVGRNTAPAIALAALRATMSGDDPLLLVLAADHVIQDKLAFIRAVQRAEPLAEAGKLVTFGIVPKSPETGYGYIRQGKQVVDGAYQVAAFVEKPDLITAERYLASGDYYWNSGMFVFKASRYLQELDLHRPDILAACKQAIAGQHTDLDFIRLNEEAFSSCPDESIDYAVMEKTSDAVVVPLDAQWNDVGCWSALWEINTKDDHGNVIRGDVLIEDTNNSYVYSQNRLIATVGINDLVIVETKDAILVAHKDKVQNVKGIVGQLKLESRCEYLQHREVYRPWGSHDAIAEGVRYHVQHVTVKPGQRIATQIHYHRAEHWIVVSGIAKVHYGKETYLVNENESTYIPVGIAHSIENPGQIPLEIIEVHTGNYISEDDVERIDDLGVGY

SEQ ID NO: 15682 - protein, 330 aa, Yersinia pestis KIM
MMQKRYLGKSGLEVSALGLGCMGLSYGYGPATDTRQAVELIRAAVERGVTFFDTAEVYGPYLNEEVVGEALKPFRDQVVIATKFGFTFGEDNKQQILNSRPEHIREAVEGSLRRLKTDVIDLLYQHRVDPDVPIEDVAGTVKDLIAEGKVKHFGLSEAGAQTIRRAHAIQPVAALQSEYSMWWREPEQEILPLLEELGIGFVPFSPLGKGFLTGAIKAGATFGEDDFRSKVPRFAAEALEANERLVALLGILAAEKGVTSAQIALAWLLAQKPWIVPIPGTTKLHRLEENLGAADITLSQDDIWNITQALATVKIVGERYPAAMQARVGR

SEQ ID NO: 15683 - protein, 242 aa, Yersinia pestis KIM
MMISLKNVSKWYGQFQVLADCTTEVKKGEVVVVCGPSGSGKSTLIKVVNGLEPIQEGNITVNGIAVNDKGTNLAQLRSKVGMVFQHFELFPHLSIIENLTLAQIKVLKRDKAEALEKGLKLLERVGLSTHVDKYPSQLSGGQQQRVAIARALCMDPIAMLFDEPTSALDPEMINEVLDVMVKLALEGMTMMVVTHEMGFARKVANRVIFMDEGKIVEDSDKDDFFNNPKSDRAKDFLAKILH

SEQ ID NO: 15684 - protein, 174 aa, Yersinia pestis KIM
MDYFTLFGLPARYLIDGNQLTTRYQELQRQFHPDRFATQPERERLASMQQAATINDAYQTLKHPLKRAEYMLSLQGFDLGNEQHTMRDTAFLMEQLELREELDAIERKPDAETLLAEFSRRVAQMTTTRTQQMVEQLDAQLWVQAADTVRKLRFLDKLQQQVEQLEERLFDDFA

SEQ ID NO: 15685 - protein, 371 aa, Yersinia pestis KIM
MFNNKLRVCAMRTYVSFKNIKKSYDGDKLVVKNLNLDIHEGDFLTLLGPSGSGKTTSLMMLAGFETPTQGEITLRDKPLHNLPPHQRGIGMVFQNYALFPHMTVTENLAFPLTIRRLNKADIKEKIDRILDMVKLKNLADRYPAQMSGGQQQRVALARALVFEPKLVLMDEPLGALDKQLREHMQLEIKQLHKMLELTIVYVTHDQSEAMTLSNRVVVFNDGIIQQMDSPSVIYEQPSNTFVAQFIGENNCLLAVNQGSDGEYYRAMLDDGTRLQALKVCPSSPGKKIMLCIRPERVSVNHPAAGSQQIKARIQQFIYLGDHVRMMTEVAGQGNFMVKLSAAHIEPHWQPGSEVLLSWMPAHLRALEGVTH

SEQ ID NO: 15686 - protein, 437 aa, Yersinia pestis KIM
MAYQQERIMSHRELEQRRKEATPRGIGVLCDFYAVRAENATLWDEQGREYIDFTAGIATLNIGHRHPKVMAAVRQQLDQFTHTAYQVVPYASYVTLAEKINSLAPISDSNMTAAGNSKTAFFTTGVEAIENAVKIARAATGRPGVIAFSGAFHGRTLLAMALTGRAVPYKVGFGPFPASIFHALYPNELYGVSVEEAISSVERLFRCDISPTQVAAILFEPIQGEGGFNIAPPEFVSALRTLCDEHGILLIADEVQTGFARTGKLFAMEYYPDTKVDVITMAKSLGGGMPISAVTGRADIMDAPLPGSLGGTYAGNPLAVAASLAVLDIIAEEKLCERALILGAKLVDVLEKAQMSNAAIVGIRARGSMVAVEFNDPVSGKPSPELTRAYQRQALEEGLLLLSCGVHSNVIRFLYPLTIPDKQFKQAMNILTRLLAS

SEQ ID NO: 15687 - protein, 365 aa, Yersinia pestis KIM
MHYVLESNYMIELSVDNLHLTYGDNPVLKGVSMELKRGEVVSLLGPSGSGKTTLLRAVAGLEKPSQGHIIIGEKTVYDGSSHSEIPAEERNLGLVFQSYALWPHKTVSENVAYPLKLRKISTSEISQRVQAVLEQLGLGALGNRHPHQLSGGQQQRVAIGRALVYNPPVILLDEPLSNLDAKLREEARVFLRELIMNLGLSALMVTHDQNEAMAISDRILLLNNGKIEQQGTPQEMYGSPSTLFTAEFMGSNNRLHGKIIDVRDGKARIEGKDWGLWGWAGEGVTAGQEGTAVIRVERVRLGDNLDGNQLELPLLTSMYLGDRWEYLFRTVADDFVIRAYGPEVRGKESCHLSLPTEHLWIFPKL

SEQ ID NO: 15688 - protein, 372 aa, Yersinia pestis KIM
MFVSNRSKSMSIEINNISKYFGRTKVLNDITLDIPSGQMVALLGPSGSGKTTLLRIIAGLENQNAGRLSFHGTDVSRLHARDRRVGFVFQHYALFRHMTVFDNIAFGLTVLPRRERPNAAAIKQKVGQLLEMVQLGHLAERFPSQLSGGQKQRVALARALAVEPQILLLDEPFGALDAQVRKELRRWLRQLHEELKFTSVFVTHDQEEAMEVADRVVVVSQGNIEQVGTPDEVWREPATRFVLEFLGEVNRLSGEIRGSQLFIGAHHWPLDLAPMHQGSVDLFLRPWEMEVSTQSSDRCPLPVQVLEVSPRGHFWQLTVQPIGWHQDPISVVLPEGNIDAPVRGNRYYVGGLNARLYSGNQLLQPIALAQSA

SEQ ID NO: 15689 - protein, 292 aa, Yersinia pestis KIM
MTTLEHCIGHTPLVKLQRLSQGLNAEIWVKLEGNNPAGSVKDRAALAMIQQAELRGDIAPGDVLIEATSGNTGIALAMIAAMKGYHLKLLMPENMSQERQAAMRAYGAELILVSREQGMEGARDLALTMQENGEGNVLDQFNNADNPYAHFTGTGPEIWQQTAGKVSHFVSSMGTTGTITGVSQYLKSQNPQVKVIGLQPAEGSSIPGIRRWSAEYIPGIFRPELVDQVLDITQSVAEQTMRRLAKEEGIFCGVSSGGAVAGALRIAADNPDAVIVAIICDRGDRYLSTGVF

SEQ ID NO: 15690 - protein, 322 aa, Yersinia pestis KIM
MSKIYEDNSLTIGHTPLVRLNRIGNGRILAKVESRNPSFSVKCRIGANMIWDAEKRGILTAGKELVEPTSGNTGVALAFVAAARGYKLTLTMPETMSIERRKLLKALGANLVLTEGAKGMKGAIAKAEEIQATDPERYLILQQFSNPANPEIHEKTTGPEIWEDTDGDVDVFVSGVGTGGTLTGVSRYIKNTQGKAITTVAVEPTDSPVITQALAGQEIKPGPHKIQGIGAGFIPGNLDLSLVDRVALVTNEEAISMARRLMDEEGILAGISSGAAVAAAVKLSEEEGFTDKTIVVILPSSGERYLSTALFADLFTEQELQQ

SEQ ID NO: 15691 - protein, 411 aa, Yersinia pestis KIM
MAELPAKRRFTRIDRLPPYVFNITSELKMAARRRGEDIIDFSMGNPDGPTPPHIVEKMCSVAQREDTHGYSTSRGIPCLRRAISRWYADRYQVDIDPENEAIVTIGSKEGLAHLMLATLDHGDTVLVPNPSYPIHIYGAVIAGAQVRSVPLTEGIDFFGELERAIRETIPKPKMMILGFPSNPTAQCVELDFFERVVALAKQYDVLVVHDLAYADIVYDGWKAPSIMQVPGAKDIAVEFFTLSKSYNMAGWRIGFMVGNPELVSALARIKSYHDYGTFTPLQVAAIAALEGDQQCVRDIAEQYRQRRNALVRGLHEAGWMVDNPKASMYVWAKIPEPYAHLGSLEFAKRLLAEAKVCVSPGIGFGDYGDTHVRFALIENQDRIRQAVRGIKSMFRADGLLKPGKSSPNEMA

SEQ ID NO: 15692 - protein, 240 aa, Yersinia pestis KIM
MINFKNVSKHFGKIQVLHDINLNITQGEVVVIIGPSGSGKSTLLRCINKLEVITRGQLIVDGLDVNSPNIDERQIRLEAGMVFQQFYLFPHLTALENVAFGPTKVRGTSKEEAKKQALALLSKVGLEDRAHHYPAELSGGQQQRVAIARALAVKPKLMLFDEPTSALDPELRHEVLTVMKDLAEEGMTMVIVTHEVGFAQKVASRLIFIDKGRIAEDGDPDSLISNPPSERLREFLQHVS

SEQ ID NO: 15693 - protein, 339 aa, Yersinia pestis KIM
MDYIKLGHCGLQVSRLCLGTMNMGSKQWKPWVFDKAESTPLIKHALDCGINFIDLADFYSAGVGEEVVGRIVKNLMSRDELVLTTKVGYPIGHGPNNQGHSRKHIMASIDASLKRLGTDYIDIYMLHYFDINTPVEETWSAMNDIIHSGKARYTGVSTMFTWQLSKILWCCERNGFAKPINMQLQLNCAYREEEREMIPQCRDQGLGISAFSPLARGLLSCDFSSVRNKTDFFTQEMYADVTSLNIAQSVERVAKNRGITPAQVAQAWVLNHPGTDCMLVGADTIEQINSAVTALRISLNAEEHFELERNYTPCDVINDYTAGQRIAREARPPSGIFAP

SEQ ID NO: 15694 - protein, 452 aa, Yersinia pestis KIM
MQTLPSEKIRMDDVPLNRFHIRIAGLTFGAHFIDGYILGLIGFALIQLKPIMALTPLWEGLLGSAALIGLFLGSLILGWISDYIGRQKIFSFSFVIITLASALQFFASTPEQLFILRVIVGIGIGGDYSVGHTLLAEFSPRKHRGVLLGAFSVIWTFGYVSASFVGHYLSMVSPEAWRWLLSSAALPALLILLVRIGTPESPRWLMGKGREDDAMAIVHKYFGPNVTLIDEEPATSTRRFLSLFGRKYWRRTAFNSLFFVCLVIPYFAIYTFLPSILNVMALSQNFATDLLLNGLLVVGALVGIVLTAFCSRRSFLISSFIFLATCLLLLSILPSNQTFWLIALFAAFTLVMSAVSNLVGVFPAESFPTEVRSMGVGFATSMSRLGSAIGTSLLPLAIVNYGMPVTTTLLAFVLIIGAIVSIAWAPETKGLTLVDASQSATTPRPPSSIIPN

SEQ ID NO: 15695 - protein, 348 aa, Yersinia pestis KIM
MLTHRHAIKRNIMTLLTHLPANMVAIEITQFGGPEVLVPAKRPTPMPAAGEILVKVSAAGVNRPDVMQRRGQYAPPPGASDIPGLEVAGEVVATAADVTRFKIGDNVCGLIAGGGYAQYCVIHETNALPIPQGLSAIEAAALPETFFTVWTNLFQRGHFTAGETVLIHGGSSGIGTTAILLSKAFGAATVIVTVGSEEKRQACLNLGADIAINYHTQDFVAETKRATAGKGADVIVDLIAGDYVARNYDAAAMNGRIVQIGTQNGHAKDLNLMLMLIKRLTHTGSTLRSRTVAEKALIANELEQHVWPLLSEGKMKPQIFSTFPLEAAAKAHELMESSTHIGKIVLTA

SEQ ID NO: 15696 - protein, 285 aa, Yersinia pestis KIM
MKTAKLFSPLKVGALTLPNRVFMAPLTRLRSIEPGDIPTPLMAEYYRQRASAGLIITEATQISFQAKGYAGAPGLHTQEQLNAWKKVTQGVHNEGGHIAVQLWHVGRISHNSLQPGQQAPVAPSAIAADTRTTVRDETGAWVRVPCSTPRALETEEIPGIINDFRQATANAREAGFDYIELHAAHGYLLHQFMSPASNQRTDQYGGSIENRTRLTLEVVDATAAEWGADRIGIRISPLGPFNGLDNGEDQEEAALYLIGPNAESGATDMTSFICRYCEPGRKPKM

SEQ ID NO: 15697 - protein, 291 aa, Yersinia pestis KIM
MERYQQLFKQLAAKKEGAFVPFVQLGDPSPAMSLNIIDTLIAAGADALELGIPFSDPLADGPTIQNAALRAFAAGVTPGICFEILAEIRQKHPTIPIGLLMYANLVFHNGIDHFYQRCAEVGVDSVLIADVPFEESAPFRAAALRHGIAPIFICPPNADDDLLREIASHGRGYTYLLSRAGVTGAENHGQLPLNHLVDKLREYNAAPALQGFGISEPAQVKASLAAGAAGAISGSAIVKIIEKNVAQPVEMLVHANPLRHRDESGNPQLVIIYNWLLLRVSYRLELITIYR

SEQ ID NO: 15698 - protein, 446 aa, Yersinia pestis KIM
MVNRISDFCWGAEIHSDDEFLNLLFTLIKGGNMEQPSPVTRQSFDEWIVPTYAPADFIVVRGEGSTLWDQQGKSYIDFAGGIAVNALGHGHPAVRAALIEQADKVWHLGNGYTNEPVLRLAKQLIDATFAEKVFFCNSGAEANEAALKLARKYALDNFANKAGQQGEKNQIVAFRNAFHGRTLFTVSAGGQPKYSQDFAPLPGGIHHGIFNDLASAEHLITDQTCAVIVEPIQGEGGVLPADKEFLHGLRALCDRHNALLIFDEIQTGVGRTGELYAYMHYGVSPDVLTSAKALGGGFPIGAMLTTTKYASALSVGSHGTTFGGNPLACAVAGTVLSLINQPTLLAGVKARHQWFIDELAEINARHNVFAEIRGRGLLIGCVLNAQYAGKSKEIVQAAAQYGLIALIAGPDVVRFAPSLIISPKEIKEGLARLAMGIEQVCQKVTS

SEQ ID NO: 15699 - protein, 340 aa, Yersinia pestis KIM
MEITDMPTDDSNNGIIDYVSTGHLPDPETVVKLVQEAHKRFSTDTAGVVSNVYPALERIPADLFGICMVGTNGKIHSAGDVDYEFTIMSVSKPFVFALVCQAIGAKTAREKLGVNSTGMAFNSVTAIERASDGRTNPMVNSGAIATTSLVPGATSDEQWKFIYDGLCRFAGRELTLNEEVYQSACETNFRNRGIANVLQGYGRLGCDPIIATDLYTRQCSLNVSARDLAVMGATLADGGVNPLTRERVVDNDICHYALAVMVTAGLYETSGDWLYDIGLPGKSGIGGGIVTVSPGKGGLGTFAPLLDSAGNSIKGQLAARFLSRSLGMDMFVSEPYTEKN

SEQ ID NO: 15700 - protein, 425 aa, Yersinia pestis KIM
MRCSQELKSQSVKEIFMRWFSDLNQTERKTFIAAFGGWALDALDFMVFTFVIATLMALWQIDAGQAGMLSTVTLLFSAIGGWGAGILADRYGRVRILQITILWFSLCTVLIGFAQNFEHVFILRALQGLGFGGEWAVGSVLMGEIVRAEHRGKAVGTVQSGWAIGWGAAALLYTLMFSVLSEEWAWRALFWIGVLPALLVLYIRKNVPEPALFLKSRHEQQAKDRRVSSFAIFSPALLKTTVLASLLCTGVQGGYYAITTWLPTFLKLERNLSVIGTGGYLMVIIFGSFVGYICGAYLTDKLGRRANLIIFSLLSCITIFAYTQLTLTNTQMLVLGFPLGFSASGIFSGMGAFLTELFPSAVRATGQGFTYSFGRAVGALFPGLVGYLSQSSSLAFAIGVFAGSAYCIVLVMSLLLPETKNKQLE

SEQ ID NO: 15701 - protein, 474 aa, Yersinia pestis KIM
MGKMVDQSKIVAEPLQEPEEHLQRSLSNRHIQLIAIGGAIGTGLFMGSGKTISLAGPSIIFVYMIIGFMLFFVMRAMGELLLSNLNYKSFSDFSADLLGPWAGFFTGWTYWFCWVITGIADVVAITAYAQFWFPDFSQWVASLLVVLLLLSLNLATVKMFGEMEFWFAMIKIVAIVALIFAGLTMVLVSYQSPSGTTASFTHLWSDGGMFPKGISGFFAGFQIAVFAFVGIELVGTTAAETKDPEVVLPRAINSIPIRIIMFYVFSLIMIMSVTPWSSVVADKSPFVELFVLVGLPAAASVINFVVLTSAASSANSGVFSTSRMLFGLAKEGNAPKQFGKLSRRSVPATGLTFSCICLLGGVVLIYLIPNVMTVFTLVTTVSAILFMFVWTIILCSYLVYRKRRPALHKKSIYKMPAGIFMSWVCMAFFAFVLVLLTLESDTRQALIVTPLWFVILTASYIFLKKRRARLYNSK

SEQ ID NO: 15702 - protein, 339 aa, Yersinia pestis KIM
MIHQFLGGHVTLQQKLTQFPRLDLVGNATPLEKLSRLSDYLGREIYIKRDDVTPVALGGNKLRKLEFLAADALRQGADTLVTAGAIQSNHVRQTAAVAAKLGLHCVALLENPIGTEQANYLTNGNRLLLDLFNVDVVMCEALNDPNQQLAELATRVEAQGFRPYVVPIGGSNALGALGYVQCSLEIAAQAAGNVAFSSVVVASGSAGTHAGLAVGLQQLLPDAELIGVTVSRSADEQRPKVAQIQQALATSLGMTDPLAKITLWDSYFAPQYGMPNEEGIAAIKLLARLEGILLDPVYTGKAMAGLLDGIEQQKFCDKGPILFIHTGGAPALFAYHPQV

SEQ ID NO: 15703 - protein, 465 aa, Yersinia pestis KIM
MKIVNHWIDGKNITSNDYFTTINPATGEVLADVASGGIKEINQAVAAAKSAFPHWANLPMKVRARLMRRLGELIEQQIPEIAQMETQDTGLPIYQTQNALIPRAAHNFEFFAEICQQMNGQTYPVDDQMLNYTLVQPVGVCALVSPWNVPFMTATWKVAPCLALGNTAILKMSELSPLTADKLGELALEAGIPAGVLNVVQGYGATVGDALVCHQDVRAISFTGGTATGNRIMQRAGLKKYSMELGGKSPVLIFDDADIERAMDAALFSIFSLNGERCTAGSRIFIQESLYSAFIQRFAERASRLRVGDPQDLDTQVGALISKPHWDKVSGYIQLGIEEGATLLAGGPDKPIDLPAHLRGGHFLRPTVLADVDNRMRVAQEEIFGPVACLIPFKNEDAGLRLARSIEAGMVFVNTQNVRDLRQPFGGIKASGTGREGGKYSFDVFAEVKNVCISMGEHPIPRWGM

SEQ ID NO: 15704 - protein, 503 aa, Yersinia pestis KIM
MFVPQPSNKPLSLMLAGLSVKKTAADSFMKCVVYSHQCVISATEGRMEQQLQNSSLKRGLKNRHIQLIALGGAIGTGLFLGIAQTINMAGPSVILGYAIGGFIAFLIMRQLGEMVVEEPVAGSFSHFAYKYWGDFAGFLSGWNYWAMFILVGMAELTAVGIYIQYWWPEIPTWVSAAVFFIIINAINLVNVRLYGETEFWFAIIKVAAIIGMIVFGAYLLASGSGGPAASVTNLWAQGGFMPHGFRGLIMAMAVIMFSFGGLEMVGITAAEAEDPRNSIPKATNQVVYRILIFYIGSLTVLLSLFPWNNVVEGGSPFVMIFDALDSPWVATALNVVVLTAALSVYNSGVYCNSRMLFGLASQGNAPKLLTKLNKRGVPIRSIALSALATSAGVVINYIMPGKAFELLMALVVSTLVINWVMICLAHLKFRKAKVKEGVVPRFKALWYPYGNYLCLVFLALILVIMYLTEGIRISVLMMPVWIALLWCGFVLTRRKCPKTVTSL

SEQ ID NO: 15705 - protein, 486 aa, Yersinia pestis KIM
MALRLVTGVILQTGVFLMSKQQIGVVGMAVMGRNLALNIESRGYSVSIFNRSSDKTDEVVAENPGKNLVPSYTVEEFVDSLEKPRRILLMVKAGEATDKTIASLTPHLDKGDILIDGGNTYYKDTIRRNRELSAQGFNFIGTGVSGGEEGALKGPSIMPGGQKEAYELVAPILEKIAARADDGDACVAYIGADGAGHYVKMVHNGIEYGDMQLIAEAYSLLKQSLGLSNEELASTFAEWNKGELNSYLIDITKDIFTKKDEDGNYLVDVILDEAANKGTGKWTSQSSLDLGEPLTLITESVFARYLSSLKDQRVAASKVLTGPKVQPFTGDKAEFIEKIRRALYLGKIVSYAQGFSQLKAASNENNWDLNYGEIAKIFRAGCIIRAQFLQKITDAYAENADIANLLLAPYFKQIADEYQQALRDVVSYAVQNGIPTPTFSAAINYYDSYRSAVLPANLIQAQRDYFGAHTYKRTDKEGVFHTEWMA

SEQ ID NO: 15706 - protein, 379 aa, Yersinia pestis KIM
MEMIKTRAAVAWGPNQPLSVEEVDLMPPQKGEVLVRIVASGVCHTDAYTLSGADPEGVFPTILGHEGGGIVEAIGEGVTSVAVVDHVIPLYTPECGECKYCRSGKTNLCQAIRSTQGKGLMPDGTTRFSKNGQPIFHYMGTSTFSELTVVPEISLAKINKEAPLEEVCLLGCGVTTGMGAVMNTAKVKPGDTVAIFGLGGIGLSAVIGAQMAGASRIIGIDLNTSKFELARKLGATDLINPKDYDKPIQEVIVELTDGGVDFSFECIGNVNVMRSALECCHKGWGESVIIGVAGAGEEISTRPFQLVTGRVWRGSAFGGVKGRSELPGIVQQYLDGKFALNDFITHTMALDQINEAFDLMHEGKSIRSVIHFNHSSESK

SEQ ID NO: 15707 - protein, 498 aa, Yersinia pestis KIM
MSEYHEKNNALFKSITALDGALFINGEFRKGAGGRLPVENPATGKVIGHLAAATPEEIEEAVAAARRAFPAWAAERPKARANALHRLGDLIAGDALNMARNMTIEQGKPVNEAQGEILKLAEICHFYGEEATRVQGDVVPNDPPGFQSLVVREPVGVVGAITPWNYPAELVGWKLCASLAAGCTLIIKPAELTPYTALAIAEKCLEAGIPAGVVNVLTGKGEQVGQALVEHPQVDKIAFTGSSAVGLHIQQSCPQVKRLSLELGGNGPMVVTACADVAAAVKGAVRRSFRNCGQVCIAINRIYVHRSCYRAFVSKMGVATNGLRLGNGLDDPAADLGAMASVEPLNKTRAHLEDALAKGARLVAGGKAPEGVEYAKGHFFRPTVLADCTHQMRVMTEETFGPLVGLAPFDDIDEVISRANDTPYGLAAYVYARDLAAIHRLSAALDYGNVAINNVDASMMNAPYGGRKQSGVGYEHGREGLLEYFNFKHIRLYHGIGD

SEQ ID NO: 15708 - protein, 487 aa, Yersinia pestis KIM
MPAVIREIVMSYQQLPKDFLWGGAVAAHQVEGGWDKGGKGVSIADVLSGGSHGVDRVMTDGVLEGYRYPNHEAVDFYSHYKEDIALFAEMGFKCFRTSIAWTRIFPHGDEQQPNEAGLQFYDDMFDELLKYGIEPVITLSHFEMPWHLVKEYGGWKNRKVVDFFVKFSEVVMARYKSKVKYWMTFNEINNQRNWKYPLFGYCCSGVVFTEQENPEETLYQVLHHQFVASAKVVKLGHAINPEFKIGCMVAMVPLYPFSCHPDDMMYSVEAMRERYLFGDVHMRGYYPSYILQEWARRGFNIHMEEGDLETLRDGCADYMGLSYYMSNAVSAINPGSGNSLSGFEGSVPNPHVKASDWGWQIDPVGLRYSLSVLYERYQKPLFIVENGFGAIDKVAADGMVHDDYRIAYLKAHIEQMKKAVFEDGVDLMGYTPWGCIDCVSFTTGEYSKRYGFIYVDKNDDGTGTMARSRKLSFDWYKKVIASNGEVL

SEQ ID NO: 15709 - protein, 444 aa, Yersinia pestis KIM
MSTDDQKVGLIPVTLMVAGNIMGSGVFLLPANLASTGGIAIWGWLVTIIGALALSMVYAKISSLDDSPGGSYAYARRAFGPFLGYQTNVLYWLACWIGNIAMVVIGVGYLSYFFPILKEPMVLTITCVVFLWIFVGLNIIGPKMITRVQAVATSLALIPIVGIALFGWFWFKGETYMAAWNVSGLGTFGAIQSTLNVTLWSFIGVETASVAAGVVKNPKRNVPIATVGGVLIAAVCYVLSSSAIMGMIPNAELRLSASPFGDAARLALGDTAGAVVSLCAAAGCLGSLGGWTLVAGQTAKAAADDGLFPPIFGKVNKAGTPVAGLLILGVLMTIFQISSISPNAAKEFGLVSSVSVIFTLVPYLYTCSALLLVGHGHLGNQVKTYVGITLIAFVYCIWAVVGSGAEEVMWSFVTLMVITALYTFNYNRTHKNPFPLDAPVKNGQ

SEQ ID NO: 15710 - protein, 278 aa, Yersinia pestis KIM
MIRLIERSQRTCSLKYDGHIPNLIGVNVMAVTKLVLVRHGESQWNNENRFTGWYDVDLSEKGRSEAKAAGKLLKDEGFTFDFAYTSVLKRAIHTLWNILDELDQAWLPTEKTWKLNERHYGALQGLNKSETAEKYGDEQVKQWRRGFAITPPALEKSDERFPGHDPRYAKLTDAELPTTESLALTIERVIPYWNDVIKPRIASGERVIIAAHGNSLRALVKYLDDLGEDEILELNIPTGVPLVYEFDENFKPIKHYYLGNADEIAAKAAAVANQGKAK

SEQ ID NO: 15711 - protein, 308 aa, Yersinia pestis KIM
MVTTLDNALLNDILQQVRPLIGQGKVADYIPALAEVPANKLGIAVCTLDGQIFQAGDADERFSIQSISKVLSLTLALSRYSEQDIWQRVGKEPSGQPFNSLVQLELEKGKPRNPFINLGALVVCDMLQSRLSAPKQRLLEVVRQLVKDDSISYDPRVARSEFEHSDRNAAIAYLMKSFGNFDNDVLTVLQTYFHYCAMRMSCVELARCFVYLANQGRSISGSESLITPMQARQINALMITSGMYDGAGEFAFRVGMPGKSGVGGGIIAIVPDEFCIAVWSPELDHAGNSLAGTAALERLAQQMGRSIF

SEQ ID NO: 15712 - protein, 477 aa, Yersinia pestis KIM
MTNPGDISMSAEHVLTMLNEHEVKFVDLRFTDTKGKEQHITIPAHQVNADFFEEGKMFDGSSIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHAFGKTATFMPKPMFGDNGSGMHCHMSLSKNGNNLFAGDKYGGLSEIALFYIGGIIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEAMAALNEDREFLTRGGVFTDDAIDAYIELRREEMDRVRMTPHPVEFELYYSV

SEQ ID NO: 15713 - protein, 453 aa, Yersinia pestis KIM
MHLQNTLRPEMWFFLKSRDNVPLVTDQTQIDSSYKYWRIQLMWTMYIGYAAFYFTRKSFNFIMPAMLTDLGLSMSDVGILGTLFYITYGCSKFVSGMISDRSNPRYFMGIGLVMTGIINILFGMSSSLLVLGALWILNAFFQGWGWPPCSKILTSWYSRSERGGWWAIWNTSHNFGGALIPLLVGVITLHFSWRYGMIIPGIIGVVIGLLMCWRLRDKPSTMGLPSVGKWRNDAMELIQESEGQGLSNKEIVKRYVLTNKYIWLLAVSYVLVYIVRTAINDWGNLYLTQEKGYSLLTANSAISLFEVGGFIGSLVAGWGSDKWFRGNRGPMNLIFAIGIFLSVASLWTLPSISFVLQAGCFFAIGFFIFGPQMLIGMAAAECSHKDAAGAATGFVGLFAYLGAALSGYPIARVMEIWHWNGFFVVISVAACLSAFFLLPFLRAQSPQLKQATT

SEQ ID NO: 15714 - protein, 314 aa, Yersinia pestis KIM
MTSKNIAVIGECMIELSQKGTDLSRGFGGDTLNTAVYIARQVSAPDLNVHYVTALGTDSFSEEMLTAWQQENIQTDLIQRMDNKLPGLYFIETDESGERTFYYWRNDAAARFWLTSPAADDICQRLETFDYLYLSGISLAILDSASRQRLLKLLRACRAKGGKVIFDNNYRPRLWQSKEETQEAYRDMLACTDIAFLTLDDEDMLWGEKPLEQVIDRTQALGVSEIIIKRGADSCIVWVKEGSEAQQYDVPAVKLPKEDVVDTTAAGDSFSAGYLAVRLTGGNAHDAAVRGHLTASTVIQYRGAIIPLAAMPTA

SEQ ID NO: 15715 - protein, 460 aa, Yersinia pestis KIM
MTGYLMETTLMTKHYDYLAIGGGSGGIASINRAAMYGKKCALIEAKQLGGTCVNVGCVPKKVMWHAAQIAEAIHLYGPDYGFDTTVNHFDWKKLIANRTAYIDRIHQSYERGLGNNKVDVIQGFARFVDAHTVEVNGETITADHILIATGGRPSHPDIPGAEYGIDSDGFFELDEMPKRVAVVGAGYIAVEIAGVLNGLGTETHLFVRKHAPLRTFDPLIVETLLEVMNTEGPKLHTESVPKAVIKNADGSLTLQLENGTEVTVDHLIWAIGREPATDNLNLSVTGVKTNDKGYIEVDKFQNTNVKGIYAVGDNTGVVELTPVAVAAGRRLSERLFNNKPDEHLDYSNIPTVVFSHPPIGTIGLTEPQAREKFGDDQVKVYTSSFTAMYSAVTQHRQPCRMKLVCVGAEEKIVGIHGIGFGMDEILQGFAVAMKMGATKKDFDNTVAIHPTAAEEFVTMR

SEQ ID NO: 15716 - protein, 229 aa, Yersinia pestis KIM
MEKRMKKYLIAPSILSADFARLGEDTAKVLAAGADIVHFDVMDNHYVPNLTIGPMVCKALRDYGITAPIDVHLMVKPVDRIVPDFAKAGATYITFHPEASEHVDRTLQLIKESGCKAGLVFNPATPLSYLDYVMDKLDVILLMSVNPGFGGQSFIPETLNKLRQVRKLIDDSGYDIRLEVDGGVKVENIRQIAAAGADMFVAGSAIFNQPDYAAVIDAMRNELAMAANG

SEQ ID NO: 15717 - protein, 409 aa, Yersinia pestis KIM
MGSVMTDKLAVNRNTFDQVILPVYAPAQFIPVKGKGSRVWDQQGTEYIDFAGGIAVTALGHCHPALVSALHQQGETLWHTSNVFTNEPALRLAQKLIAATFADRVFFANSGAEANEAAFKLARHYAIERHSPYKTKIIAFHNAFHGRTLFTVSVGGQPKYSDGFGPKPADIIHVPFNDLAAVKAVMDDHTCAVVLEPIQGEGGITSATPEFLQGVRALCDQHNALLVFDEVQSGMGRSGKLFSYMHYGVTPDILTTAKALGGGFPISAMLTTEEIASVMTVGTHGTTYGGNPLACAVAEAALDVINTPEVLNGIEQRHGLFVQALQSINSKYDVFSDIRGMGLLIGAELTAKYRGQAREFLAAAAANGLMILNAGPDVLRLAPSLVIELEDIQQGMARLEKAMASVIKG

SEQ ID NO: 15718 - protein, 279 aa, Yersinia pestis KIM
MLGVRVLKPMEKWMKSLFKVTLLATAMTLTLNTSTVFAADATSPVVTNSAFKNNDQQSAYALGASLGRYMDNSLKEQEKLGIKLDKDQLIAGVQDAFANKSKLTDEEIEKTLQNFEARVKASAQAKMEQDAKENADKGAKYRDTFAKEKGVKKTASGLLYKVENAGTGDAPKDSDTVVVNYKGTLADGTEFDNSYKRGEPLSFRLDGVIPGWTEGLKQIKKGGKITLVIPPELAYGKAGVPGIPANSTLIFDVELLDVKAAAKADAQEQQPAVDTKAKK

SEQ ID NO: 15719 - protein, 472 aa, Yersinia pestis KIM
MRECTMKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWNSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERAKSSEMPS

SEQ ID NO: 15720 - protein, 335 aa, Yersinia pestis KIM
MIFTLREIYVLLCTSIKKECVMELKDIGNTELIELKNLSINNNSLFSKCEFNNPTGSHKDRTFLHILNILEEENKIIPGMTLIDCSTGNGGAALAWIGQKKGYKIKIFMPEGMTEERKEQIYSFGGEIIETPKENFLKGAVKAATEYSNHQKNIFFLNQSDTTLNKDAWHSCGEEIVRKMKEINKKPDYFICSIGTGGTFSGIAEILKKAYPRIHTVGIEVDQSAPIYSQRHGLNFHHKHHNLMGLGAGVISVNTLLDLIDEVRVVNGKAAWERMKSFIEKERLGIGPTCGANLLITEDIMQEVNGKVIVTLFFDSAWKYKSCWDGVYPGYKETQ

SEQ ID NO: 15721 - protein, 338 aa, Yersinia pestis KIM
MKYDGYNWLECVMKPSIVLYKSIPTDLHQRLAQHFTVNSFDGLTPDNQPELLAALQQAEGLIGSGGKIDQDFLQLAPNLRAASTISVGYDNFDVEALSQRGIALMHTPTVLTETVADTMMALMLSTARRVVELAERVKAGEWQESIGDDWFGVDVHHKTIGILGMGRIGMALAQRAHFGFSMPVLYTSRRPHEAAEQRFGARHCSLDTLLAEADFLCITLPMTEQTYHMIGREQLAKMKSSAILINAGRGPVVDEQTLIAALQDGTIHAAGLDVFEQEPLPVDSPLLTLRNVVAVPHIGSATHETRYNMAACAVDNLINALTGTVKENCVNPQVLITH

SEQ ID NO: 15722 - protein, 461 aa, Yersinia pestis KIM
MIFVIGYAPTITPFSGTLRMSKSNLDTEQGLLERVFKLKQHGTTARTELIAGITTFLTMVYIVFVNPQILGVAGMDVQAVFVTTCLIAAFGSIFMGLLANLPVALAPAMGLNAFFAFVVVGAMGISWQVGMGAIFWGAIGFLLLTIFRIRYWMIANIPLSLRVGITSGIGLFIAMMGLKNAGIVVANPDTLVAVGNLTSHSVLLGALGFFIIAVLASRNIHAAVLVSIVVTTLIGWALGDVHYSGVFSMPPSVTSVVGQVDLAGALNIGMAGIIFSFMLVNLFDSSGTLIGVTDKAGLADHKGKFPRMKQALYVDSISSVAGAFIGTSSVTAYIESSSGVSVGGRTGLTAVVVGILFLLVIFISPLAGMVPAYAAAGALIYVGVLMTSSLARVKWDDLTEAVPAFVTAVMMPFSFSITEGIALGFISYCLMKLGTGRWREISPCVVVVALLFMLKIAFVDH

SEQ ID NO: 15723 - protein, 466 aa, Schizosaccharomyces pombe
MDIKGGRRGNVEDSLNKLSLSPPDNNSSFLSNHFQVRKSYSQAPARTLKPFASEDIKILLLENVNQSALSNLKDEGYQVEFLKTSMSEDDLVEKIKGVHAIGIRSKTRLTRRVLEAADSLIVIGCFCIGTNQVDLDFAAERGIAVFNSPYANSRSVAELVIGYIISLARQVGDRSLELHRGEWNKVSSGCWEIRGKTLGIIGYGHIGSQLSVLAEAMGLHVVYYDILPIMPLGSAKQLSSLPELLHRADFVSLHVPASPETKNMISSKEFAAMKEGSYLINASRGTVVDIPALVDASKSGKIAGAAIDVYPSEPAGNGKDKFVDSLNSWTSELTHCKNIILTPHIGGSTEEAQYNIGIEVSEALTRYINEGNSIGAVNFPEVSLRSLTEADRNAARVLFVHRNVPGVLRQVNELFIDHNIKSQFSDSRGDIAYLVADISDCTPGSLEALHQKLESLPCKINTRLLY

SEQ ID NO: 15724 - protein, 511 aa, Zea mays
MAVNEESEGEQAGATLEDLFFFNGEEDDDSDWEPASRLVVNRWFCLNCTMPNVDKITYCMNCRELPGSVVDGYDVFKKQIAQTALLSADTGLLPVSTAIGFDERMLLHSELEVKPNPHPERPDRLRAIAASLAAAGIFPSKCALVPPREITKEELLMVHSPDHIESVEQTKNMLYSYFTSDTYANGHSACAAKLAAGLCADLASLIVSGRVRNGFALVRPPGHHAGVKQAMGFCLHNNAAVAALAAKRAGAKKVLIVDWDVHHGNGTQEIFDGDKTVLYISLHRHEDGNFYPGTGAAHEVGVLDGQGFSVNIPWSRGGVGDDDYIFAFQTVVLPIASEFAADITIISAGFDAARGDPLGCCDVTPTGYSWMTSLLAGSSNGRLLVILEGGYNLRSISSSATEVVKVLLGEGPNRASFVVSPSKEALSTVSQVLKIQQQFWPVLGPTYASLQAQQGSVSSNHSNELKKRKRPGGGPGPFWWKMGSKRLLYEALIEPRSRPRKLKGSTGSAAP

SEQ ID NO: 15725 - protein, 407 aa, Zea mays
MLLHSELEVKPNPHPERPDRLRAIAASLAAAGIFPSKCALVPPREITKEELLMVHSPDHIESVEQTKNMLYSYFTSDTYANGHSACAAKLAAGLCADLASLIVSGRVRNGFALVRPPGHHAGVKQAMGFCLHNNAAVAALAAKRAGAKKVLIVDWDVHHGNGTQEIFDGDKTVLYISLHRHEDGNFYPGTGAAHEVGVLDGQGFSVNIPWSRGGVGDDDYIFAFQTVVLPIASEFAADITIISAGFDAARGDPLGCCDVTPTGYSWMTSLLAGSSNGRLLVILEGGYNLRSISSSATEVVKVLLGEGPNRASFVVSPSKEALSTVSQVLKIQQQFWPVLGPTYASLQAQQGSVSSNHSNELKKRKRPGGGPGPFWWKMGSKRLLYEALIEPRSRPRKLKGSTGSAAP

SEQ ID NO: 15726 - protein, 325 aa, Arabidopsis thaliana
MASNGDKGLIVSFGEMLIDFVPTESGVSLAEAPGFLKAPGGAPANVAIAVSRLGGRSAFVGKLGDDEFGHMLAGILRKNGVDDQGINFDTGARTALAFVTLRADGDREFMFYHNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFVGALLNQIVDDRSVLEDEERLRKVLRFANACGAITTTKKGAIPALPSDAEVRSFLEKK

SEQ ID NO: 15727 - protein, 483 aa, Arabidopsis thaliana
MENGEKAAETVVVGNYVEMEKDGKALDIKSKLSDMFWHGGSAYDAWFSCASNQVAQVLLTLPYSFSQLGMLSGILFQLFYGILGSWTAYLISILYVEYRTRKEREKVNFRNHVIQWFEVLDGLLGKHWRNVGLAFNCTFLLFGSVIQLIACASNIYYINDNLDKRTWTYIFGACCATTVFIPSFHNYRIWSFLGLLMTTYTAWYLTIASILHGQVEGVKHSGPSKLVLYFTGATNILYTFGGHAVTVEIMHAMWKPQKFKSIYLFATLYVLTLTLPSASAVYWAFGDLLLNHSNAFALLPKNLYRDFAVVLMLIHQFITFGFACTPLYFVWEKLIGMHECRSMCKRAAARLPVVIPIWFLAIIFPFFGPINSTVGSLLVSFTVYIIPALAHIFTFRSSAARENAVEQPPRFLGRWTGAFTINAFIVVWVFIVGFGFGGWASMINFVHQIDTFGLFTKCYQCPPPVMVSPPPISHPHFNHTHGL

SEQ ID NO: 15728 - protein, 468 aa, Arabidopsis thaliana
MDLSGCRDIISSLPEAISCHILSFLPTKEAASTSVLSKKWRYLFAFVPNLDLDESVYLNPENETEVSSSFMDFVDRVLALQGNSPLHKFSLKIGDGVEPDRIIPWINNVLERGVSDLDLHVYMETEFVFPSEMFLSKTLVRLKLMLYPLLEFEDVYLPKLKTLYIDSCYFEKYGIGLTKLLSGCPILEDLVLDDIPWCTWDFASVSVPTLKRLTFSTQVRDEFPKSVSIDTPNLVYLKFTDTVAGKYPKVNFDSLVEAHIDLRLLQGHQGYGENDMVGNATDFIMRICNVKTLYLSSNTLQVLTYSCDAIPIFNNLTHLTIESNPEVGWQSLPGLLKNSPNLETLIFQGLIHKATDKCGDVCLCKPREEIRSCLASSPVKVIKILKFGEISDDMEKQREQIKYFLETMPNLEKMILYYNTTSVEDVTEVSSRLQRLVSKLASSTCIVQLISDNLSLSSTVSTNGLLCF

SEQ ID NO: 15729 - protein, 478 aa, Arabidopsis thaliana
MDLLVMLLSLLVSYLIFKIWKRIDSKRDQNCYILDYQCHKPSDDRMVNTQFSGDIILRNKHLRLNEYKFLLKAIVSSGIGEQTYAPRLFFEGREQRPTLQDGLSEMEEFYIDTIEKVLKRNKISPSEIDILVVNVSMLNSTPSLSARIINHYKMREDIKVFNLTAMGCSASVISIDIVKNIFKTYKNKLALVVTSESLSPNWYSGNNRSMILANCLFRSGGCAVLLTNKRSLSRRAMFKLRCLVRTHHGARDDSFNACVQKEDELGHIGVHLDKTLPKAATRAFIDNLKVITPKILPVTELLRFMLCLLLKKLRSSPSKGSTNVTQAAPKAGVKAGINFKTGIDHFCIHTGGKAVIDAIGYSLDLNEYDLEPARMTLHRFGNTSASSLWYVLGYMEAKKRLKRGDRVFMISFGAGFKCNSCVWEVVRDLNVGEAVGNVWNHCINQYPPKSILNPFFEKYGWIHEEEDPDTFKMPEGFM

SEQ ID NO: 15730 - protein, 388 aa, Arabidopsis thaliana
MDKTFFSSNEGKPITCKAAICRKAGEALVIEDIHVDPPQAYEVRIKILCTSLCHTDLTFWKLSFGPISRFPRILGHEAVGVVESIGENVDGFKQGDVVLPVFHPYCEECKDCKSSKTNWCDRYAEDFISNTRRYGMASRFKDSSGEVIHHFLFVSSFSEYTVVDIAHLVKISPEIPVDKAALLSCGVSTGIGAAWKVANVEEGSTIAIFGLGAVGLAVAEGARLRGAAKIIGIDTNSDKFELGKKFGFTDFINPTLCGEKKISEVIKEMTEGGVDYSFECVGLASLLNEAFISTRTGTGKTVMLGMEKHAAPISLGSFDLLRGRVICGSLFGGLKSKLDIPILVDHYLKKELNLDSFITHELNFKEINKAFALLEEGKSLRCILWMDK

SEQ ID NO: 15731 - protein, 390 aa, Arabidopsis thaliana
MENGNSSSDNKSSHKPIRCKAAVSRKAGEPLVMEEIMVAPPQPFEVRIRIICTALCHSDVTFWKLQVPPACFPRILGHEAIGVVESVGENVKEVVEGDTVLPTFMPDCGDCVDCKSHKSNLCSKFPFKVSPWMPRYDNSSRFTDLNGETLFHFLNVSSFSEYTVLDVANVVKIDSSIPPSRACLLSCGVSTGVGAAWETAKVEKGSTVVIFGLGSIGLAVAEGARLCGASRIIGVDINPTKFQVGQKFGVTEFVNSMTCEKNRVSEVINEMTDGGADYCFECVGSSSLVQEAYACCRQGWGKTITLGVDKPGSQICLDSFDVLHHGKILMGSLFGGLKAKTHIPILLKRYLSNELELDKFVTHEMKFEEINDAFQLLLEGKCIRCVLWMG

SEQ ID NO: 15732 - protein, 114 aa, Arabidopsis thaliana
MGSSEKRSKDIMSDIPTFSAENLQNNLKVIQNSRTFLSIIAGVLAGIIGFNGLIGFVFYFVVMLITSVGLMAKAGFSADLYFDSWNRVLFDGFLGGLMSFVLFWTFAYDLVHIF

SEQ ID NO: 15733 - protein, 490 aa, Arabidopsis thaliana
MEIILVTLCLTTLLALLLLKSILKRTTTNNLNLPPSPWRLPVIGNLHQLSLNTHRSLRSLSLRYGPLMLLHFGRTPVLIVSSADVAHDILKTYDVICANRPKTKVIDKILRGGRDVAFAPYGEYWKQMKSICIQNLLSNKMVRSYKKIREDEIKLMIEKVENASSCSPPSPVNLSQLFMTLTNDIICRAALGRKYSSKEDGIDVENIVRAFSALVGEFPIGEYIPSLSWIDKIRGQDHKMEEVDKRFDEFLERVVKEHEDANKDTRSDLVDTLLTIQSDKSALKLIIWDMFLAGTATSLSFLEWAMTELMRNPKVMKKLQEEIRSSSRQGLFVTEKEAEKMDYLQAVIKEALRLRPPAPLMVPRVFSEDVTLKGYNIPAGTQVIINAWAIQRDTTTWGIDAEEFRPERHLDSILDFQGQDFKFIPFGSGKRICPGIGFTSALIGVTLANIVKRFNWRMDVEPQRVQHDLTEATGLVVFRKFPLIAIPSSA

SEQ ID NO: 15734 - protein, 381 aa, Arabidopsis thaliana
MDLSGSRDVISSLPDDISSHILSFLPTKEAASTSVLSKKWRYLFAFVPNLDLDDSVYLNPENETEISTSFMDFVDRVLALQGNSPLHKFSLKIGDGIDPVRIIPWINNVLERGVSDLDLHLNLESEFLLPSQVYLCKTLVWLKLRFGLYPTIDVEDVHLPKLKTLYIEATHFEEHGVGLTKLLSGCPMLEDLVLDDISWFIWDFASVSVPTLKRLRFSWQERDEFPKSVLLDTPNLVYLKFTDTVAGKYPKVNLDSLVEAHIDLRLLKPLLINYHQGYGENDMVGNATDFIMRICNVKTLYLSANTLQVLTYSCDAIPIFNNLTHLTIESNPRVGWQSVPGLLKNSPNLETLIFQGLIHKATYRCGDVCLCKKPRKEILSC

SEQ ID NO: 15735 - protein, 509 aa, Arabidopsis thaliana
MAVLIIFILLCLLSFLCYSLFFMKPKDSRDGRDLPPSPPSLPIIGHLHLILLSTLTHKSFQRLSSKYGPLLHLRIFHVPIVLASSASVAYEIFRDQDVNVSFRHSPPIEESLFLGSYSFISAPYGDYWKFMRKLMVTKILGPQALERSRRFREDELDRFYKTLLDKAMKKESVEIVEEAAKLNNNTICKMIMGRSCSEETGEAERIRGLVTESMALTKKIFLATIFHKPLKKLGISLFKKEIMSVSRKFDELLEKILVEHEEKMEEHHQGTDMMDVLLEAYRDENAEYKITRNHIKSMFVDLFIAGTDTSSTTIQWIMAEIINHPKILERLREEIDFVVGKTRLIQETDLPNLLYLQAIIKEGLRLHPPGPLLPRTVQERCEIKGFHIPEKTILVVNSYAIMRDPDFWEDPDEFKPERFLSISRSGQEDEIRDKFLKYIPFASGRRGCPGTNLAYASVGTAVGVMVQCFDWKIEGENVNMNEAAGTMVLTMAHPLKCTPVPRTLNLLPP

SEQ ID NO: 15736 - protein, 465 aa, Arabidopsis thaliana
MATSHPDPTTSRHVAVIGAGAAGLVAARELRREGHSVVVLERGSQIGGVWAYTSQVEPDPLSLDPTRPVVHSSLYRSLRTNIPRECMGFTDFPFATRPHDGSRDPRRHPAHTEVLAYLRDFAKEFDIEEMVRFETEVVKAEQVAAEGEERGKWRVESRSSDGVVDEIYDAVVVCNGHYTEPRHALITGIDSWPGKQIHSHNYRVPDQFKDQVVIVIGSSASGVDICRDIAQVAKEVHVSSRSTSPDTYEKLTGYENLWLHSTIQIAREDGSVVFENGKTIYADTIMHCTGYKYYFPFLDTKGEVTVDDNRVGPLYKHVFPPALAPSLSFIGLPWQITPFPMFELQSKWVAAVLSGRVSLPSQDEMMEDTKAFYDKLEASGIPKRYTHLMPDDSQFEYDNWLADQCEYPRIEKWREQMFYIGFKRIYAQSSTYRDNWDDDHLIVEAYDDFVKFMSSYQELLPMLKT

SEQ ID NO: 15737 - protein, 188 aa, Arabidopsis thaliana
MDPAGASVASAIGGEGEKFAVGNIYSVKVITGDEFRGIVMAYDPIPNFVFFEEGTKPRPGHLKNTRMVNASFITGLSYLGKTEDPLDSDNFSVDLNGLRAKEALAIRQAEADAERMGVGVTAEAQSIFDALSKTLPVQWENSDILVMKEVRVRSPYLSDCVFGGTDAANNRVKKVLELERRRLQLFGT

SEQ ID NO: 15738 - protein, 495 aa, Arabidopsis thaliana
MGNGVTKLSICFTGGGGERLRPKDISVLLPDPLDEGLGHSFCYVRPDPTLISSSKVHSEEDTTTTTFRTISGASVSANTATPLSTSLYDPYGHIDRAAAFESTTSFSSIPLQPIPKSSGPIVLGSGPIERGFLSGPIERGFMSGPLDRVGLFSGPLDKPNSDHHHQFQRSFSHGLALRVGSRKRSLVRILRRAISKTMSRGQNSIVAPIKSVKDSDNWGIRSEKSRNLHNENLTVNSLNFSSEVSLDDDVSLENQNLQWAQGKAGEDRVHVVVSEEHGWLFVGIYDGFNGPDAPDYLLSHLYPVVHRELKGLLWDDSNVESKSQDLERSNGDESCSNQEKDETCERWWRCEWDRESQDLDRRLKEQISRRSGSDRLTNHSEVLEALSQALRKTEEAYLDTADKMLDENPELALMGSCVLVMLMKGEDIYVMNVGDSRAVLGQKSEPDYWLAKIRQDLERINEETMMNDLEGCEGDQSSLVPNLSAFQLTVITAQI

SEQ ID NO: 15739 - protein, 440 aa, Arabidopsis thaliana
MSHSWDGLGEIASVAQLTGLDAVKLIGLIVKAANTAWMHKKNCRQFAQHLKLIGNLLEQLKISEMKKYPETREPLEGLEDALRRSYLLVNSCRDRSYLYLLAMGWNIVYQFRKHQDEIDRFLKIIPLITLVDNARIRERFEYIDRDQREYTLDEEDRHVQDVILKQESTREAASVLKKTLSCSYPNLRFCEALKTENEKLQIELQRSQEHYDVAQCEVIQRLIGVTQAAAAVEPDSEKELTKKASKKSERSSSMKTEYSYDEDSPKKSSTRAASRSTSNVSSGHDLLSRRASQAQHHEEWHTDLLACCSEPSLCFKTFFFPCGTLAKIATAASNRHISSAEACNELMAYSLILSCCCYTCCVRRKLRKTLNITGGFIDDFLSHVMCCCCALVQELREVEIRGAYDLCRYGEDENKPAFVAVHGTLKSSIIQKVNKNNDLL

SEQ ID NO: 15740 - protein, 487 aa, Arabidopsis thaliana
MVTETVLATAVSNGKSKGCCKSGPGYATPLAAMAGPREKLIYVTALYSGTGRDKPDYLATVDVDPSSPTFSSVIHRLKMPYIGDELHHTGWNSCSSCHGDASADRRYLVLPGLISGRIYAIDTKTDPKAPSLYKVVEPKEIAEKTGLAFPHTSHCLASGDMLVSCLGDKEGNAKGNGFLLLDSDFNVKSRWDKPGHGPLFGYDFWYQPRFKTMISTSWGAPKAFSKGFNLQHVADGLYGSHLHIYQWPEGEMKQIIDLGNTGLLPLEIRFLHDPSKDTGYVGSALSSNMIRFFKNSDDTWSHEVVISVKPLKVENWILPEMPGLITDFLISLDDRFFYFVNWLHGDIRQYNIEDPKNPVLTGQIWVGGLLQKGSPYKAVGEDGNTYQFDVPQIKGKSLRAGPQMIQLSLDGKRLYATNSLFSAWDRQFYPEIMEKGSHIIQIDVDTDKGGLTLNPDFFVDFGDEPDGPALAHEMRYPGGDCTSDIWI

SEQ ID NO: 15741 - protein, 420 aa, Arabidopsis thaliana
MVCSSFIRSFIVQAGCRIGVLAQGRHQFIHIKKTLSVGFGFRTSVIGFRTTSGIGFRTSAKMMVDTSAGEKRISLVDMPPEKVDDGGYIGGGWKNDDGSLSCGYCSFRGKRSTMEDFYDIKASTIEGQAVCMFGIFDGHGGSRAAEYLKEHLFNNLMKHPQFLTDTKLALNETYKQTDVAFLESEKDTYRDDGSTASAAVLVGNHLYVANVGDSRTIVSKAGKAIALSDDHKPNRSDERKRIESAGGVIMWAGTWRVGGVLAMSRALGNRMLKQFVVAEPEIQDLEIDHEAELLVLASDGLWDVVPNEDAVALAQSEEEPEAAARKLTDTAFSRGSADNITCIVVKFRHDKTESPKIETNAMAESEPELNPTTELEPESNPSTALETESIPKAELESEPDAIPDPKPETEPETKGEKAGE

SEQ ID NO: 15742 - protein, 161 aa, Pseudomonas stutzeri
MSACNDYAVELKGVTFKRGERSIFDNVDIAIPRGKVTAIMGPSGCGKTTLLRLIAAQLMPARGEVWVAGNNLPSLSRSELFDMRKQMGVLFQSGALFTDLDVFENVAFPLRVHTRLPDEMIRDIVLMKLQAVGLRGAIELMPDELSGGMKRRVALARAIPL

SEQ ID NO: 15743 - protein, 332 aa, Oryza sativa (japonica cultivar-group)
MAASNIGMMDGAYFVGRNEILAWINTTLQLGLSKVEEAASGAVACQLMDAAHPGAVPMHKVNFDAKTEYEMIQNYKVLQDVFNKLKITKHIEVNKLTKGRPLDNLEFMQWMKRYCDSVNGGFMNSYNASERRESSKGGKETNRRTSVPSQAPAKSSSATHKAQASSHGAKKANGHAPNAPPSRSAKPSPANSAGPAYDEQITELKLLVDSLEKERDFYFSKLRDVEILCQSPEVEHLPIVNAIHKVLYAAEDDPSMVAEAQAMISQQQQSEQPMLSPILEASEERPAKQEAHKRKSISDLELEEFGMASSSRQRLSDISDVQLCGSPLTSFT

SEQ ID NO: 15744 - protein, 491 aa, Pseudomonas mendocina
MDTTRPAYQNLELQPLAGQWRAGSSGRPLEVFDPYNDELLLRIALASREDLDAAYRKARDSQREWATTAPAERARVLLEAVKIFDERREEIIDWIIRESGSTRIKAQIEWGAARAITLESASLPNRVHGRIIASNISGKESRVYRAPLGVIGVISPWNFPLHLTARSLAPALALGNAVVVKPASDTPITGGLLLARIFEEAGLPAGVLSVVVGSGAEIGDAFVEHPVPALISFTGSTQVGRNIGRIASGGEHLKHVALELGGNSPFVVLADADVEQAVNAAVVGKFLHQGQICMAINRIIVEQPLLEDFTRRFVERVKALPYGDPSKPGTVVGPVINARQLAGLKEKIATAKAEGATLLLGGEPQGNVMPPHVFGNVTADMEIAREEIFGPLVGIQSARDAEHALELANSSEYGLSSAVFTASLERGVQFARRIHAGMTHVNDIPVNDEPNAPFGGEKNSGLGRFNGDWAIEEFTTDHWITLQHSPRPYPF

SEQ ID NO: 15745 - protein, 157 aa, Staphylococcus aureus
GHSERRELFHETDEEINKKAHAIFKHGMTPIICVGETDEERESGKVNDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGA

SEQ ID NO: 15746 - protein, 392 aa, Sulfolobus solfataricus
MGEKMIKLLKFYQDRGIKIIKGEGQYVWDEKNNKYLDMHAGHGVAFLGHRNKVIIDHLKKQMEEISTLSLAFDTPIREEMIKELDELKPEDLDNLFLLNSGSEAVELALKIARKITKRRKIVAFKNSFHGRSMGALSVTWNKKYREPFEPLIGPVEFLEYNNVDSLKSITEDTAAVIVEPVQGEGGVIPAKKEFVKSLREVTEKVNALLIIDEVQTGFGRTGKIWAYQHFDIKPDILTAGKAIGGGFPVSAVFLPNWISEKIEEGDHGSTYGGNPLAAAAVTAACKVAKSEKIAEQAQKKGELFMRILKEKLEDFKIVREIRGLGLMIGIDLKVNPSIAIKVLQDEKVLSLKAGLTTIRFLPPYLITQSDMEWASDATRKGISETESKRVAS

SEQ ID NO: 15747 - protein, 477 aa, Mycobacterium tuberculosis
TEKTPDDVFKLAKDEKVEYVDVRFCDLPGIMQHFTIPASAFDKSVFDDGLAFDGSSIRGFQSIHESDMLLLPDPETARIDPFRAAKTLNINFFVHDPFTLEPYSRDPRNIARKAENYLISTGIADTAYFGAEAEFYIFDSVSFDSRANGSFYEVDAISGWWNTGAATEADGSPNRGYKVRHKGGYFPVAPNDQYVDLRDKMLTNLINSGFILEKGHHEVGSGGQAEINYQFNSLLHAADDMQLYKYIIKNTAWQNGKTVTFMPKPLFGDNGSGMHCHQSLWKDGAPLMYDETGYAGLSDTARHYIGGLLHHAPSLLAFTNPTVNSYKRLVPGYEAPINLVYSQRNRSACVRIPITGSNPKAKRLEFRSPDSSGNPYLAFSAMLMAGLDGIKNKIEPQAPVDKDLYELPPEEAASIPQTPTQLSDVIDRLEADHEYLTEGGVFTNDLIETWISFKRENEIEPVNIRPHPYEFALYYDV

SEQ ID NO: 15748 - protein, 342 aa, Thermotoga maritima
  misc_feature (1)..(1): Xaa can be any naturally occurring amino acid
  misc_feature (13)..(13): Xaa can be any naturally occurring amino acid
  misc_feature (160)..(160): Xaa can be any naturally occurring amino acid
  misc_feature (166)..(166): Xaa can be any naturally occurring amino acid
  misc_feature (172)..(172): Xaa can be any naturally occurring amino acid
  misc_feature (220)..(220): Xaa can be any naturally occurring amino acid
  misc_feature (237)..(237): Xaa can be any naturally occurring amino acid
  misc_feature (266)..(266): Xaa can be any naturally occurring amino acid
  misc_feature (272)..(272): Xaa can be any naturally occurring amino acid
XGSDKIHHHHHHXSKTLKEITDQKNELKKFFENFVLNLEKTEIFSEIQKNLTDEVLFVGCGSSYNLALTISYYFERVLKIRTKAIPAGEVAFQKIPDLEERGLAFLFSRTGNTTEVLLANDVLKKRNHRTIGITIEEESRLAKESDLPLVFPVREEAIVXTKSFSXILLSLXFLADKIAGNSTERFSELVGYSPEFFDISWKVIEKIDLKEHDHFVFLGXSEFFGVSLESALKCIEXSLTFSEAYSTLEYRHGPKALVKKGTLVFXQKVSGXDEQEKRLRKELESLGATVLEVGEGGDIPVSNDWKSAFLRTVPAQILGYQKAISRGISPDKPPHLEKTVVL

SEQ ID NO: 15749 - protein, 167 aa, Chlorella vulgaris
MPRSQRNDNFIDKTFTVIADILLKILPTSNKEKQAFSYYRDGMSAQSEGEYAEALQNYYEALRLETDAYDRSYILYNIGLIHTSNGDHARALDYYYQALERNPSLPQALNNIAVIYHYRGEQALESSQTEISKLLFDKAADYWREAIRLAPTNYIEAQNWLKMTGRF

SEQ ID NO: 15750 - protein, 409 aa, Chlorella vulgaris
MAREKFQRKKPHVNIGTIGHVDHGKTTLTAAITMALAARGGAKGRKYDDIDSAPEEKARGITINTAHVEYETENRHYAHVDCPGHADYVKNMITGAAQMDGGILVVSGADGPMPQTKEHLLLAKQVGVPNIVVFLNKEDQVDDAELLELLELEIRETLDKYEFPGDEIPIISGSALLALEALTENPETKPGDNKWVDKIYNLMDQVDSYIPTPERETEKPFLMAVEDVFSITGRGTVATGRVERGCVKIGDTVELVGLRDTKTTTVTGLEMFQKTLDESVAGDNVGILLRGVQKIDIERGMVLAKPGSILPHTKFEAQVYVLNKEEGGRHTPFFPGYRPQFYVRTTDVTGKIESFRADDNTATQMVMPGDRIKMIVELIQPIAIEKGMRFAIREGGRTVGAGVVSTIVI

SEQ ID NO: 15751 - protein, 236 aa, Chlorella vulgaris
MSILIENISKRFGSFQALDRVNLEIKNGSLVGLLGPSGSGKSTLLRVLAGLEKPDSGRIWLEGQDATQMKLQDREIGFVFQNYALFPHLTVSENVAFGLEIQKIDSLLKKKRVNELLKLMQLEKFGDSYPNQLSGGQRQRVALARALAMEPKVLLLDEPFAALDAKIRKQLRSWLRELHHKISVTTVFVTHDYSEAMELAQEIVLLENGKIIQIGSAQELSDHPTNTFVTNFLGLK

SEQ ID NO: 15752 - protein, 475 aa, Chlorella vulgaris
MSPQTETKARVGFKAGVKDYRLTYYTPDYQPKDTDILAAFRMTPQPGVPPEEAGAAVAAESSTGTWTTVWTDGLTSLDRYKGRCYDIEPVPGEENQYIAYIAYPLDLFEEGSVTNLFTSIVGNVFGFKALRALRLEDLRIPPAYVKTFQGPPHGIQVERDKLNKYGRGLLGCTIKPKLGLSAKNYGRAVYECLRGGLDFTKDDENVNSQPFMRWRDRFLFVAEAIYKSQAETGEIKGHYLNATAATAEAMMQRAECAKDLGVPIIMHDYLTGGFTANTSLSHYCRDNGLLLHIHRAMHAVIDRQRNHGITFRVLAKALRLSGGDHLHSGTVVGKLEGEREVTLGFVDLMRDDYIEKDRSRGIYFTQDWVSLPGTMPVASGGIHVWHMPALVEIFGDDACLQFGGGTLGHPWGNAPGAAANRVALEACTQARNEGRDLAREGGDVIRAACKWSPELAAACEVWKEIKFEFETIDTL

SEQ ID NO: 15753 - protein, 1978 aa, Arabidopsis thaliana
MSTEDEKLLKEAKKLPWEDRLGHKNWKVRNEANVDLASVFDSITDPKDPRLRDFGHLFRKTVADSNAPVQEKALDALIAFLRAADSDAGRYAKEVCDAIALKCLTGRKNTVDKAQAAFLLWVELEAVDVFLDTMEKAIKNKVAKAVVPAVDVMFQALSEFGSKVIPPKRILKMLPELFDHQDQNVRASAKGVTLELCRWIGKDPVKSILFEKMRDTMKKELEAELANVTAGAKPTRKIRSEQDKEPEAEASSDVVGDGPSEEAVADAPQEIDEYDLMDPVDILTPLEKSGFWDGVKATKWSERKEAVAELTKLASTKKIAPGDFSEICRTLKKLITDVNLAVAVEAIQAIGNLACGLRTHFSASSRFMLPVLLEKLKEKKQSVTDPLTQTLQTMYKAGCLNLVDVIEDVKTAVKNKVPLVRSSTLTWLTFCLETSNKALILKAHKEYVPLCMECLNDGTPDVRDAAFSALAAIAKSVGMRPLERSLEKLDDVRKKKLSEMIAGSGGGDQAGTSSVTVQSSVGSTATGNSDASFVRKSAASMLSGKRPAPSAQASKKVGTGKPGGGKKDGSVRNEGSKSVEPPEDVEPAEMGLEEIENRLGSLVKPETVSQLKSSVWKERLEATLALKEEIEGLQELDKSVEILVRLLCAVPGWNEKNVQVQQQVIEIITYISSTAAKFPKKCVVLCITGTSERVADIKTRASAMKCLTAFCEAVGPGFVFERLFKIMKEHKNPKVLSEGLLWMVSAVDDFGVSLLKLKDLIDFCKDVGLQSSTAATRNATIKLLGALHKFVGPDIKGFLNDVKPALLSALDTEYEKNPFEGTAAPKRVVKTSVSTSTSSGGLDSLPREDISTKITPNLLKGFESPDWKMRLESIEAVNKILEEANKRIQPTGTGELFGGLRGRLLDSNKNLVMQTLTTIGGVAAAMGPAVEKASKGILSDVLKCLGDNKKHMRECTLAALDLWLGAVHLDKMIPYIIIALTDGKMGAEGRKDLFDWLTKQLTGLSDFVDAIHLLKPASTAMTDKSADVRKAAEGCISEILRVSGQEMIEKNLKDIQGPALALVLEKVRPGFVQEPFESSKAMAGPVSKGVTKISKSTSNGTLKQGNRSRAVPTKGSSQITSVHDIAIQSQALLNTKDSNKEDRERVVVRRIKFEELRPEQIQDLENDMMKFFREDLQKRLLSPDFKKQVDGLEILQKALPSVSKEIIEVLDVLLRWFVLQFCKSNTTCLLKVLEFLPELFNTLRDEEYCMTEAEAAIFLPCLAEKLGHNIEKVREKMRELMKQIIQAYSVGKTYPYILEGLRSKNNRTRIECTDLIGYLLETCGTEIGGLLKYLNIVASLTAERDGELRKAALNTMATGYQILGADIWKYVGKLTDAQKSMIDDRFKWKAKDMEKRREGKPGEARAALRRSVRDSGPEVAEQSGDISQTVPGPLFPRQSYGISEQMLERTPVPRTIAGVNGPTDWNEALDIIMFGSPEQSVEGMKVVCHELAQASNDPEESAIDELVKDADGLVSCLANKVAKTFDVSLMGASSRSCKYVLNTLMQTFQNKKLAHAVKEGTLESLITELLLWLLDERVPRMEDGSQLLKALNVLMLKILDNADRTSSFVVLISLLRPLDPSRWPSPATAEVYAVRNQKFSDLVVKCLIKLTKLLQSTIYEVDLDRLLQSIHVYLQDLGMEEIRRRAGADDKPLRMVKTVLHELVKLRGAAIKGHLSLVPIDMRPQPIILAYIDLNLETLAAARMLTATGPVGQTHWTDSTANNPSPPANSADVQLKQELGAIFKKIGDKQTSTIGLYDLYHITKSYPKVDIFSQLQNASEAFRTYIRDGLAQVEKNAAAGRTPSSLPLSTPPPSSLALPSPDIPSLSSLDVKPLMNPRSDLYTDDIRASNMNPGVMTGTLDAIRERMKNMQLASSEPVSKPLMPTNDNLSMNQQSVPPSQMGQETVHTHPVVLPMDEKALSGLQARMERLKGGSLEHM

SEQ ID NO: 15754 - protein, 381 aa, Micromonospora echinospora
MSGMRFDTRLVHGGRRPSAGTGDVVPPIHVSTTYERRAQDEPRYFYGRGENPTREELEECLAGLERAPFATVFSSGQAAAATLLSLVRPGQCVVSTDDVYAGTDGLFDLAARQGVRVRYADLTTPEGIAAALAEPDLALVWIETPTNPLLTVVDVAEVSRRAHERGARVVVDNTFASPVLQQPLALGADVSLYSTTKSIAGHADVLGGALVYRDADLHAAVRAYRTTAGNVPGALDCFLVRRGLHTLSLRVHRQVATARVLVERLRASPVVGAVHYPGLPEHPQHAVVKAQMSAPGAIVSFDYLGGPAERLLDRFTLFTCGVSLGGVHSLVECPALMTHRPLSAEARARRGIGESLIRLSVGIEDPQDLAEDLSRALAGGT

SEQ ID NO: 15755 - protein, 475 aa, Fagopyrum cymosum
MSPQTETKASVGFKAGVKEYKLTYYTPDYEPHDHDILAAFRVTPQPGVPPEEAGAAVAAESSTGTWTTVWTDGLTSLDRYKGRCYHIEPVPGEENQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEALFKSQVETGEIKGHYLNATAGTCEEMIKRAVFARELGVPIVMHDYLTGGFTANTSLAHYCRDNGLLLHIHRAMHAVIDRQKNHGIHFRVLAKALRLSGGDHIHSGTVVGKLEGERDITLGFVDLLRDDFVEKDRSRGIYFTQPWVSLPGVIPVASGGIHVWHMPALTEIFGDDSVLQFGGGTLGHPWGNAPGAVANRVALEACVQARNEGRDLAREGNDIIRKAAKWSPELAAACEVWKEIKFEFQAMDTL

SEQ ID NO: 15756 - protein, 362 aa, Nicotiana tabacum
MATAVSAAVSLPSSKSTSFSSRTSIISTDKINFNKVPLYYRNVSGGSRLVSIRAQVTTEAPAKVEKISKKQDEGVIVNKFRPKEPYVGRCLLNTKITGDDAPGETWHMVFSTEGEVPYREGQSIGVIADGVDANGKPHKLRLYSTASSALGDFGDSKTVSLCVKRLVYTNDKGEEVKGVCSNFLCDLKPGAEVKITGPVGKEMLMPKDPNATVIMLATGTGIAPFRSFLWKMFFEKHEDYKFNGTAWLFLGVPTSSSLLYKEEFEKMKEKAPENFRLDFAVSREQTNEKGEKMYIQTRMAQYAEELWTLLQKDNTFIYMCGLKGMEQGIDEIMSALAERDGIVWADYKKQLKKAEQWNVEVY

SEQ ID NO: 15757 - protein, 156 aa, Nicotiana glutinosa
MAEVEYRCFVGGLAWATTDQTLGDAFSQYGEILDSKIINDRETGRSRGFGFVTFKDEQAMRDAIEGMNGQDLDGRNITVNEAQSRGSGGGGGGYRGGRGGGGGGYGGGGRREGGYGGGGGGYGGGRREGGYGGGGGYGGGRREGGYGGGSEGNWRN

SEQ ID NO: 15758 - protein, 294 aa, Daucus carota
MDQYEKVEKIGEGTYGVVYKARDRVTNETIALKKIRLEQEDEGVPSTAIREISLLKEMQHENIVRLQDVVHSEKRLYLVFEYLDLDLKKHMDSCPEFAKDPRLIKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQQPLFPGDSEIDELFKIFRIVGTPNEDTWPGVTALPDFKSAFPKWPSKELGNVVPNLDVAGLNLLKKMLCLDPSRRITARSALEHEYFKDIGIVP

SEQ ID NO: 15759 - protein, 355 aa, Vitis labrusca x Vitis vinifera
MVTSVAPRVESLSSSGIQSIPKEYIRPQEELTSIGNVFEEEKKDEGPQVPTIDLKDIESEDEVVRERCREELKKAAMEWGVMHLVNHGISDDLINRVKVAGETFFNLPMEEKEKYANDQASGKIAGYGSKLANNASGQLEWEDYFFHLIFPEDKRDMTIWPKTPSDYVPATCEYSVKLRSLATKILSVLSLGLGLEEGRLEKEVGGMEELLLQKKINYYPKCPQPELALGVEAHTDVSALTFILHNMVPGLQLFYEGKWVTAKCVPNSIIMHIGDTIEILSNGKYKSILHRGLVNKEKVRISWAVFCEPPKEKIILKPLPETVSETEPPLFPPRTFSQHIQHKLFRKTQEALLSK

SEQ ID NO: 15760 - protein, 494 aa, Pseudomonas putida
MSASSKFNVDPAGFRNRNLIGGQWKGSISGETITVENPATEEIIAHIPQGRHEDIDEAVRVARATFESPAWRKIRPIDRGRILENVARKIEEHADELAYLESLDTGKALTFAKAIDLPSTIDVFRYMGGWCSKLGGTTPPISFDGREYHTYTRREPIGVVGAITPWNYPLALGSWKIASALAAGCTMVLKPTELTPLSTLRLAELCLEAGLPEGALNIVNGHGHEAGEALARHPGVDKITFTGSTVVGKKIVEYALGNMKRVTLELGGKSPSIVFADADLDQVGLGAALAVFFNSGQICFAASRLFVQDSVYDQVVEAVAAAAAQFKVGNGLDPDTLLGPLVSRKQQERVMGYVQSGIEQGARLVCGGKSVGEKGYFLQPTVFADAAPSMRIAQEEIFGPVVSVIRFKDEAEAIRMANDTAYGLAANIWTRDIKKAHRVAHRLQAGSVWINCHGVIDPAAPFGGFKQSGWGREVSEEGLSAYTETKTVCALLDD

SEQ ID NO: 15761 - protein, 369 aa, Anabaena azollae
MQVKAAVAYSVVQPLTIETVELEGPQAGEVLVEIKASGVCHTDAYTVSGADPEGLFPAILGHEGAGVVVEVGADVKSVKPGDHVIPLYTPECRQCEYCLSFKTNLCQAIRVTQGRGLMPNATSRFSIVGKMIHHYMGTSTFANYTVLPEKAVAKIREDAPFDKVCYIGCGVTTGIGAVIYTAKVEAGANVVISGLGGIGLNIIQAAKMVGANMIVGVDINPKKRALAEKLGMTHFVNPHEIEGDLVSYLIDLTKGGADYPFECIGNINVMRQALECCHKGWGVSVIIGVAGAGQEISTRPFQLVTGRVWKGSAFGGARGRTDVPKIVDLYMNGQINIDDLITHVMPIEQINHAFDLMYRGESIRSVVTF

SEQ ID NO: 15762 - protein, 511 aa, Glycine max
MANIDIEGILKQQQPYDGRVPKTKIVCTLGPASRSVEMTEKLLRAGMNVARFNFSHGTHDYHQETLNNLKTAMHNTGILCAVMLDTKGPEIRTGFLKDGKPIQLKEGQEVTITTDYDIKGDPEMISMSYKKLPVHLKPGNTILCSDGTITLTVLSCDPDAGTVRCRCENTATLGERKNVNLPGVVVDLPTLTEKDKEDILGWGVPNKIDMIALSFVRKGSDLVNVRKVLGPHAKNIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATQRGLCKPGDAVVALHRIGTASVIKICIVK

SEQ ID NO: 15763 - protein, 510 aa, Glycine max
MANIDIEGILKQQPDDGRVPKTKIVCTLGPASRSVEMTEKLLRAGMNVARFNFSHGTHDYHQETLNNLKTAMHNTGILCAVMLDTKGPEIRTGFLKDGKPIQLKEGQEITITTDYDIKGDQEMISMSYKKLPVHLKPGNTILCSDGTITLTVLSCDPDAGTVRCRCENTATLGERKNVNLPGVVVDLPTLTEKDKEDILQWGVPNKIDMIALSFVRKGSDLVNVRKVLEPHAKTIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATQRGLCKPGDAVVALHRIGTASVIKICIVK

SEQ ID NO: 15764 - protein, 476 aa, Thermosynechococcus elongatus BP-1
MDCIPVILSGGVGSRLWPLSRQAHPKQFIRLTPEGKSLLQQTWQRVQGLPQLQPPLVVANEAHRFLVAEQFQELGVTPTRILLEPVGRNTAPAITVAALYVTEVLASDALLLVLPADHFIQDVAHFQWGLQRGFSAAAKDWLVTFGIAPTSPHTGYGYIRRGESLSDPDTYRVAEFVEKPDLATAEAYLAAGNYLWNSGMFLFRAQSFLAELAQQQPQILDYCRLALRQGREDLDFIRLGKEAFDQCPNLSVDYGLMEKTQKAAVVPLDCGWSDVGSWSSLWEILPKDEWGNSCRGDVLVYNSKDCFAQSQHRLVALVGVDNLMVVETADAILIAHREAAQQVKQVVEQLQARNRSEAYNHRLVYRPWGYYDAIDAGHRFQVKRITVKPGASLSLQQHHHRAEHWIVVSGTAEVTCNGKTFLLTENESTYIPVGAVHRLANPGKIPLEMIEVQSGSYLGEDDIVRFEDCYGRKTEE

SEQ ID NO: 15765 - protein, 195 aa, Thermosynechococcus elongatus BP-1 [sequence omitted]

SEQ ID NO: 15766 - protein, 507 aa, Thermosynechococcus elongatus BP-1
MKLRSILRRGFRLQHPLTQILYLPTRRTLLTFAVMIGVLSATAALGQDTAASAAVPEKVQVALNTLWVILAGVLVFFMNAGFGMLETGFCRAKNAVNLLSKNLIVFALASISYWAIGFALMFGDGNGVLGSSGFFLLGADNSPATGEAYRGVYSSLSWAAVPLSAKFFFQLVFAGTAATIVSGAVAERIKFYAFFIFSLLLVGISYPITGHWIWGGGWLQQLGMWDFAGSTVVHSVGGWAALMGAALLGPRLGRFLPDGSVAAIPGHNFAIATLGCLILWLGWFGFNPGSTMAADPGAIAHIAVTTNMAAAFGGVTATVVSTLYFGKPDLSMIINGILAGLVAITASCAFVTIESAALIGAIAGTIIVFSVVTIDRLKIDDPVGAISVHLVNGVWGTLAVGLFADGPGRFYEAGAGPLKGLLWSGDFTQFGYQLVGVLAVGGFTVAFSTAVWLLLNATIGIRVSPEEEIEGLDIGEHGMEAYAGFLLREEVKGFVDLLKRMSGSGRS

SEQ ID NO: 15767 - protein, 462 aa, Thermosynechococcus elongatus BP-1
MVIASVNPTTAEVLKTFSPLGAEEVDRAIAQAATTFETYRLTSFEQRAQWLENTANLLQQQRETLARLMTLEMGKPIAEARAEIDKCAWVCRYYAEQGAAFLEPEFIPTEASYSAIHYQPLGIILAVMPWNFPFWQVFRFAAPALMAGNVALLKHASNVPQCALAIAQIFRQAGFPEGVFQTLLIPGSAVADLVADPRIKAATLTGSEAAGTSLAQAAGQHLKKTVLELGGSDPFIVMPSANISQAIATAVQARMINNGQSCIAAKRFIVHEAVYDTFAEGIKAAFESWVIGDPLEPTTQLGPLATAAIRDELHAQVELALGHGAKAFYRRSLDLPTQCRQGYFFGPTILTEVTPNNPVFTQELFGPVAMLFRVSSLTAAIELANATPFGLGASAWTQDSDEAEILVRDLEAGAVFINAMVKSDPRLPFGGIKTSGYGRELGRAGLLEFVNIKTVCRANTHS

SEQ ID NO: 15768 - protein, 214 aa, Thermosynechococcus elongatus BP-1
MPATALSLPLDEIRYDERGLVPAIVQDYLDGTVLMLAWMNRESLQKTLETGRTWFWSRSRQELWPKGETSGHVQWVKSIRYDCDSDALLLTVEQVGHIACHTGERSCFHRHGAKGESIEPPPADTLSQVYNIVCQRRDFPQLQSYTSSLFTAGDNKILKKLGEETAEVVMACKDDDPEAIASEVADLFYHTLVALAYHRVSLRQVYEQLQLRRR

SEQ ID NO: 15769 - protein, 268 aa, Thermosynechococcus elongatus BP-1
MGHMAEPLVELRGVCKAFGNKPVLSDVDLVIYPQDALVILGPSGTGKSTILRIIAGLLAPDRGEVYVAGERRQGLRQDGLCRLRMGMVFQQSALFDSLTVAENVGFYLYQHTRLPEARIREIVSEKLAMVGLSGMEDLYPAQLSGGMRKRVSFARAIVDNPEDPDDDPYLLLYDEPTAGLDPIASTVIEDLIRELQEKTGHAYVVVTHQKSTIDRTGDRLILLYQGRICWEGTQREIQTTDNPYLRQFLSGDVNGPMRIIDQVGTAAL

SEQ ID NO: 15770 - protein, 466 aa, Thermosynechococcus elongatus BP-1
MSLWRPTAILLASDLPLIPPTRLRAMTLPTFVDLNLDPFWMPFTANRQFKQSPRLLVSAAGMYYRSIDGREILDGTAGLWCVNAGHCRPEIISAIAQQAATLDFAPTFQMGHPGPFQVADRLRRITPDPLNHVFFANSGSEAVDTALKIALAYHRLRGEGTRQRLIGRERGYHGVGFGGISVGGIAPNRKFFGSLLAGVDHLPHTHNLEHNAFSKGQPTWGAHLADELERLVALHDASTIAAVIVEPLAGSTGVLIPPQGYLERLRAICDRYGILLIFDEVITGFGRLGAPFASQYFGVTPDLITVAKGLTNAAVPMGAVIVRDEIYETFMQGPAGQIEFFHGYTYSGHPLACAAALATLEIYEKEALFERAASLAPYWQEAIHSLRGLPHVIDIRNLGLVAGIELAPREGQGGPRGYDALCRAFEAGLLIRVTGDIIALSPPLIVERSHIDQMVDILSRVLQELP

SEQ ID NO: 15771 - protein, 151 aa, Thermosynechococcus elongatus BP-1
MLDFGELLPLQPPTIPAHQLPPAALAYFGDAVYELFIRLLFLTPPQRINAYHRQVVAHVRAESQARYMDFLWEYCTETERSIFRQGRNAAADGPKRVAAKIYRQATGFEALLGYLYLTNPQRLQEIFQLLAGHIRSEVENKTHAAESPSEM

SEQ ID NO: 15772 - protein, 266 aa, Thermosynechococcus elongatus BP-1
MIVPKISERFEHCRARQRCALIPFLTAGDPDLETTVAALKILDDHGADLIELGMPYSDPLADGPVIQAAATRALQRGTRLEAVLEMTTDLHQQLTAPLILFSYYNPIYHRGVSSFLKAVAQAGIKGLVIPDLPLEEAEPVLAETANLGLELTLLIAPTTSPERMRAIATASQGFIYLVSTTGVTGMRQEMASRVQELLHTLRQITPKPIGVGFGIASPEHARQVRDWGADAAIVGSAFVKRLAEPDQGLAAVAEFCQSLRTALDTP

SEQ ID NO: 15773 - protein, 411 aa, Thermosynechococcus elongatus BP-1
MPGGVSSPVRAFKSVGGQPIVFDHVKGAHIWDVDGNQYIDYVGSWGPAIVGHAHPEVIDALHAALEKGTSFGAPCLLENILAEMVIAAVPSVEMVRFVNSGTEACMAVLRLMRAYTQREKVIKFEGCYHGHADMFLVKAGSGVATLGLPDSPGVPKATTAATLTAPYNDLEAVSRLFEQYPNDIAGVILEPVVGNAGFIPPDAGFLEGLRELTKQYGALLVFDEVMTGFRIAYGGAQEKFGVTPDLTTLGKVIGGGLPVGAYGGRAEIMKMVAPAGPVYQAGTLSGNPLAMTAGIKTLEILSRPGSYEHLDRITGKLVQGLLDAAREFGHEVCGGHISGMFGLFFTAGPVTNYEQAKQSDLKKFAAFHRGMLEQGIYLAPSQFEAGFTSLAHTEADIERTIAAARTVLSQL

SEQ ID NO: 15774 - protein, 321 aa, Thermosynechococcus elongatus BP-1
MNIAPDITALIGRTPLVRLNRIPQAEGCVAEIVVKLESMNPAASVKDRIGLSMIQEAEAAGLITPGKTVLVEPTSGNTGIALAMVAAAKGYRLILTMPETMSAERRAMLRAYGAELDLTPGTEGMSGAIRRAEEIAASLEDAFMLQQFKNPANPKIHRETTALEIWQDTDGQVDILVAGVGTGGTITGVAEVIKAKKPTFQAIAVEPSNSPVLSGGKPGPHKIQGIGAGFVPPVLKRELIDEVIPVSDDQAIHFGRRLAREEGLLSGISSGAALCAAIQVAQRPENAGKLIVMVQPSFGERYLSTPLFQEALPLVPSYLQT

SEQ ID NO: 15775 - protein, 506 aa, Thermosynechococcus elongatus BP-1
MLLEAPTVPISPAALLHSLLELRQEITKEGEARFQEWQLKIKRSEFIPSARNLAYYLALRWRDLRAMQMALMPWGLSSLGRIESRVLPNLDAVINTLGALCHTHGSLPPRPPLDAFFAGDRQLRRQTEELFGPIRGKRHVRIMVTLPTEAATDRQWSITLLRKGMNCARVNCAHDDPATWEAMIEHLRAASHITGQPCKILMDLGGPKPRIADIFPETVRVHSGDRLRLTTEICPEGGEIPQFTCSLPEIVPQLEVGQRVWIDDGRTGGRIVSKDAQGVELTITHCKEGQRLKVAKGLNFPDSDLRLCPLTASDREHLAFACRYADIIGYSYVQSAEDIALLQRELAHCCGDCADQMGIIAKIETPKAIRALPEMIIQAAGRQPFGVMIARGDLAVEIGYQRLAEMQEEILWLCEAAHVPVVWATQVLENLVKKGVPSRAEITDAAMAERAECVMLNKGPYVGLAVDILDDVLARMEAHQQKKTPQLRALHSWHPDKTIGRPSICD

SEQ ID NO: 15776 - protein, 250 aa, Thermosynechococcus elongatus BP-1
MYLEQLRRIAAEGGGWLDPDTYLNDQSDRVARLAVQAWLDGVDLALQRQQAIFVLARPPGHHALRERGMGFCLLANGAIAGHYALSLPGIKRVAILDWDVHHGNGTQALVQDNPQIAYCSLHEFPAYPYTGDGGDRGPYNNVLNLPMPTGANGEAYRAAFQDQVIPFLRQFNPDLLIISAGYDAHRNDPLSSIELEEGDYAWMMQQCLRITQRIVVGLEGGYDLEALGRSLVATVQATVVDDAPLELPQN

SEQ ID NO: 15777 - protein, 322 aa, Thermosynechococcus elongatus BP-1
MSDQPRPTVIITGASSGVGLYATKALANRGWHVIMACRNLEKAEQAAKNLQIPPEAYTILHLDLSSLASVRGFVESFRALNRPLRALVCNAAVYYPLLKEPIYSVDGYEITVATNHLGHFLLINLLLEDLKNSPESDKRLVILGTVTANRKELGGKIPIPAPPDLGNLEGFEKGFKKPIAMINGKPFKSGKAYKDSKLCNMLTARELHRRFHESTGIVFNSLYPGCVADTPLFRHHFPLFQKLFPLFQKKITGGYVSQELAGERVAMVVADPEFRQSGVHWSWGNRQKEGRKAFVQELSAEASDEQKARRLWELSEKLVGLA

SEQ ID NO: 15778 - protein, 480 aa, Thermosynechococcus elongatus BP-1
MSQQDFGVIGLAVMGENLALNVERNGFSVAVYNRTPARTEAFMAERAAGRRFKATYTLEELVASLSRPRRILAMVKAGQPVDDLIQQLKPLLEPGDILIDGGNSLYTDTERRVAEMESAGLCFFGMGVSGGEEGALNGPSLMPGGSREAYQALEPILTKIAAQVDDGPCVTYIGPGGSGHFVKMVHNGIEYGDMQLIAEAYDLLKNLLGLNHQQLHEVFKSWNETPELNSFLIEITSQIFTYIDPETHLPLVDVIVDAAGQKGTGRWTVESALEMGVAIPTITAAVNARIMSSIKAERMAAAQVLPGPAAHFSGNTEEFIGKIRDALYCSKICSYAQGMALIAKGSQELFDHQLNLSEIARIWKGGCIIRAGFLNKIKQAYSENPQLANLLLAPEFRQTILDKQAAWREVLVEATRAGIAVPAFGASLEYFDSYRRDRLPQNLTQAQRDFFGAHTYERIDKPGTFHTEWVPIQEAGKASV

SEQ ID NO: 15779 - protein, 294 aa, Thermosynechococcus elongatus BP-1
MLGQLHPDLIQEWLEAAATEIPRGEPLQRLPKVGSEAFAFAVVTPEQEFTLGRSRLRFPLMSAIKPFLLLYALTLWQEQVWTWVGQRPSDYPYNSVLQLTLDQGWPRNPMINSGAIALAGQLAYVGGATAFQTWLNECAGTQFEVDQEVLGAVHRHPNWQNRTLAHFLVESGRIADAEVALEIYNQVCCFQGTVEEVARLGLLLALPQAKVSDRHRQQVNVLMLTCGLYEDSPRYGLEIGLPMKSGVSGVMLAIVPRQGAIACYSPPLDKSGNSILGLYLLQRISRHLGLSPLG

SEQ ID NO: 15780 - protein, 426 aa, Thermosynechococcus elongatus BP-1 [sequence omitted]

SEQ ID NO: 15781 - protein, 334 aa, Thermosynechococcus elongatus BP-1
MKVAVFSAKSYDRQFLDAANAAQGHPHLLTYYDVLLRPKTAALVEGHDAICAFVNDDLGAQTLERLAELGVRLVTLRCTGFNNVDLATAARLGITVTRVSVYSPYSVAEHTVGLMLMLNRKLHRAYNRVRDDNFSLEGLMGFDLHGCTVGIIGTGKIGQIVAQILHGFGCHLYGYDPYPSQAFREIGTYTTLETLLAASEIITLHCPLLPENEHLINATTIAQMKRGVMLINTSRGKLVDTKAVIEGIKSGQIGYLGIDVYEEEDSLFFQDLSDTVIQDDTFQLLQSFPNVVITAHQAFFTRNALTDIARTTIENLTCFEQGLPLANEVKQASP

SEQ ID NO: 15782 - protein, 152 aa, Thermosynechococcus elongatus BP-1
MTMGANRFVGYLRRGVVCLLLSVLCWSSLATLPAIAGIQVRLFDLNYHKCPPEIGEGSVTPGGTTLKANCYLITGKAENKSGKTVVDADVFGRIYDANGNPVLQNRTRVGAIDVIPPGISEFEIRISVPYNQPEPLHLEQFKASGFTAKVRG

SEQ ID NO: 15783 - protein, 446 aa, Thermosynechococcus elongatus BP-1
MEAAEMGGTCVNRGCIPSKALLAAAGRVRELRQASHWQALGIQLGQVNVDRAGVAAHAANLVQKIRSDLTNSLKRLGVDILIGRGKIAGSQKVSITTPTGEKIITAKDIIIATGSVPWVPPGIEVDGKTVYTSDDAIKLDWLPQWVAIIGSGYIGLEFADIYTALGSEVTMIEALDQLMPTFDPDIAKQAQRILIAGRDIETYSGTLAKRVIPGSPVVIELADGKTQEVVDVLEVDACLVATGRIPATQDIGLESVGVSTDKRGFIPVNEYLAVTKKGKPVPHLWAIGDATGKMMLAHAASAQGIAVVETIVGRPRQVDYRSIPAAAFTHPEMSFVGLTEPQARELGEKEGFEVQVARTYFKGNSKALAETETDGLAKVIFRADTGELLGAHIFGLHAADLIQEAANAIRDRQTVSHLAFNVHTHPTLSEVLDEAFKRAHEMVTHR

SEQ ID NO: 15784 - protein, 224 aa, Thermosynechococcus elongatus BP-1
MISIPVAQQQKLPRLVLPRVYGFPPNRETLGGTAYLIVENDGNTLIDSPPWTDGSQHWLREQGGVKRLILTHRGAIARVRAIQDTFDCEVMIHAQEAYLLPQVTVTPFNHHLAIGETLEILWTPGHSPGSACVYWSCQGGVLFTGRHLLPTPTGELAPIKTATTFHWPRQLRSVEALKAFCRQKSLSYLCPGANMGFLRGTLAIANAQAVLQGLSVDNLLCDKF

SEQ ID NO: 15785 - protein, 215 aa, Thermosynechococcus elongatus BP-1
MPATQTLDAQALFRAAYENRYTWDENFPGFTAKVTLIEGDRTYQGQVKVSRDYSVEVSGIEDEHVRESLYNQLRDVIVHRKRNSFEAAHGKNTFQIGQTDASGAVEILVSGDAMGSNYKVRDNQIVYVSRVMGRVAFAITHREALDTGSGYISTNYVAVFRNPQTNEVVRQMEFEDTYVPVGNYYLMSRQVVHTHENGQTSTVEIRFDDLQLLDD

SEQ ID NO: 15786 - protein, 299 aa, Thermosynechococcus elongatus BP-1
MLMLIGSQEGTAHLPLAVMNPQEYALVLDPGYPSHVGGVYLAGGQVYPLPLRSEDHFLPDLAAIPLAVREQAKLLILSYPHNPTTAVAPLDFFKTAVEFCDRHGILLVHDFPYLDLVFDGERAPSIFEVDRDRQVGIEFYSLSKSYNMGGFRIGFAIGRADIIAALRQIKSVIDFNQYAGILRGAIAALTGDQTCVQQTREIFRQRRDVFVQALGDHGWPVPLPPATMYVWAQLPAPWQRDSLGFCQALVQATGIAAAPGSGFGQGGEGYVRFALVRDRPCLEVAAAQIAAFSQTVPKV

SEQ ID NO: 15787 - protein, 265 aa, Thermosynechococcus elongatus BP-1
MIRDNPCGTLDQVKFRRGKSRGVRPKVLAGNWKMHKTQQEAVAFLQEFLGELVDTPSDREVVLCVPYTCLSVLSKSLHGTRVKLGAQNVHWADQGAFTGEISPPMLVELGVRYVIIGHSERRQYFGETDATVNQRLRAAQSHGLTPILCVGETKAQRAAGETENHIFQQLALDLVDVDQTNLVIAYEPIWAIGTGDTCEETEANRVIGLIRSQLHNPDVPIQYGGSVNANNIDAIMAQPEIDGVLVGGASLQPQSFGRIVNYKPL

SEQ ID NO: 15788 - protein, 320 aa, Thermosynechococcus elongatus BP-1
MQTRSLGRTEIQITPLILGTWQAGKRWWVGIEDEESIRTIRAAVEAGMTTIDTAEVYGEGHSERIVAAAVGDLRDRCVYATKVFANHLRYKDVIAACERSLRNLNTDYIDLYQIHWPAGSFGSEIVPIEETMQAMVELQAAGKIRAIGVSNFSRAQLAEAMQYGRIESVQPPYSLFWRWAEAELIPFCIEHEITVLAYSPLAQGLLTGRFGPGHQFEPEDNRSKNQLFQGETYARALEAIELMKPIATSLGTTVGNLALAWLLHQPQTCAIVGARHPEQVRENIKAADLPLDRSILAMLDEISQPVIATLDPENPVMWKW

SEQ ID NO: 15789 - protein, 463 aa, Thermosynechococcus elongatus BP-1
MPKPKVLYICRECGAQHLQYFGCCPSCGQWNTLDEQVLTPVETAPRWTVPRKSTTLQPLSAKALGEISEQTQSRSASGFTELDRVLGGGIVAGSLVLVAGEPGIGKSTLLLQMAATLGQQQRVLYVCAEESAQQVKLRSQRLGLSAPPSLYLLAETDLEVILQELTHLQPHLAIIDSIQAVYLPQLTAAPGSVSQVREGAAALMRLAKREQISLFIVGHVTKEGAIAGPKVLEHLVDTVLYFEGDRFARHRLVRAVKNRFGASQEVGVFEMGAQGLAEVTNPSALFLGDREPTPGTATIVACEGTRPLVVELQSLVSPTSYPSPRRTATGIEYNRFLQILAVLEKRLGVPLSKLDAYVASSGGLNVAEPAADLGVAVAVVASFRDRWVQPQTVIIGEVGLGGQVRAVSQLELRLREALKLGFRRAIIPESQACGIAGLEIYSVRRVSDAIVAALAPIAPGESP

SEQ ID NO: 15790 - protein, 322 aa, Thermosynechococcus elongatus BP-1
MTDDPTVTDASDPTSEDLVTLKAQRDALKAEIQALDAQFHRLVHDRLKSLEERQQSLQLTIEQLERRKERIEQELRRNFVGASQELAIRVQGFKEFLVKSMQELAATVEEMELLPPAPAVAETAPSPAETAATPPKLILDEGFQEEADRIRRLLEQYRSSPNYYGPPWQLRRTFEQVHAERVESWFFDLGGRGALRSLPSRLQNILVASAIISILRDFYGEMLRVLVLADSPERLGDWRRGLQDCLGITRQDFGPDQGVALFESADALAFRADRLEQEDYIPLILIDDSQPQVSLSLLQYPLLLGFAPEPQLRPSRSSDFFE

SEQ ID NO: 15791 - protein, 272 aa, Thermosynechococcus elongatus BP-1
MIVMLGMGITLSWREFQAVGLMPRTVALGFIAQYVIMPTAGWLVAQLYQLSAPFAVGLILVACCPGGTASNVVTFIARAHVALSVVMTLCSTLAAIILTPLLTQLLAGQYVEVNALQLFWGTVQVVLLPILVGLALNTKAPNLVKKVLPISPLISVLGICVICGGVFAASAKAILSHGLQLLAAVVSLHSLGFLGGYYLARAVGYSERTCRTIAIEVGMQNSGLGVALARQAFANPLTAVPCAISGVVHSLIGSLLAGFWRWQQGAAAVPKI

SEQ ID NO: 15792 - protein, 137 aa, Thermosynechococcus elongatus BP-1
MGKIKPLTGKALLQRLKELDGVSRKEAAKLCGYYRVTKSGEVRVNLGKFYEALLAAGGLEVHSSEKEVNSQSGRGRSPSYRVKVHQNGQIVIGAAYTTAMNLKPGDTFKIQQGYKHIHLYLIDSEIDSEDVNGAPRN

SEQ ID NO: 15793 - protein, 437 aa, Thermosynechococcus elongatus BP-1
MSGLTLAATDYSLLTDLYELTMVSTYAGEDLAWTPASFELSVRRLPRGYTYLVAMGLAQVLEYLQQLRLTPQQIDYLRGLAVFERAPAAFWELLSQGEFRGDVWAVPEGTVVFAQEPLLRIDAPLWQGQWIETCLLNIVNYQTLVATRASRLRQLVGEEVDLLEFGTRRAFSPQASLWAARSALAAGFTATSNVLAAQQLGVVPVGTMAHSLVMAIATLKGTEQDAFTVFLRSYPEGALLVDTYDSLAAIATLADRQAAGEILVKAVRIDSGDLLSLSQKIRQLLPQAKIIASGDLDEGEIRRLQAAGAAIDAYGIGTKLVTGEPVNGVYKLVEINGQGVMKIASGKMTLPGRKQIYRRPSGDCLALASEEQVWGKPLLELVMKEGCPLYPPESLTTIRDRHRASLAELPETLLDVTQPVVYSPALDALIQQLRQHP

SEQ ID NO: 15794 - protein, 412 aa, Thermosynechococcus elongatus BP-1
MLAAPLPSFSTDAFDQVVMSTYGRFPITLVRGEGCRVWDDQGRSYLDFVAGIATCTLGHAHPALVETVSRQMQTLHHVSNLYYIPQQGALAQWLVAHSCGDRVFFCNSGAEANEAAIKLARKYAHTVRHIANPIIITAQASFHGRTLATITATGQPKYQKYFDPLVPGFAYVPYNDLGALEALVASLDQPQPQVAAILLEPLQGEGGVRPGDRAYFEQVRQLCTEKGILLIFDEVQVGMGRTGSLWGYETLGVEPDIFTSAKGLAGGVPIGAMIAKEFCAVFQPGDHASTFGGNPLATAAALTVCETLEKENLLENVRDRGQQLRTGLQELAAAYPQVIAEVRGWGLINGLELQPDTPLTAAEVVKAALAEGLLLVPAGPKVVRFVPPLIVSATEIDMALGAMSRALAHLAA

SEQ ID NO: 15795 - protein, 1009 aa, Thermosynechococcus elongatus BP-1
MTILVTKWKWGFSTRDMAVPILSLLGADGSRQQIQLGRDRLIIGTDPQSQVILVGEGISRHHALILATETGYQVVDLGSASGTFLNGTKLQPRTPVVLKAGDRLKIGDFEAIFDPDGRATTALPGTVVMGAASTPILQVATPHWLQEFPLLKEELILGRDPKADIILDHPFVSFHHAKLVRSGDHYKIIDLGSKNGLHWRGTTISEHILAPGDVIHVGESLRLTYLLMPATQVVEQTRPLQLRDRQQVRIGRDPSNDMVLDHPVVSRFHARLYLQEGQWYLVDLESANGTFVNNRRLEPRKPVVLPTGALVRIGPYSSVFTPDETIVPHNDSGNLRLDAIHLSKTTAKGAKLLQDISLSILPREFVAIVGGSGAGKSTLLDALSGFRPATRGTVLVNGYDLYRSFGTYRTQIGYVPQDDIIHRELTVAQALDYAARLRLPADFTDQERQEQVNQVLAELELTAQRHVLVKELSGGQRKRVSIGVELLTRPSLFFLDEATSGLDPGTETQMMRLLRQLADQGRTILLITHATKNVMLCDLVVFLARGGHLAYFGPPDQALSYFDVQDFDEIYLKIESEPNPALWQQRYCQSHLYQTYVVERQRPLNVDTEATRQVQPQRQKATIPRVAPWRQWWILIQRNLAILRQDRAALILMLSLAPILAALDFVLWKPTILDPDQGDAGQAFTMAFVTVLIAVMVGSLATMREIVKELEIYRRERMVGLGLWPYIFSKLGPAVVLALYQAAIFLGMKFLAIHLSLGIGAIAGLYLTLFLVTFGGMVMGLLVSALSPTQTVAPLLTILFLVPQITFAGAIIPLKDLGPVGNWISDVTLTRWSYANVVSLLGFGQDVAQDPCWQQPKSLREKLSPEALAQCPCFGENLFRRCRFPGVRKEYHPAVDEPEPPQPAEPGDPPALPKSVLEFNQAYRDRVEAYNQQVKDYQRAMDRWQDQFALWKEQRGRAIASGEALIDRFWSLQGQTFNANVTANQLRLGGIIALMLGLVGVFQKRKDVL

SEQ ID NO: 15796 - protein, 1029 aa, Thermosynechococcus elongatus BP-1
MTQAAWLELVKSVSEQGVRLPVSGLKVGRAPDNDIVLNDISVSRHHAFFEWREGQVHLVDLGSKAGTHLNGQAVVPNTPIPLEDGDLITLGNSAVRFRLIWQYHNYQPGATEVSKDAAVPVIEVCTKTWRQRWGLQEQTALLGTHPACDVVVDTPELLPCHLKLRFAEQHLQVVDLSDPQPAMNVHLGIGESYALTEFVRLTYVGQQLPDRIDKERHALVFSPATELGLTGTATVLAVPEADAPPSVPVKTISLVGYNTFTIGRDPNNDLVIGHPTVSRHHAKIERRNGDFLLTDLGSSNGTFVNGREVEEPTLLRVGDSIRIGSDRLVLNVDETLTQYAESGHMRLDAINLRKLVGKGTQILHDISLSIMPKEFVAILGPSGSGKSTLLDALNGLRPATTGTVLVNGTNFYRNYQAFQAQLGYVPQKNIIHEELTIAQALEYAAKLRMPPDTTAAERQQRVTEVLTELGLNHRRDVPIARLSGGQQRRVCIGAELLTQPSLFFLDEATSGLDPGTEADLMFLLRQLADQGRTILIITHATQNIRECDLVIYLAEGGRLAYFGPPNQLLPYFRATFGDRLSGIKLEDFSGIYRALDKEKNPHAPTSEELEQAYRRSRLYQEYVVGRQQMLVHLPDESQQGTKGKSRRSSEPKSKISPWQQFLILTQRNLTLLSQDRIHLLLTLLIAPLLGSLSFVSWRRDVFNPETGNGGQALTMIFVTSLIAVMIGAMTTMRELVKEVEVYQRERMIGLRLLPYLGSKGAIALGLALYQAATYLAVTKLAVDLPGDWGVTFAMYITLALAIFGGMAMGLLVSALAPSQNIVPLLVLMFLVPQIIFSGGIQPVSSFGLPGQMMSHLTVIKWPFEAMVKLTGMGDDIANDPCWREPEEERQNMTEQMQRDFCLCYGPGLFQTCNFPGIRSKYVPAVDEPAPPQPEPPGDPPTDPAALQDYLRRLQAYQAAMDQWEVKYSEWNRQRSRAINEAQGTISRFQRDQGYMFTVDVQRHWRNQSLLILAMLVALPFCQKRRDFGR

SEQ ID NO: 15797 - protein, 329 aa, Thermosynechococcus elongatus BP-1
MSQPTVLCAGEVLFDCLEIPPDPPQCFLGGAPANVACGLVKLGVSAAFLGAVGEDPLGERACAELAALGVNIEAVERVAGLPTRQVRVQLVEGDRQFVGFAPAGTSVFADMQFCGQQVSPLLLTGARFFVTGTLGLASEPTATTIAHLVHQLRQKGTLILIDANWRPIFWSDPRVAPERICPFLAQAHFLKLAKEEAELFFSDSDPQVVYRALWGRAPDHGVVITDGDQAIRYFWHENQGELQPPSMSVVDTTGAGDGFVAGWIAQLLQGTPETYRDPAWQVACLEFATVVGALVTTKRGAIAGQPTLAEVRQWLRDHPQRKIQTHSTG

SEQ ID NO: 15798 - protein, 373 aa, Thermosynechococcus elongatus BP-1
MFLAKGLHCRQFTFWVPMTTLSLMPTLKTAVQVAHLHKSFGRFLAIRDLSLWVQEGEILGLLGPSGCGKTTLLRLIAGLDTPDAGEIRVGDRCVAGANVFIPPEQRSLGMVFQDFALFPHLTVAENIAFGLQQQRLSKPQIQERVAAVLALVRLEGMQKRYPHELSGGQQQRVALARAIAPQPAVILLDEPLSNLDAQVRLQLRQELRQILKGTGTTAIFVTHDQEEALSLSDRLAVMRQGKIEQVGTPEEIYRCPASRFVAGFITQANFLPACAEGAQVRTDVGTFPLLEALAKGEGELMIREEDLQLQPDPEASSCFVIRDRQFLGREYRYCIQLPSGQELHARQPLAVDIPIGTAVKVAAEAVRFFPKEN

SEQ ID NO: 15799 - protein, 475 aa, Thermosynechococcus elongatus BP-1
MAYTQSKSQKVGYQAGVKDYRLTYYTPDYTPKDTDILAAFRVTPQPGVPFEEAAAAVAAESSTGTWTTVWTDLLTDLDRYKGCCYDIEPLPGEDNQFIAYIAYPLDLFEEGSVTNMLTSIVGNVFGFKALKALRLEDLRIPVAYLKTFQGPPHGIQVERDKLNKYGRPLLGCTIKPKLGLSAKNYGRAVYECLRGGLDFTKDDENINSQPFQRWRDRFLFVADAIHKAQAETGEIKGHYLNVTAPTCEEMLKRAEFAKELEMPIIMHDFLTAGFTANTTLSKWCRDNGMLLHIHRAMHAVMDRQKNHGIHFRVLAKCLRMSGGDHIHTGTVVGKLEGDKAVTLGFVDLLRENYIEQDRSRGIYFTQDWASMPGVMAVASGGIHVWHMPALVDIFGDDAVLQFGGGTLGHPWGNAPGATANRVALEACIQARNEGRDLMREGGDIIREAARWSPELAAACELWKEIKFEFEAQDTI

SEQ ID NO: 15800 - protein, 173 aa, Thermosynechococcus elongatus BP-1
MPRSQRNDNFIDKTFTVMADLILKVLPTSSQSKTAFAYYRDGMSAQADGEYAEALENYQAALELEEDPTDRSYILYNIGLIHASNGEHEKALEYYHQALELNPRMPQALNNIAVIYHYLGTQAEEQQRLEEAEQFFDRAADYWKRAIQLAPNNYIEAQNWLKTTGRSNIDVYF

SEQ ID NO: 15801 - protein, 471 aa, Thermosynechococcus elongatus BP-1
MATPQEILNLIDSKYELIDLKFTDMPGTWQHLTVHKSQISESSFTEGVPFDGSSIRGWKAINESDMVMVPDPNTAWEDPFMKEPTLSLICTIKDPRTGELYDRCPRSIATRAIEYLKATGIGDTAYFGPEAEFFVFDDVRYDQNQKSGYYYIDSIEGVWNSGREEEGGNLGYKIRGKEGYFPVAPTDTLQDLRTEMLLTMAKCGVPIEKHHHEVATAGQCELGFRFGTLVQAADWLMTYKYCVKNVARKHGKVATFMPKPVFNDNGSGMHTHQSIWKDGQPLFWGDGYANLSQIALWYIGGILKHAPALLAFTNPTTNSYKRLVPGFEAPVNLAYSQGNRSASVRIPLTGPNPKAKRLEFRCPDATSNPYLAFAAMLCAGIDGIKNQIDPGSPLDVDIYDLSPEELAKIPSTPGSLMAALENLQKDHSFLTAGGVFSEDFILNWIQYKLDTEVIPMSLRPHPYEFALYFDA

SEQ ID NO: 15802 - protein, 461 aa, Thermosynechococcus elongatus BP-1
MTYDYDLFVIGAGSGGLAASKRAASYGARVAIAEGDKVGGTCVIRGCVPKKLMVYGSKFSHLFEDAVGYGWHPVKAKLNWERLIRAVDQEVNRLSQLHISYLEKAGVELLPFFARFADPHTLELVDRQGQVQGRVTAAKILIAVGGEAIKPNVPGIEHSITSREMFLLPKQPKRLAILGGGYISVEFAGIMQGLGTEVIHFLRGDRPLRGFDQDIQDGVYGGMIRHGIDVRPQCHITGLKLTKKGNIRIRYEQQGQTRETKVDTVLCAVGRAPNLQGLGLDRAGVHLRTNRQGIVAIAVDEYYRTNQEHIFAVGDCTNRVNLTPVAIAEGRAFADTQFGNLPRTLSYENIPSAVFSQPEAASVGLSEAQAKAKLGEENVKIYRAAFRPMYHSLTGRPEQVIVKLVVENNTERVLGAHMVGDNAAEVIQGIAIALKMGATKKDFDATLGIHPSTAEEFVTLR

SEQ ID NO: 15803 - protein, 309 aa, Thermosynechococcus elongatus BP-1
MSLFDWFANRRKETALTPMQPEREIADGLWTKCEACGVMIYSKDLHSHQLVCPECGHHHRVSSSERIQQLIDPHTWRPLDENLVSCDPLQFKDRKPYSDRLREYQEKTGLKDAVQTGLGQLEGLPVALGVMDFAFMGGSMGSVVGEKITRLIERATWEHIPLVIVCASGGARMQEGMLSLMQMAKTAAALERHRSAGLLYIPILTHPTAGGVTASFAMLGDIIIAEPKATIAFAGRRVIEQTLREKLPDDFQTAEFVQKCGFVDVIVPRTQLKSTLARLIRLHQPVPSRMSSALLPKSFPLMAMAEESS

SEQ ID NO: 15804 - protein, 336 aa, Thermosynechococcus elongatus BP-1
MGITIENVSKSFGSFQAVKQVDLDIASGSLVALLGPSGSGKSTLLRLIAGLEMPDTGRILLTGKDATYQSVQERNIGFVFQHYALFKHMTVRQNIAFGLELRKVPRAKINARVAELLELVQLTGLGDRYPSQLSGGQRQRVALARALAVEPKVLLLDEPFGALDAKVRKELRAWLRRLHDDVHVTTVFVTHDQEEAMEVADQIVVMNKGQVEQVGTPAEIYDHPASPFVMSFIGPVNVLRSRVFQQSEGTAAHCDIFLRPRDIIIETRPNGNTVSARIHRIIHLGWEIQVELRLDDGQELMAHLSRERFDELHLEPQQQVFIKPREAKSFPLYYSI

SEQ ID NO: 15805 - protein, 260 aa, Thermosynechococcus elongatus BP-1
MIPYNLSDPRLFGIMVGVMFLMVVSRLLLVAGFFSLVYVVASWTPLRKRRVNLRPYQRGQFWQEFGWSLVTAAIFALAGAIAAVMWQRGWTAVYLELNSPWDYMYFPVSIGLVLLLHETYYYWLHRWMHQPKIYRRVHRVHHHSIVASPWTAFSFHPWEACLQAIFLPLIIVLVPLHPYAIVIQLSLMTLSSVINHLNLEIYPRGFAEHWLGQWLIGATHHSLHHSQFRCNYGLYFTFWDRWLGTESRDYLPLFRDRTQG

SEQ ID NO: 15806 - protein, 481 aa, Thermosynechococcus elongatus BP-1
MKAMSKLKLKRARRQKRPLLNLDWQPNFRWRSPALVACIPLALIIVAVWGVAAQAQDKPLTPEDVQGVLNTIWVLVAAILVIFMNAGFGMLETGFCRQKNAVNILAKNLIVFALATLAYWAIGYSFMFGTEGNAFIGWGGFFLSSEDPATYGLNPFPKGLPISVAFLFQAAFAGTAATIVSGAVAERIKFVDFLIFSLLLTGISYPITGHWVWGGGLLSSIGFLGENVAFKDFAGSTVVHAVGGWSALMGAAFLGPRIGKYAADGTPQALPGHNMGFAMLGCLILWIGWFGFNPGSQLAADEAVPYIAVTTNLAAAAGGVAATITAWLAIGKPDLSMIINGILAGLVSITAGCAGVSYWSAVIIGTIGGVIVVYSVLFFDRIKIDDPVGATSVHLVCGTWGTLAVGLFDKELGLFSGYGVTQLIAQIIGILTIGGFTVLLTSIFWLALKQTLGIRVSEEEEIKGLDIGEHGMEAYSGFLKE

SEQ ID NO: 15807 - protein, 276 aa, Thermosynechococcus elongatus BP-1
MSELCMSTPISVIVVGALGKMGREVVKAVHQAPDTALYAAVDRKQVGEDIGEALGLGTLEIPISGSLQEVCVAAAQEKQPVVMVDFTHPQAVYENVRMAIAYGVYPVVGTTGLSPEQIEELAEFADKADMGAVIAPNFSIGMVLLQEAAIRASQYFDHVEIIELHHNQKADAPSGTALQTAQRLAELGKTFNPPQVQESEHLRGARGAFAAAEIRIHSVRLPGLIAHQEVIFGAPGQIYTLRHDTSDRQCYMPGVLLAIRKVRQLKRLIYGLEKLL

SEQ ID NO: 15808 - protein, 238 aa, Thermosynechococcus elongatus BP-1
MFLNLKDIILLLHPILACTFVFPVIGMTTFFALQTRQRRLKNTPSIPATVGSLHVKLGNLLAAGVIGITLVALAYSVVFGFQGFLMQAEKNTLQPLSVVLVALMFIVTIAATVLLYHAQSKLWRAVFATLSGMGVIILAFQPGVFRRDDEWWVSHFYFGLAAVMLMIFSVAIVKEIYQDRSLTWRRIHIGLNSLALILFLLQGITGTRDLLEIPLSWQAPVVYQCNFDPRSPQFKTCP

SEQ ID NO: 15809 - protein, 406 aa, Thermosynechococcus elongatus BP-1
MGLEWIQPADRLGALPPYVFARLDELKLKARQQGLDLIDLGMGNPDGSAPRPVIEAAIAAFEEPSYHGYPPFEGTAVFRQAITRWYQRRYNVSLDPEGEALPLLGSKEGLTHLALAYVNPGDVVLVPSPAYPAHFRGPAIAGANIYPLILKREKGWLIDLSEIPSDIARQAKVLYFNYPSNPTAAIAPRSFFEEVVAFAREYQILLVHDLCYAELAFDGYQPTSLLEIPGAKEIGVEFHTLSKTYNMAGWRVGFVVGNRHIIQGLRTLKTNLDYGVFSVLQKAAEVALSLPDSYIASVCDRYRQRRDFLIQGLNELGWQLTPTQATMYLWVPVPLGMSSTDFALKLLQETGIVVTPGNAFGEGGEGYVRISLIADCDRLGEALKRMAQANIRFDSLSHSLTPSSHD

SEQ ID NO: 15810 - protein, 282 aa, Thermosynechococcus elongatus BP-1
MVRLGYLGPVGTYSEEAAQSYAQWHRGEALTLVPVTTIAGCLEALAAGELDLALVPSENSVEGSVNITLDSLWRLDTLHIQYAFIRPIVHAFIAQTTDLAEIEAVYSHPQALGQCQGWLQAYLPQARQCPVTSTAEGLQYVAQSDRVGAIASVRAAQLHHLPIIATEIQDIPDNCTRFWVVSRQQGEGWPQPGDTHTSIAFSLKANAPGALLKVLQLFSDRQINLSRIESRPSKRALGDYLFFVDLEVNGRPDVVADCLVALKEATDVLKVFGSYQFLDLGE

SEQ ID NO: 15811 - protein, 140 aa, Thermosynechococcus elongatus BP-1
MDKQMGQPLGLEPELGGQLRQSEARSGYEPELGGAHRQRGVYVDEITCIGCKHCAHVARNTFYIEPNYGRSRVVRQDGDPLELIQEAIDTCPVDCIHWVDYTELKRLEKERLDQVVPLAGLPVDPATTRRRKRRSPPRAE

SEQ ID NO: 15812 - protein, 133 aa, Thermosynechococcus elongatus BP-1
MGRKPVEPLTGAALLEKYKQLEHLSHEEKAKACGYYTVTKTGKERISKLKFNKALLEALGVNLDSKSGRGGKRGGRSASYRITVQANGNLLIGSAYTKQMNLKPGDEFEITLGRKHIHLKQVSRNGQPIDDDE

SEQ ID NO: 15813 - protein, 387 aa, Thermosynechococcus elongatus BP-1
MTIQLGGHRTARRAYGIDEIALVPGNRTLDPQLVDTRWRIGAIEREIPIIASAMDGVVDVTMAVKLSQMGALGVLNLEGIQTRYEDPAPILERIASVSVDEFVPLMQQLYAQPIQPHLIEKRIQEIKSQGGIAAVSLTPAGASRFGEVVAAAGADLLFVQATVVSPAHLAPEGTDPLDLAAFCERMPMPVILGNCVTYEVALSLMHCGAAAILVGIGPGAACTSRGVLGVGVPQVTAIADCAAARDAYFEETQRYVPVIADGGLVTGGDVCKCIACGADAVMMGSPFARAKEAPGRGYHWGMATPSPVLPRGTRIHVGTTGTLEQILRGPAQLDDGTHNFLGALQTSMGTLGAKDLREMQQVEIVIAPSLLTEGKVYQKAQKLGMGR

SEQ ID NO: 15814 - protein, 400 aa, Thermosynechococcus elongatus BP-1
MSKKSVAQLSAADLEGKRVLVRVDFNVPVDEKGVITDETRIRAALPTIQDLISKGAKVILVSHFGRPKGVDEKLRLTPVAQRLSELLHKPVAKLDDCIGDAVIAHTQAMANGDVCLLENVRFHPGEEKNDPEFAKQLAACAEVYVNDAFGTAHRAHASTAGVTQYLSPCVAGFLMEKELEYLQNAIEHPRRPLAAIVGGSKVSSKIGVIEALLEKVDKLLIGGGMIFTFYKARGLNVGKSLVEEDKLELAKHLETKAQEKGVELLLPTDVVVADNFANDANSQVVSIEAIPDDWMGLDIGPASVKRFQEALQDCKTVIWNGPMGVFEFDQFAKGTEAIARYLAELTSQGVCTIIGGGDSVAAVEKVGVADRMSHISTGGGASLELLEGKQLPGIAALDDA

SEQ ID NO: 15815 - protein, 362 aa, Thermosynechococcus elongatus BP-1
MPKAHWAIALPEGNSGGKAFYHKSIQFTSNNDGMNIKQGFVGTVGQTPLIRLNYFSDLTGCEILGKAEFLNPGGSVKDRAALYIIEDAERKGLLKPGGTVVEGTAGNTGIGLAHICNAKGYRCLIVIPNTQSQEKIDLLRTLGAEVRPVPAVPYKDPNNYVKLSGRIAAEMENALWANQFDNLANRQAHYETTGPEIWEQTDGRIDAWVAATGTGGTYAGVALFLKEKNPAIRTVIADPMGSAIYSYVKTGTLSSTGSSITEGIGNSRITANLAGAPIDDAIQIEDQECLDVIYQLLHYDGLFMGGSVGINVGAAVRLAKELGPGHTIVTVLCDGGSRYQSRLFNPEWLASKGLRVPEIKKR

SEQ ID NO: 15816 - protein, 413 aa, Thermosynechococcus elongatus BP-1
MAYILPVNAQILSNAIFLEQPQDLQAELVIATAISAAVGSILMGIWANYPIALAPGMGINAFFAFAVVGQMGLPWPVALSAVLLEGIVFVLLTLTGVRSLIVRMIPLSLKVAIAAGVGLFIAYIGLGNAGIIIADAATKTKLTTFHTWPPILAALGILLTAFLCAKEVRGAIFWGVMITAFAAWLVGAAPWPTGFLQWPQWPSHLFGQALVGFRELQPQQVGSFLLVTLVLLFTDIFDTVGTLSAVGVQAGLLNQQGHFPRALGAFMADAVGTIVGALFGTSTVVTYIESAAGIAVGGRTGLTALMVGGLFLLSLLFLPITTAIPSFATAPALVLVGVFMARSLPEIPWSDLTEAIPAFLVMLVMPLSYSISEGLGVGFISYPIVKLAAGKGREVHPALWGLAVIFVAHYFWR

SEQ ID NO: 15817 - protein, 231 aa, Thermosynechococcus elongatus BP-1
MSAKPVVIAPSILSADFSRLGEEIQAVDRAGADWIHVDVMDGRFVPNITIGPLIVEAIRPLTQKPLDVHLMIVEPEKYVADFAKAGADIISVHAEHNASPHLHRTLCQIRELGKQAGVVLNPSSPLELIEYVLEVCDLVLIMSVNPGFGGQKFIPAVLPKIRRLRQLCEERGLDPWIEVDGGLKVDNTWQVLEAGANAIVAGSAVFNAPDYAAAIAGIRNSKRPSPELVTA

SEQ ID NO: 15818 - protein, 505 aa, Thermosynechococcus elongatus BP-1
MKPTFPAIVTTAEMQAIEGAMFNGGLPIPALMEKVGQRLSHYLQAHFPTSQYPRVAVLAGPGHNGGDALVVARELWHRGYQVKLWQPFERLKPLTADHARYARFLGLPFVERVEALQEVDVIVDGLFGFGLERELTGELAHAIDEINTWPQPRVSIDVPSGLHSDTGAVLGTAIRADRTLCLGLWKRGLLVEEAQPWVGQGVLIPFDIPSVVIETALASAPRRYCLDDSCWQALPLSRSPITHKYQQGQLLLIGGSGQFGGSILLSALAARCTGVGMLVVAVPQSLKSLVLSRVPDAIVVGCPETPRGAIARLPEGLELGKFSAIACGPGLTPEAVSVVATVLRAETSLVLDADALNILATLSPWPLPSGTILTPHYGEFRRLFPDLVGTAGDRLDQVIAAARWSNAIVLLKGARTAIASARGDLWINPHSTPALARGGSGDVLTGLIGGLLAQQEALRATYGGVWWHAQAALEAEQQATSLGVYPEQLIAHLLPTLRRALAARV

SEQ ID NO: 15819 - protein, 363 aa, Arabidopsis thaliana
MSSDAARTPLLPTEKIDTMAQDFNLNSRTSSSRKRRLRRSRSAPRGDCMYNDDVKIDEPPPHPSKIPMFSDLNPNLRRVIMFLALYLTIGTLCFYLVRDQISGHKTSGVVDALYFCIVTMTTVGYGDLVPNSSASRLLACAFVFSGMVLVGHLLSRAADYLVEKQEALLVRAFHLRQSFGPTDILKELHTNKLRYKCYATCLVLVVLFIVGTIFLVMVEKMPVISAFYCVCSTVTTLGYGDKSFNSEAGRLFAVFWILTSTICLAQFFLYVAELNTENKQRALVKWVLTRRITNNDLEAADLDEDGVVGAAEFIVYKLKEMGKIDEKDISGIMDEFEQLDYDESGTLTTSDIVLAQTTSQIQR

SEQ ID NO: 15820 - protein, 298 aa, Saccharomyces cerevisiae
SIPETQKLEYKDIPVPKPKANELLINVKYSGVCHTDLHAWHGDWPLPTKLPLVGGHEGAGVVVGMGENVKGWKIGDYAGIKWLNGSCMACEYCELGNESNCPHADLSGYATADAVQAAHIPQGTDLAEVAPVLCAGITVYKALKSANLMAGHWVAISGAAGGLAKAMGYRVLGIDGGEGKEELFREKDIVGAVLKVSVSEAAIEASTRYVRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 15821 - protein, 284 aa, Saccharomyces cerevisiae
SIPETQKLEHKDIPVPKPKANELSINVKSGVCHTDLLPLVGGHEGAGVVVGMGENVKGWKIGDYAGIKWLNGSCMACEYCELGNESNCPHADLSGYTHDGSFQQYATADAVQAAAEVCAGITVYKALKSANLRVAISGVAGGLGSLAVQYAKAMGYRVLGIDGGEGKSIGGDVFIDFTKEKDIVSAVLKAINVGAHGVIAIEASTRYVRANGTVVLVGLPAGAKCSSDVFNHVVKADTREALDFFARGLVKSPIKVVGLASLPEIYEKMEKGQIAGRYVVDTSK

SEQ ID NO: 15822 - protein, 234 aa, Legionella adelaidensis
MKMKLVAAAAMGLAMTTSIAATNNTQLTTEMDKLSYSIGTDLGKNFKRQGIDINPDMMAKGLKDGMNGGTLLLTDDQMKEVLNKFQKDLMAKRTAEFNKKAEQNKTKGESFLKENKQKQGVVTLPSGLQYKIITAGNGEKPNKEDTVTVEYTGRLIDGEVFDSTERTGKPATFNLSQVIPGWTEALQLMPAGSTWEIYVPADLAYGTRSVGGPIGPNETLIFNIHLISVKKNNA

SEQ ID NO: 15823 - protein, 232 aa, Legionella anisa
MKMKLVTAAVMGLAMSTVMAADATSLVTDKDKLSYSIGADLGKNFKNQGIDINPDALAKGMQDGMSGAQLILTEQQMKDVLNKFQKELMAKRSAEFNKKAEENKSKGDAFLSTNKSKSGVTVLPSGLQYKVIEAGTGNKPGKADTVTVEYTGTLIDGTVFDSTEKTGKPATFQVSQVIPGWTEALQLMPAGSTWEIYVPSDLAYGPRSVGGPIGPNETLIFKIHLISVKKSA

SEQ ID NO: 15824 - protein, 233 aa, Legionella birminghamensis
MKMKLVAAATMGLAMSTAIAASDVTLSTDMDKLSYSIGADLGKNFKKQGIEINPTAMAKGLQDGMSGSQLMLTEDQMKEVLNNFQKDLMAKRNAEFSKKSEENKAKGETFLSQNKSKEGVVSLPSGLQYKIIETGSGAKPAKDDTVTVEYTGRTIDGQVFDSTDKSGKPATFKVSQVIPGWTEALQLMPAGSTWEIYIPSGLAYGPRSVGGPIGPNETLIFKIHLISVKKAGA

SEQ ID NO: 15825 - protein, 233 aa, Fluoribacter bozemanae
MKMKLVTAAVMGLAMSTVIAATDATSLVTDKDKLSYSIGADLGKNFKNQGIDINPDALAKGMQDGMSGAQLILTEQQMKDVLNKFQKELMAKRSAEFNKKAEENKSKGEAFLSTNKSKSGVVVLPSGLQYKVIEAGTGNKPGKSDTVTVEYTGTLIDGTVFDSTEKTGKPATFQVSQVIPGWTEALQLMPAGSTWEIYVPSDLAYGPRSVGGPIGPNETLIFKIHLISVKKSA

SEQ ID NO: 15826 - protein, 233 aa, Legionella cherrii
MKMKLVTAAIMGLAMSTAMAATDATSLVTDKDKLSYSIGADLGKNFKNQGIDINPDALAKGMQDGMSGAQLILTEQQMKDVLNKFQKDLMAKRSAEFNKKAEENKAKGEAFLSTNKSKSGVVVLPSGLQYKIIEAGTGAKPGKSDTVTVEYTGTLIDGTVFDSTEKAGKPATFQVSQVIPGWTEALQLMPAGSTWEIFVPSDLAYGPRSVGGPIGPNETLIFKIHLISVKKAA

SEQ ID NO: 15827 - protein, 233 aa, Legionella cincinnatiensis
MKMKLVTAAIMGLAMSTAMATTDATSLTTDKDKLSYSIGADLGKNFKNQGIDINPEALAKGMQDGMSGAQLILTEEQMKDVLSKFQKDLMAKRSAEFNKKAEENKAKGEAFLSANKSKPGIVVLPSGLQYKIIDAGTGAKPGKSDTVTVEYTGTLIDGTVFDSTEKAGKPATFQVSQVIPGWTEALQLMPSGSTWEVYVPADLAYGPRSVGGPIGPNETLIFKIHLISVKKAA

SEQ ID NO: 15828 - protein, 234 aa, Fluoribacter dumoffii
MKMKLVTAAIMGLAMSTAMAATDATSLVTDKDKLSYSIGADLGKNFKNQGIDINPEALAKGMQDGMSGAQLILTEQQMKDVLNKFQKDLMAKRSAEFNKKAEENKAKGEAFLSSNKSKSGVVVLPSGLQYKVIEAGSGAKPGKSDTVTVEYTGTLIDGTVFDSTEKAGKPATFQVSQVIPGWTEALQLMPAGSTWEIYVPSNLAYGPRSVGGPIGPNETLIFKIHLISVKKASA

SEQ ID NO: 15829 - protein, 232 aa, Fluoribacter gormanii
MKMKLVTAAIMGLAMSTAMAATDATSLVTDKDKLSYSIGADLGKNFKNQGIDINPEALAKGMQDGMSGAQLILTEQQMKDVLNKFQKDLMAKRSAEFNKKAEENKSKGEAFLSTNKSKSGVVVLPSGLQYKVIEAGTGSKPGKSDTVTVEYTGTLIDGTVFDSTEKTGKPATFQVSQVIPGWTEALQLMPAGSTWEIYVPSDLAYGPRSVGGPIGPNETLIFKIHLISVKKA

SEQ ID NO: 15830 - protein, 249 aa, Legionella brunensis
MKMRLVAAAVIGLTMSTAIVAADASATATPAPATSATPTTSLNSDMDKLSYSIGADLGKNFKKQGIDINPSAMAKGLQDGMSGGQLLLTEQQMKDVLNKFQKDLMAKRTAEFSKKADENKAKGEAFLNQNKAKEGVVSLPSGLQYKIIQKGDGAKPSKEDTVTVEYTGTLIDGQVFDSTDKAGKPATFKVSQVIPGWTEALQLMPAGSTWEVYVPADLAYGPRSVGGPIGPNETLIFKIHLISVKKSDA

SEQ ID NO: 15831 - protein, 246 aa, Legionella erythra
MKIKLVAAAVVSLAMTTAFAETTTPAAGTTTPATAATPATLTTDIDKLSYSIGADLGKNFKKQGIEISPSAMAKGLQDGMSGSQLLLTEDQMKDVLSKFQKDLMAKRNAEFTKKAEENKSKGEAFLSQNKTKEGVVTLPSGLQYKIIEKGNGAKPTKEDTVTVEYTGRLIDGQVFDSTDKTGKPATFKVSQVIPGWTEALQLMPAGSVWEVYVPASLAYGPRSVGGPIGPNETLIFKIHLISVKKS

SEQ ID NO: 15832 - protein, 241 aa, Legionella fairfieldensis
MKMRLVAAAVMSLAMSTTIAATDAATVAPSATSLNSDMDKLSYSIGADLGKNFKKQGIDISPAAMAKGLQDGMNGSQLLLTEDQMKDVLNKFQKDLMMKRTAEFNKKSEENKTKGEAFLNANKTKEGVVSLPSGLQYKIIEKGEGAKPAKEDTVTVEYTGRLIDGQVFDSTDKTGKPATFKVSQVIPGWTEALQLMPAGSTWEVYVPSALAYGPRSVGGPIGPNETLIFKIHLISVKKSDA

SEQ ID NO: 15833 - protein, 233 aa, Legionella gratiana
MKMKLVTAAIMGLAMSTAMAATDATSLATDKDKLSYSIGADLGKNFKNQGIEVNPEVLAKGMQDGMSGAQLILTEEQMKDVLSKFQKDLMAKRSAEFNKKAEENKAKGDAFLSANKAKPGVVALPSGLQYKIIDAGNGTKPGKSDTVTVEYTGTLIDGTVFDSTEKAGKPATFQVSQVIPGWTEALQLMPAGSTWEVYVPSDLAYGPRSVGGPIGPNETLIFKIHLISVKKEA

SEQ ID NO: 15834 - protein, 249 aa, Legionella hackeliae
MKMRLVAAAVIGLTMSTAIIAADASATATTAPATSATPATSLNSDMDKLSYSIGADLGKNFKKQGIDISPAAMAKGLQDGMSGGQLLLTEQQMKDVLNKFQKDLMAKRNADFNKKAEENKAKGDAFLNQNKAKDGVVSLPSGLQYKILQKGDGAKPSKDDTVTVEYTGTLIDGQVFDSTDRTGKPATFKVSQVIPGWTEALQLMPAGSTWEVYVPADLAYGPRSVGGPIGPNETLIFKIHLISVKKSDA

SEQ ID NO: 15835 - protein, 242 aa, Legionella israelensis
MKLKLVAATVMSMAISTAIAATDASSLNTDVEKLSYSIGADLGKNFKKQGIEIDPQAMAAGMKDGMSGDKLKLTEQQMRDVLNKFQQELMAKRNAEFNKKAAENKAKGEAFLEQNKGKEGVVTLPSGLQYKILEKGTGTKPSKSDTVTVEYTGRLINGQVFDSSERVGKPATFKVSQVIPGWTEALQLMPAGSTWEIYVPSDLAYGPRSIGGPIGPNETLIFKIHLISVKKDKDTDTAQKDA

SEQ ID NO: 15836 - protein, 251 aa, Legionella jordanis
MKMRLVAAAVMGLAMTSAIAANDATNTATSATPASNTATSATSLNSDMDKLSYSIGADLGKNFKKQGIDINPAAMAKGLQDGMSGVQLQLTEQQMKDVLNKFQKDLMAKRNAEFSKKADENKSKGEAFLNANKSKEGVVSLPSGLQYKILEKGNGVKPSKDDTVTVEYTGKLIDGQVFDSTERTGKPATFKVSQVIPGWTEALQLMPAGSTWEVYVPADLAYGPRSVGGPIGPNETLIFKIHLISVKKSDA

SEQ ID NO: 15837 - protein, 249 aa, Legionella lansingensis
MKMRLVAAAVMGLAMTTAIAASNTPNAATPTTPAAATSATSLNSDTDKLSYSIGADLGKNFKKQGIDINPSAMAKGLQDGMSGGQLLLTEQQMKEVLNKFQKDLMAKRNAEFTKKAEENKIKGEAFLTANKNKDGVISLPSGLQYKVLEKGNGAKPTKNDTVTVEYTGKLIDGQVFDSTERTGKPATFKVSQVIPGWTEALQLMPAGSTWEVYVPADLAYGPRSVGGPIGPNETLIFKIHLISVKKSEA

SEQ ID NO: 15838 - protein, 229 aa, Legionella londiniensis
VAAAAMSLAMTTTMAATTTPALDSDIDKLSYSIGIDLGKNFKRQGIDVNPEILVKGLQDGISGNKSLLTEDQMRDVLDKFQKDLMAKRTAEYKKQAEENKAKGEAFLKENKAKEGVVTLPSGLQYKIIKSGSGKKPGKEDTVTVEYTGRLINGEVFDSTEKTGKPATFKLSQVIPGWTEALQLMSEGAIWEIYVPSDLAYGPRSVGGPIGPNETLIFKIHLLEVNKSEA

SEQ ID NO: 15839 - protein, 244 aa, Tatlockia maceachernii
MKMRLVAAAAMGLAMSTTIAASATTTDTATSAPATSLATDTEKLSYSIGADLGKNFKKQGIEISPAAMAKGLQDGMSGGQLLLTDEQMKEVLNKFQKDLMMKRSAEFNKKAEDNKAKGEAFLNDNKSKEGVVSLPSGLQYKIIERGDGAKPTKEDVVTVEYTGKLIDGQVFDSTDKTGKPATFKVSQVIPGWTEALQLMPAGSTWEVYIPANLAYGPRSVGGPIGPNETLIFKIHLISVKKSDA

SEQ ID NO: 15840 - protein, 233 aa, Legionella moravica
MKMKLVTAAVLGLAMSSAMATDATSLPTDKDKLSYSIGADLGKNFKNQGIDVNPEALAKGMQDGMSGAQLILTEQQMKDVLNKFQKDLMAKRTSEFNKKAEENKSKGEAFLTENKSKTGVVVLPSGLQYKIIDAGTGAKPGKTDTVTVEYTGRLIDGTVFDSTEKTGKPATFQVSQVIPGWTEALQLMPAGSTWEIYVPASLAYGPRSVGGPIGPNETLIFKIHLISVKKSAS

SEQ ID NO: 15841 - protein, 241 aa, Legionella nautarum
MKMRLVAAAAMSLAMSTTIAANATATSTPSAASLSTDTDKLSYSIGADLGKNFKKQGIDISPAAMAKGLQDGMSGGQLLLTEEQMKEVLNKFQKELMMKRSAEFNKKSEENKSKGEAFLKDNKSKDGVVSLPSGLQYKILEKGDGAKPAKDDTVTVEYTGRLINGQVFDSTEKTGKPATFKVSQVIPGWTEALQLMPSGSTWEVYIPSDLAYGPRSVGGPIGPNETLIFKIHLISVKKTDA

SEQ ID NO: 15842 - protein, 234 aa, Legionella oakridgensis
MKLKLVAAAVMGLAMSTAMAATDASSLTTDTDKLSYSIGIDLGKNFKRQGIEINPQAMVQGLQDGISGNKQQLTEEQMKDVLTKFQRDLMTKRTAEYNKKAEDNKKKGEEFLEQNKSKEGVVTLPSGLQYKILKAGDGQKPVKEDTVTVEYTGRLINGEVFDSTEKNGKPASFKLSQVIPGWTEALQLMPAGSVWEVYVPSDLAYGSRSVGGPIGPNETLIFKIHLISVKKSDA

SEQ ID NO: 15843 - protein, 233 aa, Legionella parisiensis
MKMKLVTAAVMGLAMSTVMAATDATSLVTDKDKLSYSIGADLGKNFKNQGIDINPDALAKGMQDGMSGAQLILTEQQMKDVLNKFQKELMAKRSAEFNKKAEENKSKGDAFLSTNKSKSGVTVLPSGLQYKVIEAGTGNKPGKSDTVTVEYTGTLIDGTVFDSTEKTGKPATFQVSQVIPGWTEALQLMPAGSTWEIYVPSDLAYGPRSVGGPIGPNETLIFKIHLISVKKSA

SEQ ID NO: 15844 - protein, 233 aa, Legionella quateirensis
MKMKLVTAAVLGLAMSTAMATDATSLPTDKDKLSYSIGADLGKNFKNQGIDVNPEALAKGMQDGMSGAQLILTEQQMKDVLNKFQKDLMAKRTSEFNKKAEENKSKGEAFLTENKSKTGVVVLPSGLQYKIIDAGTGAKPGKSDTVTVEYTGRLIDGTVFDSTEKTGKPATFQVSQVIPGWTEALQLMPAGSTWEIYVPASLAYGPRSVGGPIGPNETLIFKIHLISVKKSAS

SEQ ID NO: 15845 - protein, 233 aa, Legionella quinlivanii
MKMKLVAAATMSLAMSTAIAASDVTLSTDMDKLSYSIGADLGKNFKKQGIEVNPAAMAKGLQDGMAGSQLMLTDDQMKEVLNKFQKDLMSKRNAEFSKKSEENKSKGEAFLNQNKTKEGVVSLPSGLQYKVIETGSGAKPAKEDTVTVEYTGKTIDGQVFDSTDKSGKPATFKVSQVIPGWTEALQLMPAGSTWEIYIPSNLAYGPRSVGGPIGPNETLIFKIHLISVKKAAA

SEQ ID NO: 15846 - protein, 248 aa, Legionella rubrilucens
MKIKLVAAAVVGLAMTTAFADTNTTAPSTTTPATAATPATLNTDIDKLSYSIGADLGKNFKKQGIEISPSAMAKGLQDGMSGSQLLLTEDQMKDVLSKFQKDLMAKRNAEFTKKAEENKSKGEAFLSQNKSKEGVVTLPSGLQYKIIEKGNGAKPTKDDTVTVEYTGRLIDGQVFDSTDKTGKPATFKVSQVIPGWTEALQLMPAGSVWEVYVPASLAYGPRSVGGPIGPNETLIFKIHLISVKKSDA

SEQ ID NO: 15847 - protein, 233 aa, Legionella sainthelensi
MKMKLVTAAIMGLAMSTAMAATDATSLTTDKDKLSYSIGADLGKNFKNQGIDINPDVLAKGMQDGMSGAQLILTEEQMKDVLSKFQKDLMAKRSAEFNKKAEENKAKGEAFLSANKSKPGIVVLPSGLQYKIIDAGTGAKPGKSDTVTVEYTGTLIDGTVFDSTEKAGKPATFQVSQVIPGWTEALQLMPSGSTWEVYVPADLAYGPRSVGGPIGPNETLIFKIHLISVKKAA

SEQ ID NO: 15848 - protein, 233 aa, Legionella santicrucis
MKMKLVTAAIMGLAMSTAMAATDATSLTTDKDKLSYSIGADLGKNFKNQGIDINPEALAKGMQDGMSGAQLILTEEQMKDVLSKFQKDLMAKRSAEFNKKAEENKAKGDAFLSANKSKPGIVVLPSGLQYKIIDAGTGSKPGKSDTVTVEYTGTLIDGTVFDSTEKAGKPATFQVSQVIPGWTEALQLMPSGSTWEVYVPADLAYGSRSVGGPIGPNETLIFKIHLISVKKAA

SEQ ID NO: 15849 - protein, 234 aa, Legionella shakespearei
MKMKLVTAAVMGLALSTAMAAPDATSLPTDKDKLSYSIGADLGKNFKTQGIDINPEALAKGMQDGMSGTQLILTEQQMKDVLNKFQKDLMAKRTSEFNKKADENKSKGEAFLVENKGKTGVVVLPSGLQYKIIDAGTGAKPGKSDTVTVEYTGRLIDGTVFDSTDKTGKPATFQVSQVIPGWTEALQLMPAGSTWEIYVPSALAYGSRSVGGPIGPNETLIFKIHLISVKKTEA

SEQ ID NO: 15850 - protein, 235 aa, Legionella spiritensis
MKMKLVAAAALGLAMSTTHAVTDTTTNLNTDTDKLSYSIGADLGKNFKKQGIDISPAAMAKGIQDGMSGGELMMTDQQMKDVLNKFQKDLMARRSAEFAKKSEENKARGETFLSQNKTKDGVVTLPSGLQYKVIEKGNGAKPSKDDVVTVEYTGRLIDGQVFDSTEKTGKPATFKVSQVIPGWTEALQLMPAGSTWEVYIPASLAYGSRSVGGPIGPNETLIFKIHLISVKKTDA

SEQ ID NO: 15851 - protein, 232 aa, Legionella steigerwaltii
MKMKLVTAAIMGLAMSTAMAATDATSLVTDKDKLSYSIGADLGKNFKNQGIDINPDALAKGMQDGMSGAQLILTEQQMKDVLNKFQKDLMAKRSAEFNKKAEENKAKGEAFLSSNKSKSGVVVLPSGLQYKIIEAGTGNKPGKSDTVTVEYTGTLIDGTVFDSTEKTGKPATFQVSQVIPGWTEALQLMPAGSTWEIFVPSDLAYGPRSVGGPIGPNETLIFKIHLISVKKA

SEQ ID NO: 15852 - protein, 233 aa, Legionella tucsonensis
MKMKLVTAAVMGLAMSTVIAATDATSLVTDKDKLSYSIGADLGKNFKNQGIDINPDALAKGMQDGMSGAQLILTEQQMKDVLNKFQKELMAKRSAEFNKKAEENKSKGETFLSTNKSKSGVVVLPSGLQYKIIEAGTGNKPGKSDTVTVEYTGTLIDGTVFDSTEKAGKPATFQVSQVIPGWTEALQLMPAGSTWEIYVPSDLAYGPRSVGGPIGPNETLIFKIHLISVKKSA

SEQ ID NO: 15853 - protein, 234 aa, Legionella wadsworthii
MKMKLVNAAILGLAMSTAMAATDATSLVTDKDKLSYSIGADLGKNFKTQGIDINPDALAKGMQDGMSGAQLILTEQQMKDVLNKFQKDLMAKRSAEFNKKAEENKSKGDSFLSSNKSKSGVVVLPSGLQYKVIEAGTGNKPSKTDTVTVEYTGTLIDGTVFDSTEKTGKPATFQVSQVIPGWTEALQLMPAGSTWEIYVPSDLAYGPRSVGGPIGPNETLIFKIHLISVKKASA

SEQ ID NO: 15854 - protein, 233 aa, Legionella worsleiensis
MKMKLVAAAVLGLAMSGAMAADATSLTTDKDKLSYSIGADLGKNFKNQGIDVNPEALAKGMQDGMSGTQLILTEQQMKDVLNKFQKDLMAKRTSEFNKKADENKLKGEAFLTANKTKAGVVVLPSGLQYKILDAGTGTKPGKSDTVTVEYTGRLIDGTIFDSSDKTGKPATFQVSQVIPGWTEALQLMPAGSTWEIYVPAALAYGSRSIGGPIGPNETLIFKIHLISVKKSDA

SEQ ID NO: 15855 - protein, 379 aa, Catharanthus roseus
MAKQVDNGQEEQQQNPQNPLLTPYKLGKFQLSHRIVLAPLTRQRSYGNVPQPHAVLYYSQRTSKGGLLISEAAGVSNTAQGYPMTPGIWTKEQVEAWKPIVDAVHAKGGVFFCQIGHVGRVSNYSYQPNGQAPISSTDKGLTPLYRANGIGYVEHTPPRRLTTDELPGIVNDFRAALNAIEAGFDGVEIHGAHGYLIDQFLKDQVNDSTDEYGGSLENRCRFALEIVEAVSNAIGADRVGIRLSPFAGYMESGDSNPEALGLYMAEALNKYGILYCHMVNPRMKTLGENCEVPHSLLPMRKAFRGTFMAAGGYDREDGIKALAENRADLVVYGRLFLANPDLPKRFELNAPLNKYNRETFYIPDPVLGYTDYPFLEATE

SEQ ID NO: 15856 - protein, 403 aa, Arabidopsis thaliana
MDHLSNLPDELLCHIMSFLTTKEAALISVLSKRWRNLIAFVPNLDIFDCDILHWEVRKEERDDIRQLFMDFVDRVLALQGNSPLKKFSLCCGGGSYSDRVDCWIQNVMVRGVSELDLSMIFDTSYHMYPQVFENKKLNFEIFLRALPALEELVMNHIYWKELDVNVHVSVSSASLKTLTIKCIVCLHTKSFDTPSLAYLSYSDYAMGDYPVAKMENLFEARISLFVPEDDISRLMNSIRNVRYLYFSRDTLEVLSLCCESMPVFKNLKSLSIKSVESRGWQAMPVLLRNCPHLETLVLEALLHHVTDKCGDACACVSREEKGRSLKSCPVKVLEIKEFQGTMKEMHMIKHFLDYLPCLKEMKISYMKKNDHTTQFRVIPQVIAEMVEHYNKLSNCNVQLVVSG

SEQ ID NO: 15857 - protein, 462 aa, Arabidopsis thaliana
MDLLRNIPDELICHILSFLTTKEAALTSVLSKRWRNLLAFVSNLHIDDSIFLHPEEGKRDRNEIRQSFLDFVGRILALQGNCPVKKVSIKFLFKLDSDRVDGWISNVLARGVSELDLSIDLCMDEYFLLSSKRFESKNLVRLKLHRLCIGQREKTVGWLAGEIFLPMLKTLELDYVGFYGDLLFLRALPALEELVIVDAFWFTTFTDVTVSNPSLKTLTMSSNIYSGSISFDTPSLVYFSHFKYVAKDYPLVNMENLLEARINLGVTEGQIRRAREPNNNDEVVLRFPNVGKLMNGIRNVQCLDLSANTLEMLSLSCESMPVFKNLKSLSIKSAENRGWQAMPVLLRNCPHLETLVLEGLLHFVTDKCGDACDCVSREEKGRSLTSCPVKTLEIKEFHGTMEEMYMITHFLDYFPCLKELKIYIEGNDHAQREVSEVIAEKIKLYNKSSSSNVQLMVSGYHE

SEQ ID NO: 15858 - protein, 289 aa, Arabidopsis thaliana
MASFELWADIFGPDVYFPGNKNRRGRKRRPWRQVMYGSRGAMFGSGGYEVGSKRQRMMQSNPYLAVGTGPTSFPPFGYAGGFPVVRLRGLPFNCADIDIFEFFAGLNIVDVLLVSKNGKFSGEAFVVFAGPMQVEIALQRDRHNMGRRYVEVFRCSKQDYYNAVAAEEGAYEYEVRASPPPTGPSRAKRFSEKEKLEYTEVLKMRGLPYSVNKPQIIEFFSGYKVIQGRVQVVCRPDGKATGEAFVEFETGEEARRAMAKDKMSIGSRYVELFPTTREEARRAEARSRQ

SEQ ID NO: 15859 - protein, 497 aa, Arabidopsis thaliana
MEMTLMVSLCLTTLLTLLLLKKFLKRTAKKVNLPPSPWRIPVIGNLHQLSLHPHRSLHSLSLRYGPLMLLHFGRVPILVVSSSEAAHEILKTHDLKFANRPKSKAVHGLMNGGRDVVFGPYGEYWRQMKSVCILNLLTNKMVASFEKVREEEVNAMMEKLEKASCSSSAENLSELFVTLTSDVTSRVSLGKKYWEDETAGGLKKRVRQIMELLREFPIGDYVPALAWIDRINGFNSKIVEVSRAYSDLMEKVVQEHLEAGEHKADFVNILLSIEKEKNNGFKVQRNDIKFMILDMFIGGISTSSTLLEWIMTELIRNPECMKKLQNEIRSTIRPHGSYIKEKEVENMRYLKAVIKEVFRVHPPLPLILPRLLTEDVKVKGYDIAAGTEVLINAWSIHRDPAIWGPDAEEFKPERHLDSTLDYHGQDLKYIPFGSGRRICPGINLAMGLVEVTLANLVGRFDWSVDPGPNGDQPDLAEDFGLDVCRKNPLIAFPSSVA

SEQ ID NO: 15860 - protein, 379 aa, Arabidopsis thaliana
MERGLLELHLHAESFLFVERELFTSKTLVKLTLSAGYDFEAERVFLPALKSLYLLTDSGIDYDNHCRLLDGCPALEELFIRDADHDCPPCCGSVVKSASIKRLVVLVNLPNKRDSHDYAYFEAPSLVYLDYSSYVYETYQIVGLDSLVEARLSLKIWDYYDYNYDYEYDDESGDYYSDDDEGRSYCYSYVDDERKEPIFGDVTNLLAGVTNITTLHLSPDSLEAFYFCCKSMPVFNKLLNLFIESNKDKGWQGMPLLLKSCPILHTLVFKGLVHRVTNKCGDACACIPKKEKRENEKKNRKIVEKKLSCLWTCQVKVLEISKYDGSFQELKQMGHLLGKLGCLESVKVGVHADNNTEFLQANLLALPRLSSKCNNIQFS

SEQ ID NO: 15861 - protein, 369 aa, Arabidopsis thaliana
MAVKKACEMFPKSLIEDVHKWGCMKQTGVSLRYMMEFGSKPTERNLLISAQFLHKELPIRVARRAIELQTLPYGLSDKPAVLKVRDWYLESFRDMRAFPEIKDSGDEKDFTQMIKAVKVRHNNVVPMMALGVNQLKKGMNSGNLDEIHQFLDRFYLSRIGIRMLIGKTWQHVELHNPNPPLHTVGYIHTKMSPMEVARNASEDARSICFREYGSAPEINIYGDPSFTFPYVPTHLHLMMYELVKNSLRAVQERFVDSDRVAPPIRIIVADGIEDVTIKVSDEGGGIARSGLPRIFTYLYSTARNPLEEDVDLGIADVPVTMAGYGYGLPISRLYARYFGGDLQIISMEGYGTDAYLHLSRLGDSQEPLP

SEQ ID NO: 15862 - protein, 137 aa, Arabidopsis thaliana
MKANAGALTNFELLDFLNSRGASKDTTRVIAPIARSEYKVYDYLVETAASTQTRESVNKSADKCKDFKLAKAEILNIINLWPSSIVELLPIIENLDDREIDTDGILELVKDLLPPLPTAESPKDNDEEEETENGEQS

SEQ ID NO: 15863 - protein, 420 aa, Arabidopsis thaliana
MLLHFGSVPVIVASTAEAARDVLKTHDRVFASRPRSKIFEKLLYKSRNMASAPYGEYWRQMKSVSVLHLLSNKMVRSFQDVRQEEITLMMETIRKSSSKPVNLSKILSSLTNDVICRVALGRKYGVGTDFKELIDRLMRQLGTFTIGSYVPWLAWTDWVSGLEARLEKTANDFDKLLERIVQDHEDGDGDKTDFVDVLLAAQRDKSFGFDIDRLSIKAIVLDAFVGGTDTSSTLVEWEMTELLRHPTCLKKLQEEVRTICKGKSSVSEDDIQGMEYLKAVVKEALRLHPPVPLMVPHQSTQDVRLRDNHIPAGTQVIVNLWAVGREAATWGPDANEFRPERHLESPSDFRGQDFELIPFGAGRRMCPGISFAVVLNEVVLANLVHGFDWQSIDDETDVAESIGSVIRRMHPLYVIPSSTT

SEQ ID NO: 15864 - protein, 339 aa, Arabidopsis thaliana
MVCFNFNEMKTKKTLIGLGLGQIISLLSTLIASIASEIARKGISAPTSQTFLGYVSLAIVYGGIMLYRRSAIKVKWYHYFLLAVVDVEANFLVVKAFQNTSMTSIMLLDCWAIPCVLVLTWVFLKTRYRLMKISGVVICIVGVVMVVFSDVHAGDRAGGSNPVKGDFLVIAGATLYAVSNVTEEFLVKNADVTELMAFLGLFGAIIAAIQISIFERGAVRAIQWSTEAILLYIGGALGLFLFYTLITILIKNNGSTMFNLSLLTSDMWAILIRTFGYHEKVDWLYFLAFATTATGLIIYSMKEKDEEEQRSGEVVSERRKLFDEEDGDSLHSNLIDAST

SEQ ID NO: 15865 - protein, 476 aa, Anabaena sp.
MSYAQTKTQTKSGYKAGVQDYRLTYYTPDYTPKDTDILAAFRVTPQPGVPFEEAAAAVAAESSTGTWTTVWTDLLTDLDRYKGRCYDIEPVPGEDNQFIAYIAYPLDLFEEGSITNVLTSIVGNVFGFKALRALRLEDIRFPVAYIKTFQGPPHGIQVERDKLNKYGRPLLGCTIKPKLGLSAKNYGRAVYECLRGGLDFTKDDENINSAPFQRWRDRFLFVADAITKAQAETGEIKGHYLNVTAPTCEEMLKRAEYAKELKQPIIMHDYLTAGFTANTTLARWCRDNGLLLHIHRAMHAVIDRQKNHGIHFRVLAKALRLSGGDHIHTGTVVGKLEGERGITMGFVDLLRENYVEQDKSRGIYFTQDWASLPGVMAVASGGIHVWHMPALVEIFGDDSVLQFGGGTLGHPWGNARGATANRVALEACVQARNEGRNLAREGNDVIREAAKWSPELAVACELWKEIKFEFEAMDTV

SEQ ID NO: 15866 - protein, 472 aa, Synechococcus elongatus PCC 6301
MPKTQSAAGYKAGVKDYKLTYYTPDYTPKDTDLLAAFRFSPQPGVPADEAGAAIAAESSTGTWTTVWTDLLTDMDRYKGKCYHIEPVQGEENSYFAFIAYPLDLFEEGSVTNILTSIVGNVFGFKAIRSLRLEDIRFPVALVKTFQGPPHGIQVERDLLNKYGRPMLGCTIKPKLGLSAKNYGRAVYECLRGGLDFTKDDENINSQPFQRWRDRFLFVADAIHKSQAETGEIKGHYLNVTAPTCEEMMKRAEFAKELGMPIIMHDFLTAGFTANTTLAKWCRDNGVLLHIHRAMHAVIDRQRNHGIHFRVLAKCLRLSGGDHLHSGTVVGKLEGDKASTLGEVDLMREDHIEADRSRGVFFTQDWASMPGVLPVASGGIHVWHMPALVEIFGDDSVLQFGGGTLGHPWGNALGATANRVALEACVQARNEGRDLYREGGDILREAGKWSPELAAALDLWKEIKFEFETMDKL

SEQ ID NO: 15867 - protein, 474 aa, Anabaena sp.
MTTPQEVLKRIQDEKIELIDLKFIDTVGTWQHLTLYQNQIDESSFSDGVPFDGSSIRGWKAINESDMTMVLDPNTAWIDPFMEVPTLSIVCSIKEPRTGEWYNRCPRVIAQKAIDYLVSTGIGDTAFFGPEAEFFIFDSARFAQNANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNLIHPGEPLDKNIYELSPEELAKVPSTPGSLELALEALENDHAFLTDTGVFTEDFIQNWIDYKLANEVKQMQLRPHPYEFSIYYDV

SEQ ID NO: 15868 - protein, 152 aa, Hordeum vulgare subsp. vulgare
HMGVKIAKAMGHHVTVISSSDKKRQEALEHLGADDYLVSSDSTRMQEVADSLDYIIDTVPVFHPLEPYLSLLRLDGKLILMGVINTPLQFLTPVVMLGRKTITGSFVGSIKETEEMLEFCKEKGLSSMIEVVKMDYVNKALERLEKNDVRYR

SEQ ID NO: 15869 - protein, 242 aa, Schizosaccharomyces pombe
MSISCLSASAAKALDAELMSAGAFSIDQLMELAGLSVSQAVYREYPPSQYSQVLICCGPGNNGGDGLVAARHLWQYGYKPTVYYPKPSSPELYKRLCKQLDDLDIPVVKSHDSNHFSQLLRDSKLVVDSIFGFSFKGPVRDPFGSILAAIVESKIKVLSVDAPSSWEIDEGPQKEGPLKDFDPDTLISLTAPKPCSKFYKGKHYLGGRFVSKVITKKFNLSLPPYPGIDQVVDITNKPLSMV

SEQ ID NO: 15870 - protein, 425 aa, Thermotoga neapolitana
MKKFPEGFLWGVATASYQIEGSPLADGAGMSIWHTFSHTPGNVKNGDTGDVACDHYNRWKEDIEIIEKIGAKAYRFSISWPRILPEGTGKVNQKGLDFYNRIIDTLLEKNITPFITIYHWDLPFSLQLKGGWANRDIADWFAEYSRVLFENFGDRVKHWITLNEPWVVAIVGHLYGVHAPGMKDIYVAFHTVHNLLRAHAKSVKVFRETVKDGKIGIVFNNGYFEPASEREEDIRAARFMHQFNNYPLFLNPIYRGEYPDLVLEFAREYLPRNYEDDMEEIKQEIDFVGLNYYSGHMVKYDPNSPARVSFVERNLPKTAMGWEIVPEGIYWILKGVKEEYNPQEVYITENGAAFDDVVSEGGKVHDQNRIDYLRAHIEQVWRAIQDGVPLKGYFVWSLLDNFEWAEGYSKRFGIVYVDYNTQKRI

SEQ ID NO: 15871 - protein, 371 aa, Zea mays
MTVVDAVVSSTDAGAPAAAATAVPAGNGQTVCVTGAAGYIASWLVKLLLEKGYTVKGTVRNPDDPKNAHLKALDGAAERLILCKADLLDYDAICRAVQGCQGVFHTASPVTDDPEQMVEPAVRGTEYVINAAAEAGTVRRVVFTSSIGAVTMDPKRGPDVVVDESCWSDLEFCEKTRNWYCYGKAVAEHAAWETARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPTAEMQQGGIAIRA

SEQ ID NO: 15872 - protein, 277 aa, Klebsiella pneumoniae
MRNDRSFIELRARERAHALLDDGSYRELLNPFDGIMSPWLGAQGIVPQSDDGMVVAKGTINGQPAVVIAIEGTFQGGSMGEVSGAKMAAALELAAEDNRNGIPTQAVLCLETGGVRLQEANLGLAAIADIHAAIVDLRRYTPVVGIIAGTVGCFGGMSIAAALCSYLIVTREARLGLNGPQVIEQEAGIEEYDSRNRPFIWSMTGGEIRAASGLVDALVNDGVNAVKTAMNEAIAKGVPVQHRSDNYDDYLRRLSQFDTRQQADTAQIKQLFAREDK

SEQ ID NO: 15873 - protein, 475 aa, Chaetosphaeridium globosum
MSPQTETKTGAGFKAGVKDYRLTYYTPEYETKDTDILAAFRMTPQAGVPPEEAGAAVAAESSTGTWTTVWTDGLTSLDRYKGRCYDIEPVAGEDNQYIAYVAYPLDLFEEGSVTNLFTSIVGNVFGFKALRALRLEDLRIPPAYSKTFQGPPHGIQVERDKINKYGRPLLGCTIKPKLGLSAKNYGRAVYECLRGGLDFTKDDENVNSQPFMRWRDRFLFVAEAIFKSQAETGEIKGHYLNATAGTCEEMLKRAAYARELGVPIIMHDYLTGGFTANTSLSFYCRDNGLLLHIHRAMHAVIDRQKNHGIHFRVLAKALRMSGGDHIHSGTVVGKLEGEREVTLGFVDLLRDDYIEKDRSRGIYFTQDWVSMPGVLPVASGGIHVWHMPALTEIFGDDSVLQFGGGTLGHPWGNAPGAAANRVALEACVQARNEGRDLARHGNDVLREACKWSPELAAACEVWKEIKFEFETIDTL

SEQ ID NO: 15874 - protein, 169 aa, Chaetosphaeridium globosum
MPRSQRNDNFIDKTFTVVADILLRVIPTTRREKEAFSYYRDGMSAQSEGEYAEALQNYYEAMRLEIDPYDRSYILYNIGLIHTSNGQHTKALEYYLQALERNPALPQAFNNMAVICHYRGEQAIQQGDPENAEAWFDQAADYWKQGIALAPSNYIEAQNWLKITGRLKA

SEQ ID NO: 15875 - protein, 406 aa, Zea mays
NNAMRALFLLVLFCIVHGEKEESKGIDAKASGPGGSFDITKLGASGNGKTDSTKAVQEAWASACGGTGKQTILIPKGDFLVGQLNFTGPCKGDVTIQVDGNLLATTDLSQYKDHGNWIEILRVDNLVITGKGNLDGQGPAVWSKNSCTKKYDCKILPNSLVMDFVNNGEVSGVTLLNSKFFHMNMYRCKDMLIKDVTVTAPGDSPNTDGIHMGDSSGITITNTVIGVGDDCISIGPGTSKVNITGVTCGPGHGISIGSLGRYKDEKDVTDINVKDCTLKKTMFGVRIKAYEDAASVLTVSKIHYENIKMEDSANPIFIDMKYCPNKLCTANGASKVTVKDVTFKNITGTSSTPEAVSLLCTAKVPCTGVTMDDVNVEYSGTNNKTMAICTNAKGSTKGCLKELACF

SEQ ID NO: 15876 - protein, 491 aa, Escherichia coli
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPPLAGRAGC

SEQ ID NO: 15877 - protein, 460 aa, Vibrio cholerae
MKICPVVLSGGVGSRLWPLSREHFPKQCLILTDLLSSLLQQTLVRTIHLNVQSPLVVCNDDHRFLIAQQLQDMGVKGAKVMLEPVGRNTAPAVALAAFEVLQSDNEDVLMLVLPADHVIRDTAAFEKAIAQAKVLAEAGGLVTFGITPMRAETGYGYIKAGQDSCVEKFVEKPDLATAQSYLESGDYLWNSGMFLFQASQYLAELTQHRPAMYAAVESAYGNRTEDLDFIRIGTEAFTACPSESIDYAIMEPTQNAKVVPYNGDWSDIGAWDALHDYCEKDSNHIVLVGDVMAESTTNSLVRAESRLVATVGVNNLVVIETADAVLIMDKDQSQDVKKIVSRIKAEGRQEHMHHTTVHRPWGTYQTVDLGDRHQVKRIMVKPGEKLSVQMHHHRAEHWVVVSGTAKVQNGEREILLTENESTYIPVGVVHALENPGKIPLELIEVQSGSYLGEDDIVRFS

SEQ ID NO: 15878 - protein, 434 aa, Arabidopsis thaliana
MDHVSSLPDEVLYHILSFLTTKEAALTSILSKRWRNLFTFVPNLDIDDSVFLHPQEGKEDRYEIQKSFMKFVDRVLALQGNSPIKKLSLKLRTGFDSHRVDGWISNALARGVTELDLLIILNLVTLKLNSVRVDWLAAGDIFLPMLKTLVLHSVRLCVDNVNWGGKDVNVSNASLKILTVNYNICLGTFSVDTPSLVYFCFTEYVAIDYPVVIMQNLFEARISLLVTQDQIERARAPNIDWVEDDVVLRLVNMEKLIKGIRNVQYMYLSPNTLEVLSLCCESMPVFNNLKSLTLKSHKSRGWQAMPVLLRNCPHLETLVLEGILHHVTDKCGYACDCVSREEKGCSLTSCPVKVLEIKGFRGTIKEMHMIKHFVNYFPCLMETNIYIEESGPPKLRVPQVCEFIAEMMEHYGKSSSFNVQLLVGGYLYKKWTAQ

SEQ ID NO: 15879 - protein, 490 aa, Arabidopsis thaliana
MATETEVVAPVTVSNGGSKGCCKYGGPGYATPLAAMSGPSEKLIYVTAVYTGTGIDKPDYLATVDVDPSSPSYSSVIHRLPMPFVGDELHHSGWNSCSSCHGDASVDRRYLVLPSLISGRIYAIDTKENPRAPSLYKYVDPKEIADKTGLAFPHTAHCLATGEILVSCLGDEEGNAKGNGFLLLDSDFNIKNRWEKPGHSPLYGYDFWYQPRHKTMISTSWGAPKAFSKGFNLQHVADGLYGSHLHVYSWPGGEIKQLIDLGPTGLLPLEIRFLHDPSKDTGFVGSALSSNMIRFFKNSDETWSHEVVISVKPLKVENWILPEMPGLITDFLISLDDRFIYFVNWLHGDIRQYNIEDPKNPVLTGQIWVGGLLQKGSPVKAVGEDGNTFQFEVPQIKGKSLRGGPQMIQLSLDGKRLYATNSLFSAWDRQFYPEIMEKGSHIIQIDVDTEKGGLTINPDFFVDFGDEPDGPSLAHEMRYPGGDCTSDIWI

SEQ ID NO: 15880 - protein, 1047 aa, Arabidopsis thaliana
MAFRRPLIVIVIFIYITAGVKIAAADEPVPTPWPHQFHALMFMNYSGDLSMIDLWYDWTNGRNFNIIQEQLGGITYDLEWNNGTSFFYTLDESKSCRSGQLEDSHCVRFEFFILSRKLKYLRRVGEFSVLLKSGRVYILIVTNTLCALHLMGRLKLPNHSGREAHIMTYEVGAVLEDEKWQAPVYCFNKEKKSLSTKGALSEFKGYKEKAALRSTRVNKRDLLLCLFSLFEQVLNLHKTATNHHAFRLVFRKLKKMDLSGCRDIISSLPEAISCHILSFLPTKEAASTSVLSKKWRYLFAFVPNLDLDESVYLNPENETEVSSSFMDFVDRVLALQGNSPLHKFSLKIGDGVEPDRIIPWINNVLERGVSDLDLHVYMETEFVFPSEMFLSKTLVRLKLMLYPLLEFEDVYLPKLKTLYIDSCYFEKYGIGLTKLLSGCPILEDLVLDDIPWCTWDFASVSVPTLKRLTFSTQVRDEFPKSVSIDTPNLVYLKFTDTVAGKYPKGHQGYGENDMVGNATDFIMRICNVKTLYLSSNTLQVLTYSCDAIPIFNNLTHLTIESNPEVGWQSLPGLLKNSPNLETLIFQGLIHKATDKCGDVCLCKPREEIRSCLASSPVKVIKILKFGEISDDMEKQREQIKYFLETMPNLEKMILYYNTTSVEDVTEVSSRLQRLVSKLASSTLLKRMDLSGSRDVISSLPDDISSHILSFLPTKEAASTSVLSKKWRYLFAFVPNLDLDDSVYLNPENETEISTSFMDFVDRVLALQVRIIPWINNVLERGVSDLDLHLNLESEFLLPSQVYLCKTLVWLKLRFGLYPTIDVEDVHLPKLKTLYIEATHFEEHGVGLTKLLSGCPMLEDLVLDDISWFIWDFASVSVPTLKRLRFSWQERDEFPKSVLLDTPNLVYLKFTDTVAGKYPKPLLINYHQGYGENDMVGNATDFIMRICNVKTLYLSANTLQVLTYSCDAIPIFNNLTHLTIESNPRVGWQSVPGLLKNSPNLETLIFQVRNKPLKSILASSTKPHIDVEMCACAKSLGRRFSVANHQVR

SEQ ID NO: 15881 - protein, 505 aa, Arabidopsis thaliana
MAVADLRGGRGRRQRTNISIGLVLIFAKLHFLFYLNLFRWLGFIRFLTICEKYGRMRRRRRAEYNPEHDLLEQEFLLKGRWYQRKDLEVKNIRGDILQCSHYMPVERPEDRPLPCVIYCHGNSGCRADASEAAIVLLPSNITIFTLDFSGSGLSGGEHVTLGWNEKDDLKAVVEYLRTDGNVSLIGLWGRSMGAVTSLMYGAEDPSIAAMVLDSPFSDLVDLMMELVDTYKFRLPKFTVSKSKFVVSVSCGICSSYYKIKFAIQYMRRAVQKKANFNITDLNTIKVVSSVAKSCFVPVLFGHAVDDDFIQPHHSERIYEAYIGDKNIIKFDGDHNSPRPQFYFDSINIFFHNVLQPPEVVGPTFFDPVDDYFAKVMNLAGSWSTMQQLSSPPSSAQKSLAPGSTSDAINEVRLKRPMSRTEVPSNDPSNQSSSETKEKESLEVSSSSSSDMISFDLSNGDPYPPHLAVALDDDQYVEFHVDELADFPSNAEEEERVRVKKVDFAL

SEQ ID NO: 15882 - protein, 487 aa, Arabidopsis thaliana
MVSLFLVKIFHWVYQWRNPKTNGKLPPGSMGFPFIGETFEFFKPHDALQFSTFIKDRVLRFFADFSSIHLSFFRTSLFGDKAIISMDMELNLEMAKANSVPGVTKSVIRLFGENNLFLQSKESHKHVRNLTFQLLGPQGLKSRMIEDVDLLARTYMEEGARNGYLDVKETSSKILIGCLAKKVMGEMEPEAAKELALCWRYFQSGWFRFFLNLPGTGVYKMMKVLFVQYTEADISWQARKRMMKLLRKTVLTKRASGEELGEFFNIIFGEMEGEGETMSVENAVEYIYTFFLVANETTPRILAATVKFISDHPKVKQELQREHEEIVRGKAEKEGGLTWEDYKSMHFTQMVINESLRIISTAPTVLRVLEHDFQVGDYTIPAGWTFMGYPHIHFNSEKYEDPYAFNPWRWEGKDLGAIVSKTFIPFGAGRRLCVGAEFAKMQMAVFIHHLFRYRWSMKSGTTIIRSFMLMFPGGCDVQISEDTEVDK

SEQ ID NO: 15883 - protein, 298 aa, Arabidopsis thaliana
MAEASFYIGVIGNVISVLVFLSPVLLIDRSILIYQTKIIRETFWKIVKRRSTEEYKSLPYICTLLGSSLWTYYGIVTPGEYLVSTVNGFGALVETIYVSLFLFYAPRHLKLKTVDVDAMLNVFFPIAAIVATRSAFEDEKMRSQSIGFISAGLNIIMYGSPLSAMLLYCTTTWYGRSISWIKTYIRNISFSIIRNKINRIRFEFITISVIIYRLIIVSNFLIQYAENSSDNKEREIHAVLVVVFPLLKRRDLGCLCFTPTRRFLTRKNAKPVGLSNGLSEIAQDEEEGLTSRVEPLLS

SEQ ID NO: 15884 - protein, 359 aa, Hordeum vulgare subsp. vulgare
MIEGAGSIVDAHTVEVTQPDGSKQRHTTKHILIATGSRATLVNIPGKELAITSDEALSLEELPKRAVILGGGYIAVEFASIWKGLGAQVDLFYRKELPLRGFDDEMRTVVASNLEGRGIRLHPGTNLTELSKTADGIKVVTDKGDEFIADVVLFATGRAPNSNRLNLEAVGVEVDQIGAIKVDEYSRTSVPNIWAVGDVTNRINLTPVALMEATCFAKTVFGGQTVKPDYKDVPCAVFCIPPLSVVGLSEQEALAEAKNDLLVYTSSFNPMKNSISKRQEKSIMKLVVDAETDKVLGAAMCGPDAAEIMQGIAVALKAGATKATFDSTVGIHPSAAEEFVTMRTLTRRVSPASKPKTNL

SEQ ID NO: 15885 - protein, 370 aa, Aspergillus kawachii
MPSAKPLFCLATLAGAALAAPAPSRATDFNKRSTCTFTDAATASESKTSCSDIVLKDITVPAGETLNLKDLNDGTTVTFEGTTTWEYEEWDGPLLRISGKDITVTQSSDAVLNGNGAKWWDGEGTNGGKTKPKFFYAHDLDDSKISGLYIKNTPVQAISVESDNLVIEDVTIDNSDGDSEGGHNTDGFDISESTYITITGATVKNQDDCVAINSGENIYFSGGTCSGGHGLSIGSVGGRDDNTVKNVTFIDSTVSDSENGVRIKTVYDATGTVEDITYSNIQLSGISDYGIVIEQDYENGDPTGTPSNGVTISDVTLEDITGSVDSDAVEIYILCGDGSCTDWTMSGIDITGGETSSDCENVPSGASCSQ

SEQ ID NO: 15886 - protein, 362 aa, Aspergillus kawachii
MHSFASLLAYGLAAGATLASASPIEARDSCTFTTAAAAKAGKAKCSTITLDSIKVPAGTTLDLTGLTSGTKVIFEGTTTFDYEEWAGPLISMSGKDITVTGASGHLINCDGSRWWDGKGTSGKKKPTFFYAHGLDSSSITGLNIKNTPLMAFSVESDDITLTDITINNADGDSLGGHNTDAFDVGNSVGVNIIKPWVHNQDDCLAINSGENIWFTGGTCIGGHGLSIGSVGDRSNNVVKNVTIEHSTVSNSENAVRIKTISGATGSVSEITYSNIVMSGISDYGVVIQQDYEDGKPTGKPTNGVTITDVKLESVTGTVDSKATDIYLLCGSGSCSDWTWDDVKVTGGKKSSACKNYPSVASC

SEQ ID NO: 15887 - protein, 1024 aa, Arabidopsis thaliana
MQKEDNVERVTLLKQEVSKMLNETEGLLEQLELIDTLQRLGVSYHFEQEIKKTLTNVHVKNVRAHKNRIDRNRWGDLYATALEFRLLRQHDVFDGNIGVDLDDKDIKGILSLYEASYLSTRIDTKLKESIYYTTKRLRKFVEVNKNETKSYTLRRMVIHALEMPYHRRVGRLEARWYIEVYGERHDMNPILLELAKLDFNFVQAIHQDELKSLSSWWSKTGLTKHLDFVRDRITEGYFSSVGVMYEPEFAYHRQMLTKVFMLITTIDDIYDIYGTLEELQLFTTIVEKWDVNRLEELPNYMKLCFLCLVNEINQIGYFVLRDKGFNVIPYLKESWADMCTTFLKEAKWYKSGYKPNFEEYMQNGWISSSVPTILLHLFCLLSDQTLDILGSYNHSVVRSSATILRLANDLATSSVSHGFTTYNTEELARGDTMKSVQCHMHETGASEAESRAYIQGIIGVAWDDLNMEKKSCRLHQGFLEAAANLGRVAQCVYQYGDGHGCPDKAKTVNHVRRQRIKWRNAFLLGSIMTTIVVLLHTPTFSVFSDEEETESSSSSPIYLNGSLHLNIHIVSSEAKVENFHTLRTRTPIVQLNASEASEAVLSRKRRKRKKRKKTKDDLILTDPPPAPRHVLSSSERRALSLPPKKALTYAKLEIQRAPEVINDTDLFAPLFRNLSVFKRSYELMELILKVYIYPDGDKPIFHEPHLNGIYASEGWFMKLMESNKQFVTKNPERAHLFYMPYSVKQLQKKTTSTCSPSNTPSGTALMGQIISLSLATIGYRKCFYVKDQWGPYTVNEHPELKRNAIKALCNADLSDGIFVPGKDVSLPETSIRNAGRPLRNIGNGNRVSQRPILAFFAGNLHGRVRPKLLKHWRNKDEDMKIYGPLPHNVARKMTYVQHMKSSKYCLCPMGYEVNSPRIVEAIYYECVPVVIADNFMLPFSDVLDWSAFSVVVPEKEIPRLKEILLEIPMRRYLKMQSNVKMVQRHFLWSPKPRKYDVFHMILHSIWFNLLNQNQTSFDDHIPDS

SEQ ID NO: 15888 - protein, 371 aa, Arabidopsis thaliana
MEKEKKNIRGREFLQKSAPELTTRKTTLSFNLPTPRSLPSPTSIKDLYTDREQNQNQNLRVFSFKELSDATCEFSRKLKIGEGGFGSVYKATINNPTVGDSHSSPLTVAVKKLNRQSLQGHKQWLAEVHFLGVVNHPNVVRLLGYCSEDRERLLVYELMSNRSLEDHLFTLRTLTLSWKQRLEIMLGAAQGLAYLHEIQVIYRDFKSSNVLLNEEFHPKLSDFGLAREGPEGDNTHVTTARVGTDGYAAPEYVITGHLKTHCDVYSFGVVLYEIITGRRTLERMKPLAEQKLLEWVKKYPINSKRFKMIVDSKLCNKYPIAMVRRVAKLADHCVNKIDKERPTMAFVVESLTNIIEESNSEDMGSSVGIRG

SEQ ID NO: 15889 - protein, 345 aa, Brassica juncea
ILQTIKGLTSFSFLRSNQRGTNMEDGCMIKKDVTELIGYTPMVYLNRIVDGCVARIAAKLEMMQPCSSVKDRIAYSMIKDAEDKGLIKPGESTLIEPTAGNTGIGLACIGAARGYKVTLLMPSTMSLERRIILKALGAELHLTDMSIGIKGLLEKTEEMLNKTPGGFVPQQFENLANPEIHYQTTGPEIWRDSAGKVDIFIAGVGTGGTVTGVGRFLKEMNKDIKVIAVEPTESPVLSGGEPGRHLIQGIGAGIIPANLDLSIVDEIIQVTGEEAIETAKLLALKEGLLVGISSGAAAAAALKVAKRPENAGKLIAVLFPSGGERYLSTKLFDSVRFEAENLPVE

SEQ ID NO: 15890 - protein, 198 aa, Arabidopsis thaliana
MAPPRIPSSVHYGGSRLGCSTRFFSIRCGANRSGSTYSPLNSGSNFSDRPPTEMAPLFPGCDYEHWLIVMDKPGGEGATKQQMIDCYIQTLAKVVGSEEEAKKRIYNVSCERYLGFGCEIDEETSTKLEGLPGVLFVLPDSYVDPENKDYGAELFVNGEIVQRSPERQRRVEPQPQRAQDRPRYNDRTRYSRRRENTR

SEQ ID NO: 15891 - protein, 421 aa, Arabidopsis thaliana
MSHSWDGLGEIASVAQLTGLDAVKLIGLIVKAANTAWMHKKNCRQFAQHLKLIGNLLEQLKISEMKKYPETREPLEGLEDALRRSYLLVNSCRDRSYLYLLAMGWNIVYQFRKHQDEIDRFLKIIPLITLVDNARIRERFEYIDRDQREYTLDEEDRHVQDVILKQESTREAASVLKKTLSCSYPNLRFCEALKTENEKLQIELQRSQEHYDVAQCEVIQRLIGVTQAAAAVEPDSEKELTKKASKKSERSSSMKTEYSYDEDSPKKSSTRAASRSTSNVSSGHDLLSRRASQAQHHEEWHTDLLACCSEPSLCFKTFFFPCGTLAKIATAASNRHISSAEACNELMAYSLILSCCCYTCCVRRKLRKTLNITGGFIDDFLSHVMCCCCALVQELREVEIRGAYGTEKTKISPPSSQFMEH

SEQ ID NO: 15892 - protein, 351 aa, Bromheadia finlaysoniana
MENEKKGPVVVTGASGYVGSWLVMKLLQKGYDVRATIRDPTNLEKVKPLLDLPRSNELLSIWKADLNDIEGSFDEVIRGCVGVFHVATPMNFQSKDPENEVIKPAINGLLGILTSCKKAGSVKRVIFTSSAGTVNVEEHQAAVYDENSWSDLHFVTRVKMTGWMYFVSKTLAEKAAWEFVKENAIHFIAIIPTLVVGSFITNEMPPSLITALSLISGNEAHYSILKQAQFVHLDDLCDAHIFVYEHPEANGRYICSSHDSTIYDLANMLKNRYATYAIPQKFKEIDPNIKSVSFSSKKLMDLGFKYKYTIEEMFDDAIKTCRDKNLMPLNTEELVLAAEKYDEVKEQIAVK

SEQ ID NO: 15893 - protein, 331 aa, Saccharomyces cerevisiae
MRSIKCVIIGDGAVGKTSLLISYTTNSFPTDYVPTVFDNYSTTIAIPNGTASSPLELDNGNDKRGSLSSASSSPSTDRKLYKINLWDTAGQEDYDRLRPLCYPQTDIFLICFSVSEHASFANVTEKWLPELKQTSNIEGTSLYTKLGKYPILLVGTKSDLRDDPATQKKLQEANSDYVSQEEIDELVQRCGFMGYTECSAATQAGVREVFEQAVRYAIYEPESPNQKSANHTLTDELTTATTNTNGDKNIREQKQQPHHNNSTDSTLPKGSLQQEKEALNIKPTKKGQKDKIHEQSKSKGSKIASNNHHNKQAKPKTRNDKKKKKSKCVIL

SEQ ID NO: 15894 - protein, 338 aa, Streptococcus agalactiae 2603V/R
MKAVVVNQASTGVEVVEHDLPKVGHGEALVKVEYCGVCHTDLHVAHGDFGQVPGRILGHEGIGIVEEIGEGVTSLRVGDRVSIAWFFEGCGHCEYCTTGRETLCRSVKNAGYSVDGGMSEYAIVTADYAVKVPEGLDPAQASSITCAGVTTYKAIKEAGAAPGQWIAVYGAGGLGNLAVQYAKKVFNAHVVAVDINADKLQLAKEVGADLTVNGKEIKDVAAYIQEKTGGCHGVVVTAVSKVAFNQAIDSVRAGGTVVAVGLPSEYMELSIVKTVLDGIRVVGSLVGTRKDLEEAFAFGAEGLVVPVVEKVPVDTAPQVFDEMERGLIQGRKVLDFTK

SEQ ID NO: 15895 - protein, 379 aa, Streptococcus agalactiae 2603V/R
MNNTEFYDRLGVSKDASQDEIKKAYRRMSKKYHPDINKETGAEEKYKEVQEAYETLSDTQKRAAYDQYGAAGANGGFGGFDGGGFGGFDGGGFGGFEDIFSSFFGGGGMRNPNAPRQGDDLQYRVNLSFEEAIFGAEKEVSYNRESSCHTCSGSGAKPGTSPVTCQKCHGSGVINVDTQTPLGTMRRQVTCDVCQGSGQEIKEKCPTCHGTGHEKKTHKVSVKIPAGVETGQQIRLTGQGEAGFNGGPYGDLFVIINVLPSQQFERNGSTIYYTLNISFVQAALGDTIDIPTVHGAVEMSIPAGTQTGKTFRLRGKGAPKLRGGGQGDQHVTVNIVTPTKLNDAQKEALHAFAEASGDKMVHPKKKGFFDKVKDALDVD

SEQ ID NO: 15896 - protein, 439 aa, Streptococcus agalactiae 2603V/R
MKKYDVIVLGFGKAGKTLAAKLATQGKSVAMVEEDDKMYGGTCINIGCIPTKTLLVSASKNHDFQEAMTTRNEVTSRLRAKNFAMLDNKDTVDVYNAKARFISNKVVELTGGADKQELTADVIIINTGAKSVQLPIPGLADSQHVYDSTAIQELAHLPKRLGIIGGGNIGLEFATLYSELGSKVTVIDSQSRIFAREEEELSEMAQDYLEEMGISFKLSADIKSVQNEDEDVVISFEDEKLSFDAVLYATGRKPNTEGLALENTDIKLTERGAIAVDEYCQTSVENIFAVGDVNGGPQFTYISLDDSRIVLNYLNCDKDYSLKNRGAVPTSTFTNPPLATVGLDEKTAKEKGYQVKSNSLLVSAMPRAHVNNDLRGIFKVVVDTETNLILGARLFGAESHELINIITMAMDNKIPYTYFQKQIFTHPTMVENFNDLFNF

SEQ ID NO: 15897 - protein, 223 aa, Streptococcus agalactiae 2603V/R
MIKILVVEDNIVQQKIITTKLTQEGYQFITASNGQEALNCLDTEEVQLIITDIMMPMMDGYQLIQELRSAAYNVPIIVMTAKSQMEDMTKGFGLGADDYMVKPVQLQELALRIKALLRRANIVAQHQLIIGNTCLNEDELSLKYFEQEIIFPQKEFRVLFHLLSYPNRIFTRLELLDSIWGMDTDLDERVVDACINKIRRKVEHLPDFKIETVRGVGYRAKND

SEQ ID NO: 15898 - protein, 445 aa, Streptococcus agalactiae 2603V/R
MTEKYVNKVIVILGASFAGMTCAQKLRQLNPNWDIVLIDKEIHPDYVPNGLNWYYRHEISGLNQAMWQTEEEQRLQNIRCLFGLKVEKINKEDRELMLSDGSSVYYDQLICAMGSQAESTYIDGADAQGVLTTKTYATSQNAKQVLDKSHKVAVVGAGIIGLDIAYSLHESGKAVTLLEAQERPDFRHTDPDMSLPLLDAMAESKLHFFQNQKVEKITVTREEKLCLRTLTGDTFTVDAVILAVNFRPDSRLLTGLVDLSVDNSVVVNDYFQTSDPNIYAIGDLIWSYFKGLNSAYYMPLINQAIRSAQMLAYHLSGHAVPKLKITRATGSKHFGYYRANIGLTELEAGFYEDTVSVTYFPKEQYDLRIKLIANQKTGHLLGAQLISKENCLATANQLVQAISCDMTDFDLAFQDFIYTARESEMAYMLHQAAINLYEKRIGLCE

SEQ ID NO: 15899 - protein, 244 aa, Streptococcus agalactiae 2603V/R
MVEPIISIQGLHKSFGKNEVLKGIDLDIHQGEVVVIIGPSGSGKSTFLRTMNLLEVPTKGTVTFEGIDITDKKNDIFKMREKMGMVFQQFNLFPNMTVLENITLSPIKTKGLSNLDAQTKAYELLEKVGLKEKANTYPASLSGGQQQRIAIARGLAMNPDVLLFDEPTSALDPEMVGEVLTVMQDLAKSGMTMVIVTHEMGFAREVADRVIFMDAGIIVEQGAPKEVFEQTKEIRTRDFLSKVL

SEQ ID NO: 15900 - protein, 278 aa, Streptococcus agalactiae 2603V/R
MIVGEQEARALIKPRPKSSHKGDYGSVLLIGGFYPYGGAIIMAALACVKTGAGLVTVATQSCNIPSLHSQLPEVMAFDSDDYKWLEKSIVQSDVIVIGPGLGVSESSRKILNQTMEKIQSHQSVILDGSALTLLSEGAFPQTKAKNLVLTPHQKEWERLSGIAVSQQTKENTQTALKSFPKGTILVAKSSHTRIFQDLDEKEIIVGGPYQATGGMGDTLCGMIAGMLAQFKEASPLDKVSVGVYLHSAIAQGLSKEAYVVLPTTISDEIPKEMARLSK

SEQ ID NO: 15901 - protein, 330 aa, Streptococcus agalactiae 2603V/R
MKLKVFNVREEEATLAQDWANRNHVELSMSEGPLTLETVNEVEGFDGIANAQIEPLDDAIYPLLKEMGIKQIAQRSAGVDMYNLELAKQHGIIISNVPSYSPESIAEFTVTIALNLIRKVELIRANVREQNFSWTLPIRGRVLGNMTVAIIGTGRIGLATAKIFKGFGCRVIGYDIYHNPMADGILEYVNSVEEAVEEADLVSLHMPPTAENTHLFNLDMFKQFKKGAILMNMARGALVETKDLLEALDQGLLEGAGIDTYEFEGPYIPKNCQGQDISDKDFLRLINHPKVIYTPHAAYYTDEAVKNLVEGALNACVEVIETGTTTTKVN

SEQ ID NO: 15902 - protein, 251 aa, Streptococcus agalactiae 2603V/R
MSLISYKNVNKYYGDYHALRQINLEIEPGQVVVLLGPSGSGKSTLIRTMNALESIDDGSLVVNGHELANISSKELVNLRKEVGMVFQHFNLYPHKTVLENITLAPIKVLKQSKKEAMEIAEKYLKFVNMWERKDSYPSMLSGGQKQRIAIARGLAMHPKLLLFDEPTSALDPETIGDVLSVMQKLANDGMNMVVVTHEMGFAREVADRIIFMADGEILVDTTDVQDFFDNPREPRAKQFLSNIINHTSTDL

SEQ ID NO: 15903 - protein, 475 aa, Streptococcus agalactiae 2603V/R
MTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGKRIGKLAGMRPIMLELGGKDAGVVLADADLDNAAKQIVAGAYDYSGQRCTAIKRVLVVEEVADELAEKISENVAKLSVGDPFDNATVTPVIDDNSADFIESLVVDARQKGAKELNEFKRDGRLLTPGLFDHVTLDMKLAWEEPFGPILPIIRVKDAEEAVAIANKSDFGLQSSVFTRDFQKAFDIANKLEVGTVHINNKTGRGPDNFPFLGLKGSGAGVQGIRYSIEAMTNVKSIVFDMK

SEQ ID NO: 15904 - protein, 500 aa, Streptococcus agalactiae 2603V/R
MNKRVKIVATLGPAVEFRGGKKFGESGYWGESLDVEASAEKIAQLIKEGANVFRFNFSHGDHAEQGARMATVRKAEEIAGQKVGFLLDTKGPEIRTELFEDGADFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGNGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGFVESGDNIVIVAGVPVGTGGTNTMRVRTVK

SEQ ID NO: 15905 - protein, 399 aa, Streptococcus agalactiae 2603V/R
MNNVQGNLFRPLTLPNGLSLENRFVLSPMVTNSSTSEGFVTDDDIAYAVRRAKSAPLQITGAAYITEYGQLFEYGFSVSKDEDIPGLTKLAKAMKSKGAKAVLQLTHAGRFSSHTLARHGYVYGPSPMQLQSPYPHQVKELTHKDILRIIDEYVQATRRAIQAGFDGVEISSAQRLLIQTFFSTFSNQRKDEYGPQTLTNRCRLGLEVFKAVQKVIREEAESDFILGFRATPEETRGSQIGYSIEEFMEFLEKILAIAQVDYLAIASWGHDVFRNTIRSEGVYKGQLVNQVIFEHFGDRVPIMATGGINSASKVFEALQHAHMIGASTPLVVDPEFLQKIKAKCSDQINLRIKVSDLEGLAIPKASFKDIVPLMDYGESLPKEAREVFRELRSNYREER

SEQ ID NO: 15906 - protein, 327 aa, Streptococcus agalactiae 2603V/R
MFNDIPVFDYEDIQLIPNKCIISSRSQADTSVKLGNYTFKLPVIPANMQTIIDEEVAETLACEGYFYIMHRFNEEERKPFIKRMHDKGLIASISVGVKDYEYDFVTSLKEDAPEFITIDIAHGHSNSVIEMIQHIKQELPETFVIAGNVGTPEAVRELENAGADATKVGIGPGKVCITKVKTGFGTGGWQLAALRWCSKAARKPIIADGGIRTHGDIAKSIRFGASMVMIGSLFAGHLESPGKLVEVEGQQFKEYYGSASEYQKGEHKNVEGKKILLPVKGRLEDTLTEMQQDLQSSISYAGGKELDSLRHVDYVIVKNSIWNGDSI

SEQ ID NO: 15907 - protein, 478 aa, Streptococcus agalactiae 2603V/R
MVKQVFPKGFLWGGATAANQCEGAYNVDGRGLANVDVVPTGEDRFAIISGQKKMFDFEEGYFYPAKESIDFYHHYKEDLALLAEMGFKTYRMSIAWTRIFPKGDELYPNEAGLQFYENIFKECRKYGIEPLVTITHFDCPIYLIKHYGGWRSRKMIGFYERLVRALFTRFKGLVKYWLTFNEINMILHAPFMGAGLYFEDGENQEQIKYQAAHHELVASAIAVKIAHEVDPNNQIGCMLAAGQYYPNTCHPQDYWASMQKNRENYFFIDVQARGKYPNYAKKHFEHLGISIQMTAEDLALLRDYTVDFISFSYYSSRVASGNPTVSEQVQENIFASLKNPYLKSSEWGWQIDPLGLRITLNAIWDRYQKPMFIVENGLGAVDIPDENGYVEDDYRIDYLRQHIAAMRDAIYVDGVNLIGYTTWGCIDLVSAGTGEMEKRYGFIYVDRNNKGEGTLKRYKKKSFYWYKKVIASNGSQIE

SEQ ID NO: 15908 - protein, 1252 aa, Streptococcus agalactiae 2603V/R
MKRKDLFGDKQTQYTIRKLSVGVASVATGVCIFLHSPQVFAEEVSASPANTAIAESNINQVDNQQSTNLKDDINSNSETVVTPSDMPDTKQLVSDETDTQKGVTEPDKATSLLEENKGPVSDKNTLDLKVAPSTLQNTPDKTSQAIGAPSPTLKVANQAPRIENGYFRLHLKELPQGHPVESTGLWIWGDVDQPSSNWPNGAIPMTDAKKDDYGYYVDFKLSEKQRKQISFLINNKAGTNLSGDHHIPLLRPEMNQVWIDEKYGTHTYQPLKEGYVRINYLSSSSNYDHLSAWLFKDVATPSTTWPDGSNFVNQGLYGRYIDVSLKTNAKEIGFLILDESKTGDAVKVQPNDYVFRDLANHNQIFVKDKDPKVYNNPYYIDQVQLKDAQQIDLTSIQASFTTLDGVDKTEILKELKVTDKNQNAIQISDITLDTSKSLLIIKGDFNPKQGHFNISYNGNNVMTRQSWEFKDQLYAYSGNLGAVLNQDGSKVEASLWSPSADSVTMIIYDKDNQNRVVATTPLMKNNKGVWQTILDTKLGIKNYTGYYYLYEIKRGKDKVKILDPYAKSLAEWDSNTVNDDIKTAKAAFVNPSQLGPQNLSFAKIANFKGRQDAVIYEAHVRDFTSDRSLDGKLKNQFGTFAAFSEKLDYLQKLGVTHIQLLPVLSYFYVNEMDKSRSTAYTSSDNNYNWGYDPQSYFALSGMYSEKPKDPSARIAELKQLIHDIHKRGMGVILDVVYNHTAKTYLFEDIEPNYYHFMNEDGSPRESFGGGRLGTTHAMSRRVLVDSIKYLTSEFKVDGFRFDMMGDHDAAAIELAYKEAKAINPNMIMIGEGWRTFQGDQGQPVKPADQDWMKSTDTVGVFSDDIRNSLKSGFPNEGTPAFITGGPQSLQGIFKNIKAQPGNFEADSPGDVVQYIAAHDNLTLHDVIAKSINKDPKVAEEEIHRRLRLGNVMILTSQGTAFIHSGQEYGRTKRLLNPDYMTKVSDDKLPNKATLIEAVKEYPYFIHDSYDSSDAINHFDWAAATDNNKHPISTKTQAYTAGLITLRRSTDAFRKLSKAEIDREVSLITEVGQGDIKEKDLVIAYQTIDSKGDIYAVFVNADSKARNVLLGEKYKHLLKGQVIVDADQAGIKPISTPRGVHFEKDSLLIDPLTAIVIKVGKVAPSPKEELQADYPKTQSFKESKTVEKVNRIANKTSITPVVSKKADSYLTNEANLPKTGDKSSKILSVVGISILASLLALVGLSLKRNRHLK

SEQ ID NO: 15909 - protein, 446 aa, Streptococcus agalactiae 2603V/R
MYQTQTNKEKFVLFLKLFIPVLIYQFANFSATFIDSVMTGQYSQLHLAGVSTASNLWTPFFALLVGMISALVPVVGQHLGRGNKEQIRTEFHQFLYLGLILSLILFLIMQFIAQPVLGSLGLEDEVLAVGRGYLNYMLIGIMPLVLFSICRSFFDALGLTRLSMYLMLLILPFNSFFNYMLIYGKFGMPRLGGAGAGLGTSLTYWAIFIVIIIVMSLHPQIKTYHIWTLERIKAPLIIEDIRLGLPIGLQIFAEVAIFAVVGLFMAKFSSIIIAAHQAAMNFSSLMYAFPLSISTALAITISFEVGAERFQDANTYSRIGRLTAVGITSGTLLFLFLFRENVAAMYNSDPHFVAITAQFLTYSLFFQFADAYAAPVQGILRGYKDTTKPFMIGAGSYWLCALPLAVILEKNSQLGPFAYWIGLITGIFVCGLFLNQRLQKIKKLYY

SEQ ID NO: 15910 - protein, 458 aa, Streptococcus agalactiae 2603V/R
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPNVPAWAFASFFALVIFGLNALSVRFFAEAESFFSSIKVIAIIIFIILGLGAMFGLVSFEGQHKAILFTHLTANGAFPNGIVAVVSVMLAVNYAFSGTELIGIAAGETDNPKEAVPRAIKTTIGRLVVFFVLTIVVLASLLPMKEAGVSTAPFVDVFDKMGIPFTADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENQLEDLSYKTPFTPVLPYITIILLLISIVGIAWDSSQRAGLYFGVPFIIFCYIYHKLRYKKW

SEQ ID NO: 15911 - protein, 449 aa, Streptococcus agalactiae 2603V/R
MSKQYDYIVIGGGSAGSGTANRAAMYGAKVLLIEGGQVGGTCVNLGCVPKKIMWYGAQVSETLHKYSSGYGFEVNNLNFDFTTLKANRDAYVQRSRQSYAANFERNGVEKIDGFARFIDNHTIEVNGQQYKAPHITIATGGHPLYPDIIGSELGETSDDFFGWETLPDSILIVGAGYIAAELAGVVNELGVETHLAFRKDHILRGFDDMVTSEVMAEMEKSGISLHANHVPKSLKRDEGGKLIFEAENGKTLVVDRVIWAIGRGPNVDMGLENTDIVLNDKGYIKADEFENTSVDGVYAIGDVNGKIALTPVAIAAGRRLSERLFNHKDNEKLDYHNVPSVIFTHPVIGTVGLSEAAAIEQFGEDNIKVYTSTFTSMYTAVTTNRQAVKMKLITLGKEEKVIGLHGVGYGIDEMIQGFSVAIKMGATKADFDDTVAIHPTGSEEFVTMR

SEQ ID NO: 15912 - protein, 347 aa, Streptococcus agalactiae 2603V/R
MFVKKGLFVFLLLCILSMWLMIFGVAFYYFGSLHQSLTSRIIYQFVLTVLLTTTAWFMGAYFLAFEGHFKTVFQFQEADGKQIVNCLFQLCFALYAVVMLIGSIIDRVQTKRLLLAVVSWLFLVYTPLAYLIWNSEGVFAKMGVLDFSGGMIVHLSAGLSSYILAHVIGKSEHQHNKVKNDSLFLGMILITFGWFGFNMGPVGEWNSQAIMILLNTIFAIIGGGLAWTLAAKWNGEEEKTGSLLNGIIVGLVTSTAGVGYLLTWQLLAVTFFASLFTYFVTDYVAKAFAIDDVVSSFGMNGIGGLLGSLGVGLFKLSHMPVQLLALATTILLSIIMTYIISKAIFRK

SEQ ID NO: 15913 - protein, 462 aa, Streptococcus agalactiae 2603V/R
MSKNNNDHTQKSENGMVRGLENRHVQLIAIAGTIGTGLFLGAGRSISLTGPSIVLVYAITGAFMFFMMRAIGEMLYQDPNQHTFINFITKYLGPGWGFFSTLSYWISLIFIGMAEITAVGEYVQFWFPEWPSWIIQIVFLAILSSINLIAVKAFGETEFWFAMIKVIAILGLIATGIFMVLTNFDTGHGYHASISNITNHFEWFPKGKLNFFMAFQMVFFAYLAIEFVGVTTSETANPRKVLPKAIQEIPMRIILFYAGSLLAIMAIFPWQQLPVNESPFVTVFKLAGIKWAAALINFVVLTSAASALNSTLYSTGRHLFQLANESPNALTKALKLDQLSRQSVPSRAIIASAVIVGASALISVLPGISDAFSLITASSSGVYISIYVLIMIAHWKYRKSPDFMEDGYKMPAYKILSPITLLFFLFVFVSLFLQDSTYIGAIGATIWIIGFGLYSHFKHKSH

SEQ ID NO: 15914 - protein, 393 aa, Streptococcus agalactiae 2603V/R
MVFSVKTFNNINQIGLQELGNRFQIDGDMSENPDAYIIRSQNLHNQDFPSNLKAIARAGAGTNNIPIEEASAQGIVVFNTPGANANAVKEAVIAALLLSARDYLGANRWVNTLTGTDIPKQIEAGKKAFAGNEIAGKKLGVIGLGAIGARIANDARRLGMTVLGYDPYVSIETAWNISSHVQRVKEIKDIFETCDYITIHVPLTNETKHTFDAKAFSIMKKGTTIINFARAELVNNQELFEAIETGVVKRYITDFGDKELLNQKGITVFPHVGGSTDEAELNCAIMASQTIRCFMETGEITNSVNFPNVHQIQTAPFRITLINKNVPNIVAKISTAVSELGINIDNIINRSKGDYAYTLIDLDETDNNKISTLIEEFEGDENIVRVRLIAKQQ

SEQ ID NO: 15915 - protein, 237 aa, Streptococcus agalactiae 2603V/R
MTQFLGEFLGTFILVLLGDGVVAGNVLSKTKEEGTGWTAIVFGWGIACTVAVYVSGLFSPAHLNPAVTLAMASIGAISWGQVIPFIIAQMLGAMVAATILWLHYYPHWKETKDSGLILASFSTGPAIRHTPSNLLGEIIGTAILVITIMAIGPSKVAAGLGPIIVGIVIFAVGFSLDPTTGYAINPARDLGPRLMHAILPIENKGNSDWSYAWIPVVGPIIGGVLGAILYNIALTLV

SEQ ID NO: 15916 - protein, 304 aa, Streptococcus agalactiae 2603V/R
MLQNIGQTGIQATRIALGCMRMSDLKGKQAEEVVGTALDLGINFFDHADIYGGGLSELRFRDAIKHLNVNRDKMIIQSKCGIREGYFDFSKEYILSSVDGILERLGTEYLDFLILHRPDVLVEPEEVAEAFTKLRAEGKVKHFGVSNQNRFQMELLQSYLDEPLAVNQLQLSPAHTPMFDAGLNVNMLNKASIEHDDGIVDYCRLKRVTIQAWSPFQIDLSRGLFVNHPDYKELNETIAKLAKNYNVSSEAIVIAWILRHPAKMQAIVGSMNPSRLKAIDKANDIALTRKEWYDIYRSAGNILP

SEQ ID NO: 15917 - protein, 448 aa, Streptococcus agalactiae 2603V/R
MTITAEDIRREVKEKNVTFLRLMFTDILGVMKNVEIPATDEQLDKVLSNKAMFDGSSIEGFVRINESDMYLYPDLDTWIVFPWGDENGAVAGLICDIYTAEGEPFAGDPRGNLKRNMKRMQEMGYKSFNLGPEPEFFLFKMDENGNPTLDVNDKGGYFDLAPTDLADNTRREIVNVLTQMGFEVEASHHEVAVGQHEIDFKYDDVLKACDNIQLFKLVVKTIARKHGLYATFMAKPKFGINGSGMHCNMSLFDNEGNNAFFDPEDPRGMQLSEDAYYFLGGLMKHAYNYTAIINPTVNSYKRLVPGYEAPVYVAWAGRNRSPLIRVPASRGMGTRLELRSVDPTANPYLALSVLLGSGLEGIENKIEAPEPIETNIYAMTVEERRQAGIVDLPSTLHNALEALEEDEVVKAALGTHIYTNFLDAKRIEWASYATYVSQWEIDNYLDLY

SEQ ID NO: 15918 - protein, 398 aa, Streptococcus agalactiae 2603V/R
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGAKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 15919 - protein, 220 aa, Streptococcus agalactiae 2603V/R
MSTNKIAPSILAADYANFANELKRIEETTAEYVHIDIMDGQFVPNISFGADVVSSMRKHSKLVFDCHLMVVDPERYIEAFAQAGADIMTIHVEATKHIHGALQKIKEAGMKAGVVINPGTPVESLIPILDLVDQILIMTVNPGFGGQAFIPEMMSKVKTVAAWRKEYGHHYDIEVDGGIDNTTIKAAAEAGANVFVAGSYLFKASDLPAQVETLRVALDD

SEQ ID NO: 15920 - protein, 233 aa, Legionella pneumophila serogroup 1
MKMKTVTAAVMGLAMSTAMAATDATSLATDKDKLSYSIGADLGKNFKNQGIDVNPEAMAKGMQDAMSGAQLALTEQQMKDVLNKFQKDLMAKRTAEFNKKADENKVKGEAFLTENKNKPGVVVLPSGLQYKVINSGNGVKPGKSDTVTVEYTGRLIDGTVFDSTEKTGKPATFQVSQVIPGWTEALQLMPAGSTWEIYVPSGLAYGPRSVGGPIGPNETLIFKIHLISVKKSS

SEQ ID NO: 15921 - protein, 236 aa, Legionella pneumophila serogroup 8
MKMKLVTAAVMGLAMSTAMAATDATSLATDKDKLSYSIGADLGKNFKNQGIDVNPEAMAKGMQDAMSGAQLALTEQQMKDVLNKFQKDLMAKRTAEFNKKADENKVKGEAFLTENKNKPGVVVLPSGLQYKVINSGNGVKPGKSDTVTVEYTGRLIDGTVFDSTEKTGKPATFQVSQVIPGWTEALQLMPAGSTWEIYVPSGLAYGPRSVGGPIGPNETLIFKIHLISVKKSSKFF

SEQ ID NO: 15922 - protein, 165 aa, Desulfovibrio vulgaris
MSTIVSVWAREILDSRGNPTVEVEVSLESGHTGGAAVPSGASTGSREALEMRDGDKGRYKGKGVEKAVDNVMGEIAEAIVGLNSLRQVQVDNTLLDLDGTDNKSRLGANAMLAVSLAHRAAASSFLGLPLYQYLGGVNAKVLPVPLMNIINGGAHAPNNLDIQEF

SEQ ID NO: 15923 - protein, 229 aa, Robinia pseudoacacia
AHRAHASTEGVAKYVRPAVAGFLMQKELDYLVGAVSNPKKPFAAIVGGSKVSTKIGVIESLLAKVDILLLGGGMIFTFYKAQGHSVGSSLVEEDKLDLANSLMEKAKAKGVSLLLPTDVVIADKFAADANSKVVPASSIPDGWMGLDIGPDAIKTFSETLDKTQSIIWNGPMGVFEFDKFAAGTEAIAKKLAELSGKGVTTIIGGGDSVAAVEKVGLADKMSHISTGGG

SEQ ID NO: 15924 - protein, 513 aa, Picea abies
MAGGMAVSRPKQGRAELYEGHITAYVILACIVAATGGSLFGYDLGVSGGVTSMDDFLKKFFRHVYERKQHHLRETDYCKYDNQLLTLFTSSLYLSGLVATFGASYITRSKGRRVSIIIGGLSFLLGAILNAAAKNLGMLIVGRILLGAGVGFSNQSVPLYLSEMAPAKVRGGTNNLFQLKTCLGIFVTNVINYFTNKLHPWGWRLSLGLAVIPALLMSIGGYFLPETPNSLVEQGRLQEGRQILEKIRGTKNVQAEFDDLVEASDVARAVKHPFRNLLQRRNRPQLVMGTCIPAFQQLTGNNSFLFYAPVIFQSLGMGNDASLYSAIMTGAVITFGALVSMFTVDRVGRRFLFMEGGTQMIVCHVIISILLKSNFGKGEKIPTGYGVGIVLLICIFYLLAYGWLWGPLSWLVCSEIFPMESLVVCVNLFFTAVIAQSFLALLCHLKYGIFLLFGGLVFIMSVVIYFFLPETKNVPIEEMRFQWAKHWYWKRFMDEYMDNDDENEKGNMTKAAA

SEQ ID NO: 15925 - protein, 208 aa, Phanerochaete chrysosporium
GAGGETTAGTLTFVVYFLTQHPNVLQRLRQEILDVVGPSNLPTYDDIKQMKYLRAVLNETLRLYPPVPWNMRYAVKDGILPNSEPDGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRHI

SEQ ID NO: 15926 - protein, 180 aa, Musa acuminata
MVSSMMVSSAATFTRASPAQSSMVAPFTGLKSASAFPVTRKPNADLSHLPSNGGRVQCMKVWPIEGVKKFETLSYLPTMKDEALVKQIEYLLRSKWIPCLEFCPKGFVWRENHRSPGYYDGRYWTMWKLPMFGCTDAVQVAKEVEECKKEYPHAFIRIIGFDNNRQVQCISFIAYKPTGY

SEQ ID NO: 15927 - protein, 367 aa, Glycine max
AVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 15928 - protein, 454 aa, Bacillus subtilis
MTSLIKIHAHGRRFEIFRSRGNPTVEVDLYTAKDLFRAAGARRCVHCHLRGPRTPRCCCLDPASYEMGLKGCYAHQYNYKTCSGSQETGCCEAGEDCPADDADGRHSSQLYDLIKKHPASVPGCLQGCCRGEGGALYRHIADFAGNPEVTLPVPAFIVINGGSHPANKFAQEFILLPVGASSFRTAGPAEVYHNLKNVIKEKYGKDATNVGDEGGFAPNILENKEALELLKSAIAKAGYTDQVVIGDVAASEFYRAGKYDLDFKSPDDASRYITPDQLADQLKSFTTCISSLLLTLPDASLQSRFGYYPDGDQPQAHRAGSGGEGLQLPPLEVTESLQACKLAQSNACGVIVSIDLRRLRTLFIADLFFGRVRADQDFSPCPICACQVECSFESRGLGRANKAKFAGRSFGPPLAKFPNLTAGHACTKYTPEQVSSRRGGGKTTTPNNPPSFCC

SEQ ID NO: 15929 - protein, 410 aa, Burkholderia sp. PS12
MATHVAIIGNGVAGFTTAQALRAEGFEGRISLIGNEPHLPYDRPSLSKAVLGGSLEHPPVLAEADWYGEARIDMLSGRSVTNLNVDARTISLDDGSTFAADAIVIATGSRARTLALPGSQLTGVVTLRTNDDVRPLCRGWTPATRLVIAGGGLIGCEVATTARKLGLAVTILESADELLVRVLGRRIGAWLRGLLTELGVRVELGTGVAGFSGDDRLEEVLASDGRRFAADNALVCIGAEPEDQLARQAGLSCDRGVIVDDHGATHAEGVFAVGDAASWPLRDGGRRSLETYMNAQRQAAAVAAAILGKHGSAPQVPVSWTEIAGHRMQMAGDIEGPGEFVLRGTLGDGAALLFRLRDGRIQAVVAVDAPRDFAMAARLVEARAAIEPARLADFSNSMRDLVRAQQGDSA

SEQ ID NO: 15930 - protein, 512 aa, Ocimum basilicum
MAALLLLLLLPLLLPAIFLLHHLYYRLRFRLPPGPRPLPIVGNLYDVKPVRFRCFADWAQSYGPIISVWFGSTLNVIVSNTELAKEVLKEKDQQLADRHRSRSAAKFSRDGQDLIWADYGPHYVKVRKVCTLELFSPKRLEALRPIREDEVTAMVESIYHDCTAPDNAGKSLLVKKYLGAVAFNNITRLAFGKRFVNSEGIIDKQGLEFKAIVSNGLKLGASLAMAEHIPSLRWMFPLDEDAFAKHGARRDQLTREIMEEHTRAREESGGAKQHFFDALLTLKDKYDLSEDTIIGLLWDMITAGMDTTAISVEWAMAELIKNPRVQQKAQEELDRVIGYERVMTELDFSNLPYLQCVAKEALRLHPPTPLMLPHRSNSNVKIGGYDIPKGSNVHVNVWAVARDPAVWKNPCEFRPERFLEEDVDMKGHDFRLLPFGAGRRVCPGAQLGINLVTSMIGHLLHHFNWAPPSGVSSDELDMGENPGLVTYMRTPLEAVPTPRLPSDLYKRIAVDL

SEQ ID NO: 15931 - protein, 509 aa, Ocimum basilicum
MAALLLLLLLLPAIFLLHHLYYRLRFRLPPGPRPLPVVGNLYDVKPVRFRCFADWAQSYGPIISVWFGSTLNVIVSNTELAKEVLKEKDQQLADRHRSRSAAKFSRDGQDLIWADYGPHYVKVRKVCMLELFSPKRLEALRPIREDEVTAMVESIYHDCTAPDNAGKSLLVKKYLGAVAFNNITRLAFGKRFVNSEGIIDKQGLEFKAIVSNGLKLGASLAMAEHIPWLRWMFPLDEDAFAKHGARRDQLTREIMEEHTRAREESGGAKQHFFDALLTLKDKYDLSEDTIIGLLWDMITAGMDTTAISVEWAMAELIKNPRVQQKAQEELDRVIGYERVMTELDFSNLPYLQCVAKEALRLHPPTPLMLPHRSNSNVKIGGYDIPKGSNVHVNVWAVARDPAVWKNPSEFRPERFLEEDVDMKGHDFRLLPFGAGRRVCPGAQLGINLVTSMIGHLLHHFNWAPPSGVSTDELDMGENPGLVTYMRTPLEAVPTPRLPSDLYKRIAVDL

SEQ ID NO: 15932 - protein, 466 aa, Bacillus pumilus
METNKQSYTLPEGFWWGSSASATQTEGSVPGDGKGPNIWDHWFEQEPTRFFDGVGPDVTSQFYRKYKEDIRLMKEIGHNSFRLSISWSRLLPEGTGAVNEEAVSFYNDVINELIAHDIEPFVNLYHFDMPMALQEKGGWVNRQVVDDYVSYAALCFQLFGDRVKKWFTHNEPIVPVEGGYMYSFHYPNEVDFQKAVQVGFHEILSNAKAIAAYKKLQQGGKIGIILNLTPSYPRSQHPRDVEAAEMADAFFNRSFLDPAVKGHFPEKLVEVLKKEGFMPSMEEGDLELIRENTIDLLGINYYQPRRVKAKEHMPHPQAPFMPNHYFDSFEMPGRKMNVYRGWEIYEKGIYDILKKVQTDYDNIECFISENGMGVEGEERFKDEEGMIHDDYRIDFISEHLKWVHRAIQEGSNVKGYHLWTFMDNWSWSNAYKNRYGFVSVDLQKDGKRTIKKSGYWFQSVSKNNGF

SEQ ID NO: 15933 - protein, 264 aa, Synechococcus sp. PCC 7002
MTSVSERFRSLKQAGQCALIPFITAGDPDLETTEQALKILDAAGADFIELGVPYSDPLADGPTIQAAATRALSRGVTLEQVLAIVQRVHGQLTAPIILFTYYNPIFYRGIDAFMAQVAAAGVKGLVIPDLPLEESQMVLDAATSHGLDLILLVAPTSPTERIEAIAKASQGFIYLVSVTGVTGARTSVASRVGELLPKLRQVTDKPIGVGFGVSDPAQARQLKEWGADGVIVGSAVVKRLATGTPAEGLAAVKEFCESLKEAIA

SEQ ID NO: 15934 - protein, 366 aa, Cryptococcus neoformans var. neoformans
MTIDQSQINFNVPSTYKLEEIVGEGAYGLVVAGTHLPSGTQVAIKRITPFDHTMFCQRTLREIKLLRHFHHENIISILDLIQPESYEVFNEVYLVQELMETDLHRVIRSQELSDDHCQYFVYQTLRGLKALHSADVLHRDLKPSNLLLNANCDLKICDFGLARSSAKPPPGTSDGGQGFMTEYVATRWYRAPEVMLSFQEYTKAIDLWSVGCILAEMINGKPLFPGRDYHHQLSLILQVLGTPTMDDFNEITSQRSKDYLRALEFTRRQDFSAICPKAKPAAVDLLKQTLTFSPSKRITVEEALMHSYVEAYHDPHDEPNAEPLKPGFFDFEFHQEKLSRDQWKRMIYDEVQDPVPTILSQWTESH

SEQ ID NO: 15935 - protein, 479 aa, Methylobacterium extorquens
MSETYDVLIIGAGPGGYVAAIRSAQLGFKTAVVDREHLGGICLNWGCIPTKALLRSAEIYHYMQHASDYGLSAKEVSFDAAAIVKRSRGVSGRLNGGVGMLLKKNKVDVIWGEASIESGAKGNEPGKVTVKETKRAEPPKGAKGAGTYAAKHIIVATGARPRVLPGIKPDKKQIWTYYEAMVPEKMPKSLLVMGSGAIGIEFASFYRTMGADVTVIELLPQILPVEDAEIAGLARKRFEKQGIKILTSAKVTKVEKGADSVTATVEDDKGKTQQLTAEKLISAVGVVGNIENLGLEKVGVKIERGVVVTDGLGRTNVPGVYAIGDVAGPPMLAHKAEHEGVLCVETIKGLHTHPMDKAKIPGCTYCQPQIASVGVTEGKAKELGLSIKVGRFPFAGNGKAIALGEPDGLVKTIFDAKTGQLLGAHMVGAEVTELIQGYVVAMTLESTEEELMHTVFPHPTLSEMMHESVLDAYGRVIHT

SEQ ID NO: 15936 - protein, 467 aa, Methylobacterium extorquens
MSYDLIVIGTGPGGYVCAIRAAQLGLKTAVVEKRATHGGTCLNVGCIPSKALLHASEAFEEANKHFSELGIDVGTPKLDLKKMQSFKQSGVDGNTKGVEFLLKKNKVDTYHGRGRIAGAGRVEVISDDGGNQLLETKNIVIATGSDVTRLPGVEIDEKTVVSSTGALELAEVPKRLVVIGAGVIGLELGSVWRRLGAEVTVIEYLDRVLPGMDGEVGKQFQRILAKQGMVFKLSTKVTGVETGKKGRATVTVEPAQGGEPEKLEADVVLVAIGRVPYTEGLGLETVGVATDDKGRIEVDSHYATNVTGIYAIGDVIAGPMLAHKAEDEGVAVAEILAGQSGHVNYGVIPNVVYTFPEVASVGKTEEELKKDGIAYNVGKFPFTANGRAKANGTTDGFVKILADAQTDRVLGVHIVGADAGNLIAEVAVAMEFAASAEDIARTCHAHPTLTEAIKEAALAVDKRAIHV

SEQ ID NO: 15937 - protein, 450 aa, Lactobacillus brevis
MKVTVVGCTHAGTFAIKQILAEHPDAEVTVYERNDVISFLSCGIALYLGGKVADPQGLFYSSPEELQKLGANVQMNHNVLAIDPDQKTVTVEDLTSHAQTTESYDKLVMTSGSWPIVPKIPGIDSDRVKLCKNWAHAQALIEDAKEAKRITVIGAGYIGAELAEAYSTTGHDVTLIDAMDRVMPKYFDADFTDVIEQDYRDHGVQLALSETVESFTDSATGLTIKTDKNSYETDLAILCIGFRPNTDLLKGKVDMAPNGAIITDDYMRSSNPDIFAAGDSAAVHYNPTHQNAYIPLATNAVRQGILVGKNLVKPTVKYMGTQSSSGLALYDRTIVSTGLTLAAAKQQGVNAEQVIVEDNYRPEFMPSTEPVLMSLVFDPDTHRILGGALMSKYDVSQSANTLSVCIQNENTIDDLAMVDMLFQPNFDRPFNYLNILAQAAQAKVAQSVNA

SEQ ID NO: 15938 - protein, 1066 aa, Fusarium oxysporum
MAESVPIPEPPGYPLIGNLGEFTSNPLSDLNRLADTYGPIFRLRLGAKAPIFVSSNSLINEVCDEKRFKKTLKSVLSQVREGVHDGLFTAFEDEPNWGKAHRILVPAFGPLSIRGMFPEMHDIATQLCMKFARHGPRTPIDTSDNFTRLALDTLALCAMDFRFYSYYKEELHPFIEAMGDFLTESGNRNRRPPFAPNFLYRAANEKFYGDIALMKSVADEVVAARKASPSDRKDLLAAMLNGVDPQTGEKLSDENITNQLITFLIAGHETTSGTLSFAMYQLLKNPEAYSKVQKEVDEVVGRGPVLVEHLTKLPYISAVLRETLRLNSPITAFGLEAIDDTFLGGKYLVKKGEIVTALLSRGHVDPVVYGNDADKFIPERMLDDEFARLNKEYPNCWKPFGNGKRACIGRPFAWQESLLAMVVLFQNFNFTMTDPNYALEIKQTLTIKPDHFYINATLRHGMTPTELEHVLAGNGATSSSTHNIKAAANLDAKAGSGKPMAIFYGSNSGTCEALANRLASDAPSHGFSATTVGPLDQAKQNLPEDRPVVIVTASYEGQPPSNAAHFIKWMEDLDGNDMEKVSYAVFACGHHDWVETFHRIPKLVDSTLEKRGGTRLVPMGSADAATSDMFSDFEAWEDIVLWPGLKEKYKISDEESGGQKGLLVEVSTPRKTSLRQDVEEALVVAEKTLTKSGPAKKHIEIQLPSAMTYKAGDYLAILPLNPKSTVARVFRRFSLAWDSFLKIQSEGPTTLPTNVAISAFDVFSAYVELSQPATKRNILALAEATEDKDTIQELERLAGDAYQAEISPKRVSVLDLLEKFPAVALPISSYLAMLPPMRVRQYSISSSPFADPSKLTLTYSLLDAPSLSGQGRHVGVATNFLSHLTAGDKLHVSVRASSEAFHLPSDAEKTPIICVAAGTGLAPLRGFIQERAAMLAAGRTLAPALLFFGCRNPEIDDLYAEEFERWEKMGAVDVRRAYSRATDKSEGCKYVQDRVYHDRADVFKVWDQGAKVFICGSREIGKAVEDVCVRLAIEKAQQNGRDVTEEMARAWFERSRNERFATDVFD

SEQ ID NO: 15939 - protein, 409 aa, Arabidopsis thaliana
MTYVGAGMICSHLVNLSLLFGAILSWGIMWPLIARLKGEWFPATLKDNSMQGLNGYKVFICIALILGDGLYNFVKILFFTGRSFHSRLSKTNSISTLVEVPEDSTKESDNLKRENEVFVRESIPLWMACVGYLFFSLVSIIAIPLMFPQLKWYFVLVAYLLAPSLSFCNAYGAGLTDMNMAYNYGKAALFVMAALAGKNDGVVAGMVACGLIKSIVSVSADLMHDFKTGHLTQTSPRSMLVAQAIGTAIGCVVAPLTFFLFYKAFDVGNQNGEYKAPYAMIYRNMAIIGVQGPSALPKHCLELCYGFFAFAVAANLARDLLPDKPGKWIPLPMAMAVPFLVGGSFAIDMCIGSLVVYVWKKVNRKKADVMVPAVASGLICGDGLWILPSSLLALAKVRPPICMNFTAAH

SEQ ID NO: 15940 - protein, 308 aa, Arabidopsis thaliana
MRPPVTGGRGGGGFRGGRDGGGRGFGGGRSFGGGRSGDRGRSGPRGRGRGAPRGRGGPPRGGMKGGSKVIVEPHRHAGVFIAKGKEDALVTKNLVPGEAVYNEKRISVQNEDGTKVEYRVWNPFRSKLAAAILGGVDNIWIKPGAKVLYLGAASGTTVSHVSDLVGPEGCVYAVEFSHRSGRDLVNMAKKRTNVIPIIEDARHPAKYRMLVGMVDVIFSDVAQPDQARILALNASFFLKTGGHFVISIKANCIDSTVAAEAVFQSEVKKLQQEQFKPAEQVTLEPFERDHACVVGGYRMPKKQKTPAS

SEQ ID NO: 15941 - protein, 474 aa, Arabidopsis thaliana
MSATLTGSGTALGFSCSSKISKRVSSSPASNRCCIKMSVSVDEKKKSFSLQKSEEAFNAAKNLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDLEAVEKLFAAHKGEISAVILEPVVGNSGFIPPTPEFINGLRQLTKDNGVLLIFDEVMTGFRLAYGGAQEYFGITPDLTTLGKIIGGGLPVGAYGGRRDIMEMVAPAGPMYQAGTLSGNPLAMTAGIHTLKRLKQAGTYEYLDKITKELTNGILEAGKKTGHPMCGGYISGMFGFFFAEGPVYNFADSKKSDTEKFGRFFRGMLEEGVYFAPSQFEAGFTSLAHTPEDIQLTIAAAERVLSRI

SEQ ID NO: 15942 - protein, 333 aa, Arabidopsis thaliana
MSSDDTIEESLLVDPKLLFIGSKIGEGAHGKVYQGRYGRQIVAIKVVNRGSKPDQQSSLESRFVREVNMMSRVQHHNLVKFIGACKDPLMVIVTELLPGMSLRKYLTSIRPQLLHLPLALSFALDIARALHCLHANGIIHRDLKPDNLLLTENHKSVKLADFGLAREESVTEMMTAETGTYRWMAPELYSTVTLRQGEKKHYNNKVDVYSFGIVLWELLTNRMPFEGMSNLQAAYAAAFKQERPVMPEGISPSLAFIVQSCWVEDPNMRPSFSQIIRLLNEFLLTLTPPPPQPLPETATNRTNGRAITEFSIRPKGKFAFIRQLFAAKRNINS

SEQ ID NO: 15943 - protein, 512 aa, Arabidopsis thaliana
MGCCQSLFSGDNPLGKDGVQPQPLSQNNHGGATTADNGGSGGASGVGGGGGGGGIPSFSEFSFADLKAATNNFSSDNIVSESGEKAPNLVYKGRLQNRRWIAVKKFTKMAWPEPKQFAEEAWGVGKLRHNRLANLIGYCCDGDERLLVAEFMPNDTLAKHLFHWENQTIEWAMRLRVGYYIAEALDYCSTEGRPLYHDLNAYRVLFDEDGDPRLSCFGLMKNSRDGKSYSTNLAYTPPEYLRNGRVTPESVTYSFGTVLLDLLSGKHIPPSHALDMIRGKNIILLMDSHLEGKFSTEEATVVVELASQCLQYEPRERPNTKDLVATLAPLQTKSDVPSYVMLGIKKQEEAPSTPQRPLSPLGEACSRMDLTAIHQILVMTHYRDDEGTNELSFQEWTQQMKDMLDARKRGDQSFREKDFKTAIDCYSQFIDVGTMVSPTVFGRRSLCYLLCDQPDAALRDAMQAQCVYPDWPTAFYMQSVALAKLNMNTDAADMLNEAAQLEEKRQRGGRGS

SEQ ID NO: 15944 - protein, 280 aa, Bacillus subtilis
MDYEKERTERAERIRKGGAEKYHQSNREKGKLFVRERLSLLFDDDIELEDAFFAECMSDGLPADGVVTAIGKIGGQTVCVMANDSTVKAGSWGAKTVEKIIRIQEIAEKLNCPLIYLVDSAGARITDQINVFPGRRGAGRIFYNQVKLSGRIPQICLLFGPSAAGGAYIPAFCDIVVMVDGNASMYLGSPRMAEMVIGEKVSLEEMGGARMHCSISGCGDILAETEEEAIQLVRAYLSYFPANFQEKAPIHEKRPPKHFETPLADVIPQNQNAPFDMHEL

SEQ ID NO: 15945 - protein, 214 aa, Paeonia californica
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPERFEGAKKFGVTEFVNPKDYNKPVQEVIAEMTGGGVDRSVECTGSIMAMISAFECVHD

SEQ ID NO: 15946 - protein, 214 aa, Paeonia szechuanica
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTECVNPKDYNKPVQEVIAEMTGGGVDRSVECTGSIMAMMSAFECVHD

SEQ ID NO: 15947 - protein, 214 aa, Paeonia tenuifolia
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 15948 - protein, 214 aa, Paeonia veitchii
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAIISAFECVHD

SEQ ID NO: 15949 - protein, 214 aa, Paeonia lactiflora
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTGGGVDRSVECTGSIMAMISAFECVHD

SEQ ID NO: 15950 - protein, 214 aa, Paeonia lutea
IVESVGEGITDLKPGDHVLPVFTGECKECRHCKSEESNMCDLLRINTDRGVMLSDGKSRFSINGQPIFHFIGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYDKPAQEVIAEMTDGGVDRSVGCTGSIMAMVSAFECVHD

SEQ ID NO: 15951 - protein, 214 aa, Paeonia rockii
IVESVGEGVTDLKPGGHVLPVFTGECKECRHCKSEESNMCDLLRINTDRGVMLSDGKSRFSINGQPIFHFIGTSTFSEYTVVHVGCVAKINPEAPLDKVCVLSCGISTGLGATLNVAKPKKGSSVAIFGLGAVGLAAAEGARIAGASRIIGVDLNPKRFEEAKKSGVTEFVNPKDYDKPAQEVIAEMTDGGVDRSIECTGSIMAMVSAFECVHD

SEQ ID NO: 15952 - protein, 214 aa, Paeonia suffruticosa subsp. spontanea
IVESVGEGVTDLKPGDQVLPVFTGECKECRHCKSEESNLCDLLRINTDRGVMLSDGKSRFSINGQPIFHFIGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYDKPAQEVIAEMTDGGVDRSVECTGSIMAMVSAFECVHD

SEQ ID NO: 15953 - protein, 166 aa, Pelargonium x hortorum
MASADVEYRCFVGGLAWATDDHALEQAFSQYGEVVESKIINDRETGRSRGFGFVTFSNEKSMNDAIEGMNGQNLDGRNITVNEAQSRGSGGGGGRREGGGGGGYGRREGGGGYSRGGGGGGYGGGGGGYGGGNGGGYGGGREQRGYGDSGGGSRYSRDSDGGNWRS

SEQ ID NO: 15954 - protein, 165 aa, Oryza sativa (indica cultivar-group)
MAAPDVDYRCFVGGLAWATDNRSLEAAFSTYGEILESKIINDRETGRSRGFGFVTFSSEQAMRDAIEGMSGKELDGRNITVNEAQSRRSGGGGGGGYGQRGGGGGYGGRGYGGGGGGGGYGQRREGGYGGGGGYGGGGGGGGYGGGYGGGYGSRGGGNSDGNWRN

SEQ ID NO: 15955 - protein, 308 aa, Neocallimastix frontalis
MAQKKQQQKLGFYEDFLLAGVSATISKTAAAPLERVKLLVQNQGEMLKSGRLATPYKGIGDCFVRVAKEVGIASFWRGNGANIIRYFPTQALNIAFKERIKNALAVDKEKEGYAEWLVGNIASGGAGGALSQVFVYSLDYARTRLANDAKSANGGERQYKGLIDVYKKTYKADGITGLYRGFALSCVGIMVYRGLYFGLYDSMKPLLKNLGMEGSFAASFILGWGVTTVAGIASYPIDTIRRRMMMTSGETVKYKSSIDCAKQVMQKEGVQAFFKGCGANILRGVAGAGVLSGFDKIKEVYINWRIKN

SEQ ID NO: 15956 - protein, 488 aa, Ruegeria sp. PR1b
MTRTGETPKTVQMITPVLLCGGSGTRLWPLSRKSYPKQFVPLMGEETLFQASAKRLAGVAEGLSFGAPLVLTNSDFRFIVTEQLQAVGIDPGAILIEPEGRNTAPAVLAAALRAQAEDPEAVLLVAPSDHVVPDVAAFHAAISQGLAAVAEGQMVTFGITPTHAETAYGYLELAAAPDADGAPLALKQFVEKPDAARAAEMLAAGNFKWNAGIFLFAARDIIAAFTAHAPALVAPVQAALDQAQVDLGFLRLAPEPWAQAEDISIDYAVMEKARNLSVVPFDAAWSDLGGWDAVWRELGPDDNGVVTSAGATAIDCHDTLLRSDSEGLEVVGIGLEGIMAVAMNDAVLVADKSRAQDVKLAVSALKAKGAAQATAFPKDHRPWGWFESLVVGERFQVKRILVHPGASLSLQSHFHRSEHWIVVEGTAKVTVDDEVRLVTENQSVYIPLGAVHRMENPGKLPMVLIEVQTGAYVGEDDIVRYEDIYARS

SEQ ID NO: 15957 - protein, 499 aa, Ruegeria sp. PR1b
MNAASFTKSFWHDEAKKLEFRTKHLINGEWVDSEDGTTFDTINPATGETIAKVASGKAADIDKAVKNARETFKSGVWSMLAPRERLAVIERFSALIEENAVEFALLDCLDMGKPVMDMINIDIPESVKNLKFFAETADKVHGSLTATDPSVVHYILRQPLGVVGLITPWNYPLMMAAWKLGPALITGNSVVLKPAEQAPLSCALLGDLFLKAGGPAGVLNVVQGLGEEAGKAIGLHPDVDKIGFTGSTEVGKLLMTYAGQSNMKRVTTECGGKTPQIVFADYDNLDKAVTSAVYGIYGNMGEMCNAGSRILVQRPIYDEFIKRFSELTASNMVVGDPLDPDTTIGPLVTVEQQERVLEYIEIGKKEGATLALGGGRGLNSGCYVEPTLFTDVTNSMRVAQEEIFGPVGTVIPFDTAEEALEIANDSLYGLAAAVWTNDLKTAHRFGRDLESGFVWVNTFDIGDMTSIWGGYKQSGNGRDTCIEALSQYTQTKSVWMDMA

SEQ ID NO: 15958 - protein, 317 aa, Actinidia deliciosa
TFPVIDMEKLTGKERSPTMEKINDACENWGFFELMNHGISHELMDTVERLTKEHYKKCMEQRFKEMVATKGLEAVQSEIDDLDWESTFFLRHLPVSNISEIPDLEQDHRKAMKEFAEKLEKLAEQLLDLLCENLGLEKGYLKKAFSGSKGPTFGTKVSNYPPCPLPELIKGLRAHTDAGGIILLFQDNKVSGLQLLKEGEWIDVPPMKHSIVINIGDQLEVITNGKYKSVMHRVIAQTDGNRMSIASFYNPGSDAVIYPAPALVDKEEDQQKQVYPKFVFEDYMKLYAGLKFQAKEPRFEAMKAMESAVKLGPISTI

SEQ ID NO: 15959 - protein, 187 aa, Carica papaya
INPAVTFGLLLARKLSLTRAIFYMVMQCLGAICGAGVVKGFEGSATFELKGGGANVRQPWIHKGDGLGAEIVGTFVLVYTVLSATDAKRNARDSHVPILAPLPIGFAVFLVHLATIPITGTGINPARSLGAAIIFNRDKAWDDHWIFWVGPFIGAALAALYQQVVIRAIPFKSKCKFPKWVSIKYVI

SEQ ID NO: 15960 - protein, 406 aa, Phytophthora cinnamomi
MKFISAAFATIALVAATVNGSPMMRQVVEGSKHVQQQTQQQQQQQQQQQQLDGQQQDEQQQQEQPQQQSTSTGGSSTCNLTGIYKKGTDISSCSTVTVGPLTVPAGVTLDLSGAKTGATIQFTGTTTFGTLKWNGPLVTLSGSSLTVKGNGKLDGQGAWYWKQGQSITRPVFFQVHNVHHSTLSGFTILNTPYRTFSIVDSEYTTLSGLTLDARAGNGIATNTDGFDLSCNDHITITGNTIYNQDDCLAMQSSTNTFFTNNYCYKSHGISIGSLGGKSVDKTTTVQGLTAQGNHMIDCTNGLRIKTIIGLQGLVSDVKFLDNTLSNVLNAIVVHSDYSKSLGRYTGAATSQAQITGVTVSGLKGTATNLYDIVVNSKVVSELTFSGIQVAATAKGTLSGLPNSIAV

SEQ ID NO: 15961 - protein, 452 aa, Phytophthora cinnamomi
MKLFSTIFAVSLLVVSTAIADAGSNVLQSDNCDPGFSGTDSSSSGKEGVHIVQSGGSDQSGSSNTNASQNNPGQDNPNQDNPGQNNPGQNTPDQNNPGQNTPDQNSTSTDGSQTQEPPVLRGDCILTGDYINNTDVRKCDSIVVDSLRVPAGVTLNLTKLQDNAKVSFKGTSTFGPKLWDGPLVKLQGNNLTVTGPGTLDGQGAYYWPQGQKVDKPVFFKIYKVAHSTLSGFTLLNVPYRTFSVGNSNYTTITGLTLNTTAGNGVAQNTDGFDLSKNDHITITKNRIYNQDDCLAMQSSTNTVFSDNYCCGSHGISIGSLGGPKQNSSTTVDGLTVTGNTIENSTNGIRIKTIIGLKGLVTNAVYTNNKLINVTNAIVMHSDYNKTKGGYAGTPTSLVKIENIKIDGLKGTAENLYDIVANPDVVSDWTFTNIDVTAASNGNCTGEPSTVKC

SEQ ID NO: 15962 - protein, 452 aa, Phytophthora cinnamomi
MKLFSTIFAVSLLVVSTAIADAGSNVLQSDNCDPGFSGTDSSSSGKEGVHIVQSGGSDQSGSSNTDASQNNPGQDNPNQDNPGQNNPGQNTPDQNNPGQNTPDQNSTSTDGSQTQEPPVLRGDCILTGDYINNTDVRKCDSIVVDSLRVPAGVTLNLTKLQDNAKVSFKGTSTFGPKLWDGPLVKLQGNNLTVTGPGTLDGQGAYYWPQGQKVDKPVFFKIYKVAHSTLSGFTLLNVPYRTFSVGNFNYTTITGLTLNTTAGNGVAQNTDGFDLSKNDHITITKNRIYNQDDWLAMQSSTNTVFSDNYCCGSHGISIGSLGGPKQNSSTTVDGLTVTGNTIENSTNGIRIKTIIGLKGLVTNAVYTNNKLINVTNAIVMHSDYNKTKGGYAGTPTSLVKIENIKIDGLKGTAENLYDIVANPDVVSDWTFTNIDVTAASNGNCTGEPSTVKC

SEQ ID NO: 15963 - protein, 452 aa, Phytophthora cinnamomi
MKLFSTIFAVSLLVVSTAIADAGSNVLQSDNCDPGFSGTDSSSSGKEGVHIVQSGGSDQSGSSNTDASQNNPGQDNPNQDNPGQNNPGQNTPDQNNPGQNTPDQNSTSTDGSQTQEPPVLRGDCILTGDYINNTDVRKCDSIVVDSLRVPAGVTLNLTKLQDNAKVSFKGTSTFGPKLWDGPLVKLQGNNLTVTGPGTLDGQGAYYWPQGQKVDKPVFFKIYKVAHSTLSGFTLLNVPYRTFSVGNSNYTTITGLTLNTTAGNGVAQNTDGFDLSKNDHITITKNRIYNQDACLAMQSSTNTVFSDNYCCGSHGISIGSLGGPKQNSSTTVDGLTVTGNTIENSTNGIRIKTIIGLKGLVTNAVYTNNKLINVTNAIVMHSDYNKTKGGYAGTPTSLVKIENIKIDGLKGTAENLYDIVANPDVVSDWTFTNIDVTAASNGNCTGEPSTVKC

SEQ ID NO: 15964 - protein, 413 aa, Phytophthora cinnamomi
MKAFSALITVLLLIANTTIAEAARGIPYVPAGAASGLSYKHGVSIAGSSSAAKNPSVENYPDQNASFEGSDRPQNQTPPALEGACTLTGDYINNTDVSKCDTIIVDSLRVPAGVMLNLTNLQDNTKVSFQGTSTFGPKLWSGPLVNLKGNNITVTGPGTLDGQGAWYWPQGQKVKKPVFFNILEANHSTLSGFTLLNMPYRTFSIYYSNYTTITGLTLNSSAGDGVAKNTDGFDLLGNDHFTITKNRVYNQDDCLAMQSSTNIVFSDNYCCGSHGISIGSLGGPVLNSSTTVNGLTVTGNTIVNSTNGIRIKTIIGLKGLVTNAVYTNNTLINVTNAIVVHSDYNKTQGGYAGKPTSLVKITNIKIDGLKGTAKNLYDIVANPDVVSDWWFTNIDVTASSNGNCTGEPSNVPC

SEQ ID NO: 15965 - protein, 388 aa, Phytophthora cinnamomi
SPMLAARLIRQKITSQGSPLSPNPTTSKDTPSQNNPGQGAYDESSDGSQKQTPPVLKGACTLTGDYINNTDVSKCSTIIIDSLRVPAGVQLNLTDLQDNAKIKFQGTSTFAPMLWSGPLVLVKGKHITVTGPGTLDGQGAWYWPKGQKVTKPVFFRILNTTHSTFTGFNMLNMPYRTFSVWDSNYTTISGLKLNSSAGNGVAKNTDGFDLSRNNHVTITKNRIYNQDDCLAMQSSKNTVFSDNYCCGSHGISVGSLGGPVLNWTTTVDGLTVTGNTIENSSNGIRIKTIVGLKGLVTNAVYTNNTLINVTNAIVMHSDYNKTKGGYDGTPTSLVKITKIKIDGLKGTAENLYDIVANPDVVSDWSFTNIKVVASNNGNCTGEPSNVLC

SEQ ID NO: 15966 - protein, 454 aa, Phytophthora cinnamomi
MKLISTALAAFALFAVTVNGSSMLRMEAESKNKTSHHHSQHAVQTQQPDQQQTQQQDQTQQQDQTQQQDQSQQQDQTQQQNQTQQQQLSSSGSTNTGTASSNATTTSSGSSTSAGTSTSTTSGSSCNLTGTYKAGTDISSCASITIGSLTVPAGVTLDLSKAKSGATITFTGITTFGTQKWAGPLVLLSGSDLTVKGSGTLDGQGAWYWQQGQSITRPVFFRLQNVANSKLSGFTLKNSPFRTFSLVTCQQTTITGLLLDSRAGDGIAKNTDGFDLTKNDHITITGNKIYNQDDCLAMQSSTNTVFSNNYCCGGHGVSIGSLGGTAVNQGSTVQGLTVQNNTIVNSDNGIRIKTIIGMQGLVSDVKYVQNKLSNVKNAIVMHSDYSKTKAGYTGSPTSAVTIQGVTISGLTGSATNLYDICANSKVVSDWTFSGIEVSASATGKATGQPNSIDV

SEQ ID NO: 15967 - protein, 414 aa, Phytophthora cinnamomi
MKFFTTALAVFALIATTANGSPMLRMEAEGKKGKSKTEAPVVEADDDYTQQQDPTQQQDPTQQQDQSQQQDPTQQQSPTTKTSSGCHLTGTYKKGTSIASCSSIVIDSLTVPAGVTLDLSLAKTGATIEFVGTTTFGTQKWEGPLVRVSGTSLTVKGSGVLDGQGSWYWKQGQSITRPVFFKLQNVISSTVSGFTIKNMPFRTFSIVTSKDTTLRGLTIDNRAGNGIAKNTDGFDLTKNDHITITGNKIYNQDDCLAMQSSTNTVFSNNYCCGGHGISIGSLGGNAVDQSTTVQGLTVQGNTIVDSDNGIRIKTIIGLKGLVSDVKYVQNTLSNVKNAIVMHSDYSKAKGGYTGSPTSQVTIKGVTVNGLKGTGTNLYDIVANPKVVSGWDFSGVTVSASVKGKLAGAPNSMSV

SEQ ID NO: 15968 - protein, 414 aa, Phytophthora cinnamomi
MKFFTTALAVFALIATTANGSPMLRMEAEGTKGKSKTKAPVVEADDDYTQQQDPTQQQDPTQQQDQSQQQDPTQQQSPTTKASSGCHLTGTYKKGTSIASCSSIVIDSLTVPAGVTLDLSLAKTGATIEFVGTTTFGTQKWEGPLVQVSGTDLTVKGSGVLDGQGMWYWKQGQSITPPVFFKLQNVISSTVSGFTIKNMPFRTFSIVTSKDTTLSGLTIDSRAGNGIAKNTDGFDLTKNDHITITGNKIYNQDDCLAMQSSTNTVFSNNYCCGGHGIAIGSLGGNAVDQSTTVQGLTVEGNTIVDSDNGIRIKTIIGLKGLVSDVKYVQNTLSNVKNAIVMRSDYSKAKGAYTGSPTSQVTIKDVTVNGLKGTATNLYDIVANPKVVSGWDFSGVTVSASVKGKLAGAPNSVSV

SEQ ID NO: 15969 - protein, 377 aa, Phytophthora cinnamomi
MKLVSAAFASFALLVATVNGSPMLRMEAEGGKGGLPKQGQQQQSSSSSCNLTGTYEKGTDISSCSSVTIGSLTVPAGVTLDLSNVKDGATIQFTGTTTFGTQKWVGPLVLLSGNSLTVKGSGTLDGQGAWYWKQGESITRPVFFRLQNVVGSTLSGFTLKNSPFRTFSLVTCQQTTLSGLLLDSRDGNGIAKNTDGFDLTKNDHITITGNKIYNQDDCLAMQSSTNTIFNNNYCCGGHGISIGSLGGNTVDDSSTVQGLTVQGNHIENSDNGLRIKTIVGMKGLVSNVKYVQNQLSNVKNAIVMHSDYSKSKGGYTGSPTSAVAIEGVTISGLTGSATNLYDIVANPKTVSDWTFSGIEVSASATGKAVGQPNSIAV

SEQ ID NO: 15970 - protein, 137 aa, Physcomitrella patens
MRWIVGGGVQRTIASPGRGILAIDESNATCGKRLASIGLENNEVNRQAYRQLLCTTPGLGEYISGAIMFEETLYQSTSDGKKMVDCLVEGGIVPGIKVDKGLVPLAGSNEESWCQGLDGLASRTAAYYKQGARFAKW

SEQ ID NO: 15971 - protein, 374 aa, Nierembergia sp. NB17
MASEAVHASPTVCVTGAAGFIGSWLVMRLLERGYNVHATVRDPENKKKVKHLQELPKADTNLTLWKADLAVEGSFDEAIKGCQGVFHVATPMDFESKDPENEVIKPTVQGMLSIIESCVKANTVKRLVFTSSAGTLDVQEQQKLFYDETSWSDLDFINAKKMTGWMYFVSKILAEKAAMEEAKKNNIDFISIIPPLVVGPFITPSFPPSLITALSLITGNEAHYCIIKQGQYVHLDDLCEAYIFLYEHPKAEGRFICSSHHAIIYDVAKMIREKWPEYYVPTEFKGIAKDLPVVAFSSKKLTDMGFQFKYTLEDMYKGAIETCRQKQLLPFSTNRPSENGLDKEAISISSENFASGKENAPVANHKVKLTSVEI

SEQ ID NO: 15972 - protein, 503 aa, Nierembergia sp. NB17
MMQLSTELAIAAIIFLLAHILISKTSGRRLPPGPRGWPVIGALPLLGDMPHVSLAKMAKKYGPIMYLKVGTCGMAVASTPHAAKAFLKTLDINFSNRPPNAGATHFAYNAQDMVFAPYGPRWKLLRKLSNLHMLGGKALEDWSNVRANELGHMLKSMLDLSREGQRVVIADMLTFAMANMIGQVILSKRVFVDKGVEVNEFKNMVVELMTVAGYFNIGDYIPCLAWLDLQGIEKGMKILHKKFDVLLTKMFDEHKTTSHEREGKSDFLDMVMANRDNSEGERLSTTNIKALLLNLFTAGTDTSSSVIEWALTEMLKNPSILKKAQVEMDQVIGKNRRLLESDISNLPYLRAICKETFRKHPSTPLNLPRISSESCEVDGYYIPKNTRLSVNIWAIGRDPDVWENPLKFNPERFLSGKYAKIDPRGNDFELIPFGAGRRICAGTRMGIVMVEYILGTLVHSFDWKLPSDVIELNMEEVFGLALQKAVPLEAMVTPRLPLNVYAP

SEQ ID NO: 15973 - protein, 288 aa, Lilium longiflorum
MEGKEEDVKLGANKYSERQPIGTAAQTQDRDYKEPPPAPFFEPGELKSWSFYRAGIAEFVATFLFLYITILTVMGVSKNATNKCVTVGIQGIAWSFGGMIFALVYCTAGISGGHINPAVTFGLFLARKLSLTRAIFYIIMQCLGAICGAGVVKGFQKGLYESNGGGANVVNHGYTKGDGLGAEIIGTFVLVYTVFSATDAKRNARDSHVPILAPLPIGFAVFLVHLATIPITGTGINPARSLGAAIIYNKSHAWHDHWVFWVGPFIGAALAAVYHQIVIRAIPFKSRS

SEQ ID NO: 15974 - protein, 287 aa, Schizosaccharomyces pombe
MSASKIAFLGPRGTFSHQAALLARPDSLLCSLPSFAGKLIFALKFILICFLAVLEALSSRQVDYAVLPIENSTNGAVIPAYDLLKGRDDIQAVGEVLVPAHHCIIGKSLENVQKILSHPQAFGQCSKWISANVPNAEFVSVSSTSQAAALASKDITGTIVAISSELCAVENQFNLLVKNIEDDSNNRTRFLLLRSGGFQDDLSPLKEKSLLQFYLSHPKKLSAVFEVFAAHKVVITNLVVRPSCKFPWTYIYFVECLGMEKHLIDRVGKYCDTFTFMGSYTNQISYF

SEQ ID NO: 15975 - protein, 467 aa, Caulophyllum thalictroides
SVGFKAGVKDYKLTYYTPDYVTKDTDILAAFRVTPQPGVPPEEAGAAVAAESSTGTWTTVWTDGLTSLDRYKGRCYHMEPVAGEDNQYIVYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALNKAQAETGEIKGHYLNATAGTCEEMIKRAVFARELGVPIVMHDYITGGFTANTTLAHYCRDNGLLLHIHRAMHAVIDRQKNHGIHFRVLAKALRMSGGDHIHSGTVVGKLEGERDITLGFVDLLRDDVIEKDRSRGIYFAQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTLD

SEQ ID NO: 15976 - protein, 358 aa, Cicer arietinum
VLGHGDRENISYPREVESLSGLRTVAGACGVWHTAAIVEVIVAQSSASISSGKLFTWGDGDKNRLGHGDKDARLEPTCVSALIDYNFHRIACGHSLTVGLTTSGHVFTMGSTVYGQLGNPQSDGKLPCLVEDKLAGECVEEIACGAYHVTVLTSKNEVYTWGKGANGRLGHGDIEDRKMPTLVEALKDRHVKYIACGSNYSAAICLHKWVSGAEQSQCSTCRQAFGFTRKRHNCYNCGLVHCHSCSSRKAFRAALAPNPGKPYRVCDSCYTKLIKIAESSNNNRRNGMPRFPGENKDRLEKSELRLLKPAVPSNMDLIKQLDSKAAKQGKKADTFSLVRTSQPPSMLQLKDVVLSTAM

SEQ ID NO: 15977 - protein, 477 aa, Listeria monocytogenes
MAKEYDVVILGGGTGGYVAAIQAAKNGQKVAVVEKGKVGGTCLHRGCIPTKALLRSAEVLQTVKKASEFGISVEGTAGINFLQAQERKQAIVDQLEKGIHQLFKQGKIDLFVGTGTILGPSIFSPTAGTISVEFEDGSENEMLIPKNLIIATGSKPRTLSGLTIDEEHVLSSDGALNLETLPKSIIIVGGGVIGMEWASMMHDFGVEVTVLEYADRILPTEDKEVAKELARLYKKKKLNMHTSAEVQAASYKKTDTGVEIKAIIKGEEQTFTADKILVSVGRSANTENIGLQNTDIATENGFIQVNDFYQTKESHIYAIGDCIPTIQLAHVAMEEGTIAANHIAGKAAEKLDYDLVPPLYLYFTSTEIASVGITEEQAKERGHEVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 15978 - protein, 267 aa, Bacillus subtilis
MFKLDLQPTEKLFIPFITAGDPVPEVSIELAKSLQKAGATALELGVAYSDPLADGPVIQRASKRALDQGMNIVKAIELGGEMKKNGVNIPIILFTYYNPVLQLNKEYFFALLQENHIDGLLVPDLPLEESNSLQEECKSHEVTYISLVAPTSESRLKTIIEQAEGFVYCVSSLGVTGVRNEFNSSVYPFIRTVKNLSTVPVAVGFGISNREQVIKMNEISDGVVVGSALVRKIEELKDRLISAETRNQALQEFEDYAMAFSGLYSLK

SEQ ID NO: 15979 - protein, 449 aa, Oceanobacillus iheyensis HTE831
MHMYQTTTLKDKIKLFIIILLPILITQVSINLMSFFDTMMSGQFSARDLAGVAIGSSLWVPILTGINGIVLSITPIIAHLIGAKNKKDIPQVIQQGIYLSFVLSIIIIVIGGIALDPILQAMSLEKEVQRIAKYYLITLGTGIVPLFLFHTIRSFMDGLGQTRSSMIIILISLPINAVLNYILIFGKFGIPAFGGIGAGIATSLTYWIISGISIFMIHRVYPFHSYKVFQKILPPTLSYWADQLKIGLPIGLAIFFETSIFSAVTLLMSEYNTNTIAAHQAAMNFASLLYMLPLSVGMALTIAVGFEVGAKRLHDAKRYTYLGIMGGLFIAIFAGIILYTFDDVVARLYNSNPEVIELTKQFIIFAIFYQLADAIGAPIQGALRGYKDVNMTLVIALISYWIIGLPTGYLLANYTALEPFGYWVGIIVGLSTGAIALLARLLFIQKKSV

SEQ ID NO: 15980 - protein, 315 aa, Aspergillus oryzae
MVLPTAPEPPTLLGYHRILSPSAGVRVSPLCLGTMSFGNGWKGVMGECDQATSFNMLDTFYESGGNFIDVANFYQGGDSERWVGEWMAQRQNRDEIVLSTKYTMGYTMFGPQKIKSNYQGNHTKSLRLSVKASLQKLQTDYIDLLYVHMWDFTTSVEEVMRSLNHLVANGKVLYLGVSDTPAWLVVKCNAFARANGLTPFSVYQGHWSCAFRDFERDILPMCESEGMGLAPWGVLGRGQFRSAEEFSREGRKMGPQDEKHRRLGEKLDQMAQQKNIKATSIAQAYVMHKAPYVFPVIGVARWSTSRRTLRLSAWY

SEQ ID NO: 15981 - protein, 208 aa, Populus alba x Populus tremula
LIAGGTESSAVTVEWAISEILRKPEVFEKATEELDRVIGRERWVEEKDMVNLPYIYAIAKEVMRLHPVAPMLVPRAAREDININGYDIKKGSRVLVNVWTIGRDPKVWDKPDEFFPERFIGNSIDVRGHDYELLPFGAGRRMCPGYPLGLKVIQATLSNLLHGFKWRLPDGQKKEDLNMDEIFGLSTPKKYPLVAVAEPRLPAHVYPK

SEQ ID NO: 15982 - protein, 465 aa, Apodytes dimidiata
VGFKAGVKDYKLTYYTPDYETKDTDILAAFRVTPQPGVPAEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 15983 - protein, 142 aa, Actinobacillus hominis
TQHIGAYHVETDDGKMITFLDTPGHAAFTSMRARGAKATDIVVLVVAADDGVMPQTIEAIQHAKAAGAPIVVAVNKIDKPEANPDRVEQELLQHEVISEKFGGDVQFVPVSAKKGLGIDDLLEAILLQSEVLELTAVKEGMA

SEQ ID NO: 15984 - protein, 142 aa, Actinobacillus capsulatus
TQHIGAYHVETDDGKMITFLDTPGHAAFTSMRARGAKVTDIVVLVVAADDGVMPQTIEAIQHAKAAGAPIVVAVNKIDKPEANPDRVEQELLQHEVISEKFGGDVQFVPVSAKKGMGIDDLLEAIILQSEVLELTAVKDGMA

SEQ ID NO: 15985 - protein, 466 aa, Cassinopsis ilicifolia
AGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTLD

SEQ ID NO: 15986 - protein, 142 aa, Actinobacillus pleuropneumoniae
TQHIGAYHVETEDGKMITFLDTPGHAAFTSMRARGAKATDIVVLVVAADDGVMPQTIEAIQHARAAGAPIVVAVNKIDKPEANPDRVEQELLQHEVVSEKFGGDVQFVSVSAKKGLGIDDLLEAILLQSEVLELTAVKEGMA

SEQ ID NO: 15987 - protein, 142 aa, Actinobacillus genomosp. 2
TQHIGAYHVETEDGKMITFLDTPGHAAFTSMRARGAKATDIVVLVVAADDGVMPQTIEAIQHARAAGAPIVVAVNKIDKPEANPDRVEQELLQHEVVSEKFGGDVQFVPVSAKKGLGIDDLLEAILLQSEVLELTAVKDGMA

SEQ ID NO: 15988 - protein, 142 aa, Actinobacillus suis
TQHIGAYHVETDDGKMITFLDTPGHAAFTSMRARGAKATDIVVLVVAADDGVMPQTIEAIQHAKAAGAPIVVAVNKIDKPEANPDLVEQELLQHEVISEKFGGDVQFVPVSAKKGLGIDELLEAILLQSEVLELTAVKEGMA

SEQ ID NO: 15989 - protein, 142 aa, Actinobacillus arthritidis
TQHIGAYHVETEDGKMITFLDTPGHAAFTSMRARGAKATDIVVLVVAADDGVMPQTIEAIQHAKAAGAPIVVAVNKIDKPEANPDRVEQELLQHEVISEKFGGDVQFVPVSAKKGLGIDELLEAILLQSEVLELTAVKEGMA

SEQ ID NO: 15990 - protein, 142 aa, Actinobacillus muris
TQHIGAYHVETDDGKMITFLDTPGHAAFTSMRARGAKATDIVVLVVAADDGVMPQTIEAIQHAKAANVPLVVAVNKIDKPEANPDRVETELLQHDVVAEKFGGEAQFVYVSAKKGTGVDELLDAILLQSEVLELTAVKEGMA

SEQ ID NO: 15991 - protein, 142 aa, Actinobacillus pleuropneumoniae
TQHIGAYHVETEDGKMITFLDTPGHAAFTSMRARGAKATDIVVLVVAADDGVMPQTIEAIQHARAAGAPIVVAVNKIDKPEANPDRVEQELLQHEVVSEKFGGDVQFVPVSAKKGLGIDDLLEAILLQSEVLELTAVKEGMA

SEQ ID NO: 15992 - protein, 142 aa, Actinobacillus pleuropneumoniae
TQHIGAYHVETDDGKMITFLDTPGHAAFTSMRARGAKATDIVVLVVAADDGVMPQTIEAIQHARAAGAPIVVAVNKIDKPEANPDRVEQELLQHEVVSEKFGGDVQFVPVSAKKGLGIDDLLEAILLQSEVLELTAVKDGMA

SEQ ID NO: 15993 - protein, 142 aa, Actinobacillus ureae
TQHIGAYHVETDDGKMITFLDTPGHAAFTSMRARGAKATDIVVLVVAADDGVMPQTIEAIQHAKAAGAPIVVAVNKIDKPEANPDRVEQELLQHEVISEKFGGDVQFVPVSAKKGLGIDELLEAILLQSEVLELTAVKEGMA

SEQ ID NO: 15994 - protein, 142 aa, Bisgaard Taxon 5
TQHIGAYHVETEDGKMITFLDTPGHAAFTSMRARGAKATDIVVLVVAADDGVMPQTIEAIQHAKAAGVPIVVAVNKIDKPEANPDRVEQELLQHEVIAEKFGGDTQFVYVSAKKGTGVDELLDAILLQSEVLELTAVKDGMA

SEQ ID NO: 15995 - protein, 333 aa, Oryza sativa
MGKPGKLALPSHESTIGKFLTQSGTFKDGDLLVNKDGLRIVSQSEEGEEPLDHNQLSLDDLDAIKVIGKGSSGIVQLVRHKWTGQFFALKVIQLNIQENIRRQIAQELKISLSTQCQYVVACCQCFYVNGVISIVLEYMDSGSLSDFLKTVLKGLMYLHHEKHIIHRDLKPSNILINHMGEVKISDFGVSAIIASSSAQRDTFTGTYNYMAPERISGQKHGYMSDIWSLGLVMLELATGEFPYPPRESFYELLEAVVDHPPPSAPSDQFSEEFCSFVSACIQKNASDRSSAQILLNHPFLSMYDDLNIDLASYFTTDGSPLATFNTSNRYDDR

SEQ ID NO: 15996 - protein, 344 aa, Rhododendron simsii
MKDVNGSPATTVCVTGAAGFIGSWLVMRLLERGYVVRATVRDPANIKKVKHLLELPKADSNLTLWKADLNEEGSFDEAIEGCFGVFHVATPMDFESKDPENEVIKPTINGVLSIIKSCTKAKTVKRLVFTSSAGTVNVQEHQQPVYDENNWSDLDFINEKKMTGWMYFVSKTLAEKAAWDAAKENNIDFISIIPVLVVGPFIMPTFPPSLVTALSPITGNEPHYSIIKQGQFVHLDDLCESHIFLFEHPEAEGRYICSSHDATIYDLAKMMREKWPEYNVPTEFKGIDKDIPKVSFSSEKLIGMGFKFKYSLEDMFRGAIDTCREKGLLPYSNATTANGTNGTI

SEQ ID NO: 15997 - protein, 465 aa, Pterostyrax hispidus
VGFKAGVKDYKLTYYTPEYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMLKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGILPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 15998 - protein, 142 aa, Pasteurella pneumotropica
TQHIGAYHVEMDDGKMITFLDTPGHAAFTSMRARGAKATDIVVLVVAADDGVMPQTIEAIQHAKAAGAPLVVAVNKIDKPEANPDRVEQELLQYEVISEKFGGDVQFVPVSAKQGLGIDDLLDAILLQSEVLELTAVKDGMA

SEQ ID NO: 15999 - protein, 142 aa, Pasteurella pneumotropica
TQHIGAYHVEMDDGKMITFLDTPGHAAFTSMRARGAKATDIVVLVVAADDGVMPQTIEAIQHAKAAGAPLVVAVNKIDKPEANPDRVEQELLQHEVISEKFGGDVQFVPVSAKQGLGIDELLDAILLQSEVLELTAVKDGMA

SEQ ID NO: 16000 - protein, 142 aa, Actinobacillus sp. CCUG 28015
TQHIGAYHVETNEGKMITFLDTPGHAAFTSMRARGAKATDIVVLVVAADDGVMPQTIEAIQHAKAAGAPIVVAVNKIDKPEANPERVEQELLQHEVISEKFGGDVQFVPVSAKKGLGIDDLLEAIVLQSEVLELTAVKDGMA

SEQ ID NO: 16001 - protein, 142 aa, Bisgaard Taxon 8
TQHIGAYHVETDDGKMITFLDTPGHAAFTSMRARGAKATDIVVLVVAADDGVMPQTIEAIQHAKAAGAPLVVAVNKIDKPEANPDRVEQELLQHEVISEKFGGDVQFVPVSAKKGLGIDDLLEAIILQSEVLELTAVKDGMA

SEQ ID NO: 16002 - protein, 1165 aa, Streptococcus pyogenes
MKKKVNQGSKRYQYLLKKWGIGFVIAATGTVMLGCIPSILTHQVAAKTIVGLARDEAQQGDGNAKSGDGFQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHIPLLTPKMNEVWIDENYHAHAYRPLKKGYLRINYHNQSGHYDNLAVWTFKDVKTPTTDWPNGLDLSHKGPYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDKDKSVMTLKGDFKAQGAVYTVTFGEVSQVARQSWQLKDKLYAYDGELGATLAKDGSVDLALWSPSADSVKVVVYDKQDQTKVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKTRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPSNFEADAPGDVVQYIAAHDNLTLHDVIAKSINKDPKVAEEEIHKRIRLGNTMILTAQGTAFIHSGQEYGRTKQLLNPDYKTKVSDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLADAEQVGVTAIAKPKGVQFTKEGLTIDGLTALVLKVSSKTANPSQQKSQTDNHQTKTPDGSKDLDKSLMTRPKRAKTNQKLPKTGEAPSKGLLAAGVALLLLAISLLMKRQKD

SEQ ID NO: 16003 - protein, 499 aa, Clarkia lingulata
  misc_feature (291)..(296): Xaa can be any naturally occurring amino acid
MASPALISETEAWKDLKAHLEGIKMTHLRELMGDTERCQSMMVEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYXXXXXXKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSVSILLPTLDAYRIGQLLAIYEHRVAVQG

SEQ ID NO: 16004 - protein, 499 aa, Clarkia lingulata
  misc_feature (291)..(296): Xaa can be any naturally occurring amino acid
MATPALISDTEAWKDLKAHLEGIKHTHLRELMGDTERCQSMMVEFDNIFLDYSRQQASPDTINKLYKLAEAAHLKQKIDSMYNGDHINSTEHRSVLHVTLRAPRNSAICSDGKNVVPDVWNVLDKIKDFSERVRNGSWVGATGKELKNVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYXXXXXXKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQG

SEQ ID NO: 16005 - protein, 499 aa, Clarkia heterandra
  misc_feature (221)..(231): Xaa can be any naturally occurring amino acid
MASPALISETEAWKDLKAHLEGIKMTHLRELMGDTERCQSMMVEFDNIFLDYSRQQASPDTISKLYKLADAAHLKQKIDRMYNGDHINSTENRSVLHVALRAPRNSAICSDGKNVVPDVWNVLDKIKNFSDRVRNGSWIGATGKELKDVIAVGIGGSFLGPLFVHTALQTDPEASKNARGRELRFLANVDPIDVARNISGLNPETTLVVVVSKTFTTAETXXXXXXXXXXXSSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSISILLPTLDAYRIGQLLAIYEHRVAVQG

SEQ ID NO: 16006 - protein, 380 aa, Clarkia dudleyana
MASPALISETEAWKDLKAHLEGIKTTHLRELMGDTERCQSMMVEFDNIFLDYSRQQASPDTISKLYKLADAAHLKQKIDRMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSSVAKHMVAVSTNIPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 16007 - protein, 380 aa, Clarkia dudleyana
MATPSLISETEAWKDLKAHLEGIKRTHLRELMGDTERCQSMMVEFDNIFLDYSRQQAAPDTINKLYKLADAAHLKQKIDRMYNGDHINSTENRSVLHVALRAPRSSAICSDGKNVVPDVWNVLDKIKDFSERVRSGSWVGATGKELKDVIAVGIGGSFLGPLFAHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 16008 - protein, 380 aa, Clarkia dudleyana
MATPALISETEAWKDLKAHLEGIKRTHLRESMGDTERCQSMMVEFDNIFLDYSRQQASPDTINKLYKLADAAHLKQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 16009 - protein, 461 aa, Bacillus subtilis
MKKDTRKYMIYFFGALGGLLYGYDTGVISGALLFINNDIPLTTLTEGLVVSMLLLGAIFGSALSGTCSDRWGRRKVVFVLSIIFIIGALACAFSQTIGMLIASRVILGLAVGGSTALVPVYLSEMAPTKIRGTLGTMNNLMIVTGILLAYIVNYLFTPFEAWRWMVGLAAVPAVLLLIGIAFMPESPRWLVKRGSEEEARRIMNITHDPKDIEMELAEMKQGEAEKKETTLGVLKAKWIRPMLLIGVGLAIFQQAVGINTVIYYAPTIFTKAGLGTSASALGTMGIGILNVIMCITAMILIDRVGRKKLLIWGSVGITLSLAALSGVLLTLGLSASTAWMTVVFLGVYIVFYQATWGPVVWVLMPELFPSKARGAATGFTTLVLSAANLIVSLVFPLMLRPMGIAWVFMVFSVICLLSFFFAFYMVPETKGKSLEEIEASLKKRFKKKKSTQNQVLNERTL

SEQ ID NO: 16010 - protein, 183 aa, Lactococcus lactis
LIFYDELFDELLLNGIEPVITLSHFEIPYHLYTEYGGFRNKKMIDFFVNYAEVVLKRYKNKVKYWMTFNEINNQADGQSSLHVWTNSAIRLKDDDIKEEVVFQASLNELIAADKVVKLAHDISPNFQIGCMMAYVPVYAYSCNPTDAREAIKVMERRYFYSDIHVRGHIPKYTLNYWHNKHYH

SEQ ID NO: 16011 - protein, 274 aa, Nicotiana tabacum
MGGPKLMYSFFFLFIIFATIIPCLMAHIGDFDEVWRRRAEEAREYARQIYEPNPENVTLAFNQKVRDSMKEVTVSNNSTRRGLGTKKYKGPCMVTNPIDRCWRCDPNWADNRKRLADCAMGFGSKATGGKDGEIYIVTDNSDDYAEPKPGTLRYAVIQKEPLWIIFERSMTIRLHQELIMQSDKTIDARGANVHIAKGAGITLQYIKNVIIHGLHIHDIVEGSGGMVRDAVDHIGIRTVSDGDGISIFGASNIWIDHVSMRKCYDGIIDAVEGS

SEQ ID NO: 16012 - protein, 171 aa, Nicotiana tabacum
TAITISNGHFTDHNEVMLFGASDSSSIDQVMQITLAFNHFGKRLVQRMPRCRWGYIHVVNNDYTHWNMYAIGGSMHPTIITQGNRFIAPPDIFKEQVTKREYNPEEVWKHWTWRSEGNLFMNGAYFIESGDPDWSKKHKELYDGISAAPAEEVTWITRFAGALGCKKGKAC

SEQ ID NO: 16013 - protein, 433 aa, Borrelia burgdorferi
MGFHIYEIKARQIIDSRGNPTVEADVILEDGTYGRAAVPSGASTGINEAVELRDGDKSVYMGKGVLKAIENIKNIIAPELEGMSALNQVAIDRKMLELDGTPTKEKLGANAILAVSMATAKAAAKYLGLRPYQYLGAYKANILPTPMCNIINGGAHSDNSVDFQEFMIMPIGAKTFSEAIRMAAEVFHTLKGILSGKGYATSVGDEGGFAPNLKSNEEACEVIIEAIKKAGYEPGKDIAIALDPATSELYDPKTKKYVLKWSTKEKLTSEQMVEYWAKWVEKYPIISIEDGMAEEDWDGWKKLTDKIGNKIQLVGDDLFVTNTSFLKKGIEMGVANSILIKVNQIGTLTETFEAVEMAKKAGYTAIVSHRSGETEDTTIADLVVALGTGQTKTGSLSRTDRIAKYNQLIRIEEELETTAEYHGKSVFYSIKQK

SEQ ID NO: 16014 - protein, 335 aa, Nicotiana tabacum
MVHEKQVIEEVSGWLTVFEDGSVDRTLTGPPEDKFMAEAVPPHDDFIDGVADKDVVADENSGSRLRIYLPERNDNSVNKLPVILHFHGGGFCISQADWFMYYTVYTRLARVANAIIVSVFLPLAPEHRLPAACDAGFAALLWLRELSRQQGHEPWLNNYADFNRVFLIGDASGGNIVHQVAVRAGEENLSPLRLAGAIPIHTGFVRSYRSKSELEQEQTPFLTLDMVDKFLGLALPVGSNKDHPITCPMGEAAPAVEELKLPPYLNCVAEKDLMKDTEMEFYEAMEKGEKDIELFINNGVGHSFYLNKTAVEIDPVTASETEKFLEAVAEFINKR

SEQ ID NO: 16015 - protein, 354 aa, Hordeum vulgare
MDGNKGPVVVTGASGFVGSWLVMKLLQAGYTVRATVRDPANVEKTKPLLELPGAKERLSIWKADLSEDGSFNEAIAGCTGVFHVATPMDFDSQDPENEVIKPTVEGMLSIMRACKEAGTVKRIVFTSSAGSVNIEERPRPAYDQDNWSDIKYCRRVKMTGWMYFVSKALAEKAAMEYASENGLDFISIIPTLVVGPFLSAGMPPSLVTALALITGNEAHYSILKQVQLVHLDDLCDAMTFLFEHPEANGRYICSSHDATIHGLARMLQDRFPEYDIPQKFAGVDDNLQPIHFSSKKLLDHGFSFRYTTEDMFDAAIHTCRDKGLIPLGDVPAPAAGGKLGALAAGEGQAIGAET

SEQ ID NO: 16016 - protein, 475 aa, Mastopoma subfiliferum
MSPQTETKAGVGFKAGVKDYRLTYYTPDYQTKETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQSETGEIKGHYLNATAGTSEEMLKRAQFARELGMPIIMHDYLTGGFTANTSLAHYARDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQSGGGTLGHPWGNAPGAVANRVALEACVQARNEGRDLAREGNEIIREAAKWSPELAAACEVWKEIKFEFDTIDTI

SEQ ID NO: 16017 - protein, 475 aa, Mastopoma uncinifolium
MSPQTETKAGVGFKAGVKDYRLTYYTPDYQTKATDILAAFRMTPQPGVPAEEAGAAVAAESSTGTWTTVWTDGLTSLDRYKGRCYDLEAVPGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTSEEMLKRAQFARELGMPIIMHDYLTGGFTANTSLAHYARDNGLLLHIHRAMHAVIDRQKNHGMHFRVLAKALRLSGGDHIHAGTVVGKLEGERQVTLGFVDLLRDDYIEKDRSRGIYFTQDWVSLPGILPVASGGIHVWHMPALTEIFGDDSVLQFGGGTLGHPWGNAPGAVANRVAVEACVQARNEGRDLAREGNEIIREAAKWSPELAAACEVWKEIKFEFDTIDTI

SEQ ID NO: 16018 - protein, 475 aa, Sematophyllum pulchellum
  misc_feature (251)..(251): Xaa can be any naturally occurring amino acid
MSPQTETKASVGFKAGVKDYRLTYYTPDYQTKDTDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQSETGEIKGHYLNATAGTSEEMXKRAQFARELGMPIIMHDYLTGGFTANTSLAHYARDNGLLLHIHRAMHAVIDRQKNHGMHFRVLAKALRLSGGDHIHAGTVVGKLEGERQVTLGFVDPLRDDYIEKDRSRGIYFTQDWVSLPGVLPVASGGIHVWHMPALTEIFGDDSVLQFGGGTLGHPWGNAPGAVANRVAVEACVQARNEGRDLAREGNEIIREATKWSPELAAACEVWKEIKFEFDTIDTL

SEQ ID NO: 16019 - protein, 475 aa, Trismegistia perundulata
MSPQTETKAGVGFKAGVKDYRLTYYTPDYQTKETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQSETGEIKGHYLNATAGTSEEMLKRAQFARELGMPIIMHDYLTGGFTANTSLAHYARDNGLLLHIHRAMHAVIDRQKNHGMHFRVLAKALRLSGGDHIHAGTVVGKLEGERQVTLGFVDPLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPDLAAACEVWKEIKFEFDTIDTI

SEQ ID NO: 16020 - protein, 475 aa, Thuidium pristocalyx
MSPQTETKAGVGFKAGVKDYRLTYYTPDYQTKDTDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQGETGEIKGHYLNATAGTSEEMMKRAQFARELGMPIIMHDYLTGGFTANTSLAHYARDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVAVEACVQARNEGRDLAREGNEIIREATKWSPELAAACEVWKEIKFEFETIDTI

SEQ ID NO: 16021 - protein, 432 aa, Enterococcus hirae
MSIITDVYAREILDSRGNPTIEVEVYTESGAFGRGMVPSGASTGEYEAVELRDGDKARYGGKGVTKAVDNVNNIIAEAIIGYDVRDQMAIDKAMIALDGTPNKGKLGANAILGVSIAVARAAADYLEVPLYHYLGGFNTKVLPTPMMNIINGGSHADNSIDFQEFMIMPVGAPTFKEALRMGAEVFHALAAILKSRGLATSVGDEGGFAPNLGSNEEGFEVIIEAIEKAGYVPGKDVVLAMDAASSEFYDKEKGVYVLADSGEGEKTTDEMIKFYEELVSKYPIISIEDGLDENDWDGFKKLTDVLGDKVQLVGDDLFVTNTQKLSEGIEKGIANSILIKVNQIGTLTETFEAIEMAKEAGYTAVVSHRSGETEDSTISDIAVATNAGQIKTGSLSRTDRIAKYNQLLRIEDQLGEVAEYKGLKSFYNLKAA

SEQ ID NO: 16022 - protein, 155 aa, Neisseria meningitidis
EAKKIIDEGGLVRDDIIIGMVKERIAQDDCKNGFLFDGFPRTLAQAEAMVEAGVDLDAVVEIDVPDSVIVDRMSGRRVHLASGRTYHVTYNPPKVEGKDDVTGEDLIQRDDDKEETVKKRLAVYHEQTEVLVDFLQQTGRRTRAKYIKVDGTQPV

SEQ ID NO: 16023 - protein, 155 aa, Neisseria meningitidis
EAKKIIDEGGLVRDDIIIGMVKERIAQDDCKNGFLFDGFPRTLAQAEAMVEAGVDLDAVVEIDVPDSVIVDRMSGRRVHLAFRPYLPRYLHPPKVEGKDDVTGEDLIQRDDDKEETVKKRLAVYHEQTEVLVDFYSKLEGEHAPKYIKVDGTQAV

SEQ ID NO: 16024 - protein, 155 aa, Neisseria meningitidis
EAKKIIDEGGLVRDDIIIGMVKERIAQDDCKNGFLFDGFPRTLAQAEAMVEAGVDLDAVVEIDVPDSVIVDRMSGRRVHLASGRTYHVTYNPPKVEGKDDVTGEDLIQRDDDKEETVKKRLAVYHEQTEVLVDFYSKLEGEHAPKYIKVDGTQAV

SEQ ID NO: 16025 - protein, 155 aa, Neisseria meningitidis
EAKKIIDEGGLVRDDIIIGMVKERIAQDDCKNGFLFDGFPRTLAQAEAMVEAGVDLDAVVEIDVPDSVIVDRMSGRRVHLASGRTYHVTYNPPKVEGKDDVTGEDLIQRDDDKEETVKKRLAVYHEQTEVLVDFYSKLEGEHAPKYIKVDGTQPV

SEQ ID NO: 16026 - protein, 208 aa, Kluyveromyces lactis
MSQAVGNVASIRRKLVIVGDGACGKTCLLIVFAKGKFPQVYVPTVFDNYVADVEVDGRRVELALWDTAGQEDYDRLRPLSYPDSNVVLICYSIDLPDSLENVMEKWISEVLHFCQGVPIILVGCKADLRNDPQVVEELRAQGLQPVSQAQAQEVADQIGAVDYIECSAKTGYGVREVFEAATRASLVGKQGKSKPKTKSSKKKKCVVL

SEQ ID NO: 16027 - protein, 1230 aa, Candida albicans
MSILSENNPTPTSITDPNESSHLHNPELNSGTRVASGPGPGPEVESTPLAPPTEVMNTTSANTSSLSLGSPMHEKIKQFDQDEVDTGETNDRTIESGSSDIDDSQQSHNNNNNNNNNNNESNPESSEGDDEKTQGMPPRMPGTFNVKGLHQGDDSDNEKQYTELTKSINKRTSKDSYSPGTLESPGTLNALETNNVSPAVIEEEQHTSSLEDLSLSLQHQNENARLSAPRSAPPQVPTSKTSSFHDMSSVISSSTSVHKIPSNPTSTRGSHLSSYKSTLDPGKPAQAAAPPPPEIDIDNLLTKSELDSETDTLSSATNSPNLLRNDTLQGIPTRDDENIDDSPRQLSQNTSATSRNTSGTSTSTVVKNSRSGTSKSTSTSTAHNQTAAITPIIPSHNKFHQQVINTNATNSSSSLEPLGVGINSNSSPKSGKKRKSGSKVRGVFSSMFGKNKSTSSSSSSNSGSNSHSQEVNIKISTPFNAKHLAHVGIDDNGSYTGLPIEWERLLSASGITKKEQQQHPQAVMDIVAFYQDTSENPDDAAFKKFHFDNNKSSSSGWSNENTPPATPGGSNSGSGSGGGGAPSSPHRTPPSSIIEKNNVEQKVITPSQSMPTKTESKQSENQHPHEDNATQYTPRTPTSHVQEGQFIPSRPAPKPPSTPLSSMSVSHKTPSSQSLPRSDSQSDIRSSTPKSHQDVSPSKIKIRSISSKSLKSMRSRKSGDKFTHIAPAPPPPSLPSIPKSKSHSASLSSQLRPATNGSTTAPIPASAAFGGENNALPKQRINEFKAHRAPPPPPSAPPAPPVPPAPPANLLSEQTSEIPQQRTAPSQALADVTAPTNIYEIQQTKYQEAQQKLREKKARELEEIQRLREKNERQNRQQETGQNNADTASGGSNIAPPVPVPNKKPPSGSGGGRDAKQAALIAQKKREEKKRKNLQIIAKLKTICNPGDPNELYVDLVKIGQGASGGVFLAHDVRDKSNIVAIKQMNLEQQPKKELIINEILVMKGSSHPNIVNFIDSYLLKGDLWVIMEYMEGGSLTDIVTHSVMTEGQIGVVCRETLKGLKFLHSKGVIHRDIKSDNILLNMDGNIKITDFGFCAQINEINSKRITMVGTPYWMAPEIVSRKEYGPKVDVWSLGIMIIEMLEGEPPYLNETPLRALYLIATNGTPKLKDPESLSYDIRKFLAWCLQVDFNKRADADELLHDNFITECDDVSSLSPLVKIARLKKMSESD

SEQ ID NO: 16028 - protein, 346 aa, Cucurbita maxima
MDKLPAVGLLTPLDLNTVEAVPESHVWPHLDESSQKFKSDKTVSIPVVDFNDDNVLELIGKACEEWGMFQLINHGIPKTLTAETEEVARCLFALPKSQKMKTLNVPGTANGYCMARLTKHHDKMMWHEGFTVIGSPVDDFKKLWPSDYQPFCDKVEEYQLKMKALADKLISLIFKYLGISDEEMVKKLSYIDPATGKPHLALRLNSFPPCPEPSKVMGLAAHTDTSLFTMLHQARREGLQILNEKEGWLPLAPRRDALIINIGDFLQIISNGRFHSVPHRVMIRETEKTTMSMAYFFHPPGHLYVAPYCKPLSETLQTPIYKGVNVKEYFIIKAKASGKGIAALTI

SEQ ID NO: 16029 - protein, 294 aa, Allium cepa
MDQYEKVEKIGEGTYGVVYKARDRLTNETIALKKIRLEQEDEGVPSTAIREISLLKEMQHANIVRLQDVVHSEKRIYLVFEYLDLDLKKHMDSCPDFAKDSRLAKTFLYQLLRGIAYCHSHRVLHRDLKPQNLLIDRRTNSLKLADFGLARAFGIPVRTFTHEVVTLWYRAPEILLGARQYSTPVDIWSVGCIFAEMVNQRPLFPGDSEIDELFKIFRIMGTPNEDTWPGVTSLPDFKSAFPKWPAKDLATIVPKLDSAGIDLLYKMLHLEPSKRITARKALEHEYFRDLGTIP

SEQ ID NO: 16030 - protein, 494 aa, Medicago truncatula
MAASPAYQAHLPTSPEWLNKGDNAWQMTAATLVGLQSMPGLVILYASIVKKKWAVNSAFMALYAFAAVLICWVLVAYRMAFGDELLPFWGKGAPALGQKFLVARAKVPASTHYYKNGVDIETPMEEPFFPMASLVYFQFTFAAITMILLAGSVLGRMNIKAWMAFVPLWLIFSYTVGAFSLWGGGFLYHWGVIDYSGGYVIHLSSGIAGFTAAYWVGPRIKSDRERFPPNNVLLMLAGAGLLWMGWSGFNGGAPYAANVASSIAVLNTNICAATSLLVWTSLDVVFFGKPSVIGAVQGMMTGLVCITPGAGLVQSWAAIVMGILSGSIPWVSMMILHKKSSLLQKVDDTLGVFHTHAVAGLLGGLLTGLFAEPALCRLLLPVTNSRGAFYGGSGGMQLLKQLVAAMFVIGWNIVSTTIILLVIQLFIPLRMPDEQLEIGDDAAHGEEAYALWGDGEKYDPTRHGSLNTGNTGVSPYVNGARRCDYKFMSHNLQV

SEQ ID NO: 16031 - protein, 401 aa, Pichia angusta
MSQPSLTDTNLFKPIKVGNVELKHGFFSAPTTRFRASDDFVPTDSMLSYYEQRAENNGGLIVAEATFPDYSFGLYPNAPMIKTPEQVAAWKKIVDAVHKQGSFFSIQLWHLGRVAVPQLNKKYNVPLVGPSKLYVDESSEKAAKEAGNELHELTIPEIEAIVKEFAAGAKRVVDEAKADFVEILAGGGYLLDQFNHSNINKRTDKYGGSIENRARLILEVVDACIEAVGAEHVGIKLSPYAAVNGLQGVDTEIHPISRYGYILSELERRGKEGKRIAYITMIEPRVNGTEDSKDTRAFDSSWVGEIWKSTLLRAGAYLNQFSNYLIQDVNKDDRTLIGAARYFTSNPDLIERLRKGQELTPYDRSKFYTPATNDGYITWTKYGEDPEKYKGLVAVKPQPLS

SEQ ID NO: 16032 - protein, 402 aa, Pichia angusta
MTPSTSLASSNLFKPIKVGKVELKNRLVFAPTTRYRASKDFVPTDSMLKYYEQRAENNGGLLTAEATYVDFNFGLYPFTPMIKTPAQVAAWAKIIEAVHKQGSYFSIQLWHLGRAADPKFNKEKGVPFVAPSAIYLDQDSEKAAREAGNELRELTIPEIEAIVKEFAAAAKRAIHEAKADFIELHSAHGYLLDQFIQPNINKRTDKYGGSIENRARLVLEVVDACIEAVGAEHVGIRLSPYAKFQGSEGVDSEINPIASFGYILSELEKRARDGNRLAYVSVVEPRVSGNVDSNDQRKFDTSWIREIWKGILFRAGGYLKENEQSLEHDVNQDDRTLIGVSRYYTSNPDLVERLKKGLSLTPYDRSRFYNHSSNDGYLTWPKYGEDEEKYKAVLDVEPKALA

SEQ ID NO: 16033 - protein, 402 aa, Pichia angusta
MSKTPTLANTNLFKPIKVGKVELKNRLVFAPTTRYRASKDFVPTDSMLKYYEQRAENNGGLLVTEATYPDYSFGLYPDTPMIKTPAQVAGWKKVIEAVHNKGSFVSIQLWHLGRTASAEFNKSKGLPLVGASPIYMDEDSEKAAKEAGNELRALTIPEIENIVTEYAAAAKRAIHEAKADFIELHGAHGYLLDQFNQPGSNKRTDKYGGSIENRARLILEAVDACIEAVGAEHVAIRLSPYAAVQGIKGVDSEIHPISYFGYVLSELERRAQEGKRLAYISVVEPRVNGIYDSKDKREFNTSWISEIWKGVLLRSGAYLNENYKFLQHDVDENDRTLIGVSRYYTSNPDLADRLKNGHELTPYDRSKFYKHSSNDGYLTWTRYGEKEPQYKDLVDVAPEPLA

SEQ ID NO: 16034 - protein, 378 aa, Dunaliella salina
MAFALRTGVAPSVLPRGQSRRQMVCRAGKFDEELMKTARTIASPGRGILAMDESNATVGKRLDSIGLENSEANRQAYREMLVSTKGLGQYISGAILFEETLYQSGSNGKRMTDMLVENGIVPGIKVDKGLAPLANSNNEQWAMGLDGLDKRCAEYHKAGARFAKWRSVVSIPNGPSPIAVRETAYGLARYAAICQNNGLVPIVEPEILLDGDHDINRCLAVFEDVWAETFKYLADNKVLFEGILLKPSMVTPGAESPARATPQQVAEMTLIGLKRRVPPAVPGIMFLSGGQSELEATLNLQEMNRQPNPWHVSFSYARALQNTVLKTWQGKPENVPKAQEALLKRAKANSDAQRGQYDPATEGSTEAAQSMYQEGYSY

SEQ ID NO: 16035 - protein, 399 aa, Bordetella pertussis
MAQIVLFENIHPSARAVFSAAGYTDIVAHAAALPSGELREALRGAEVVGIRSRTHLDADLLAANPDLRVVGCFCIGTNQVDLDAAMMRGVPVFNAPFSNTRSVAELVLGETILLLRRIPEKNARVHLGHWDKSAAGAYEARGKTLGIVGYGNIGSQISTLAEAIGMRVVFFDVEAKLPLGNARAAGSLAELLEQADVVTLHVPGGKSTQNIVNADTLARMKRGAILINASRGTVVDIQALHDALASGHLAGAALDVFPTEPKSADEPLASPLIGMPNVVLTPHIGGSTQESQENIGREVAEKLVRFLQAGTTKSAVNFPELSYQAPVGGSRIIHVHRNAPGALGALDNLMAQHGLNIVSQSLQTKGQIGYAVTDVDGEVSDTVLADLRSHPVTVRCEKL

SEQ ID NO: 16036 - protein, 324 aa, Bordetella pertussis
MPSRRPPPAAADGHSIGHSWRTLSAQVRQLYAGWDPNTDIARIRRDWDAFFGAVRLPARVTPVDAGGVPCHWIEAPASTRDRVVVFIHGGGYQIGSHRSHHNLMARLSAWSGRAVLSIGYRLAPQARCPAALEDVDAAHAWLAGQGWSARQTALCGDSAGGALAVLLLARLRARGAALPAACAVMSPWIDLQARGESYTANAASDPIANRATVLRMARAYLGRDGDPEAPAVSAQHADLRGLPPLLVQAGSAEALLDDARALAARAAASGVAVRLSVWQDMPHVFQLFAARLDAADAAIAELADFINHPLRAPTGAEPRHETST

SEQ ID NO: 16037 - protein, 494 aa, Sphingomonas sp.
MTSVSSSPITDTILNFIDGSYREGSEGKSFSNVNPATGAEIGVVHEASQADVADAVAAAKAALTGPWGKMTTAERVKLITAVATEIERRADDFLAAEVADTGKPRHVASHIDIPRGAANFRMFADVVSTMPGESFNTPTPDGGQAFNYTVRKPKGVVAVVCPWNFPLLLMTWKVGPALACGNTVVVKPSEETPRTAALLGEVMNAVGMPKGVYNVVHGFGPGSAGEFLTSNPDVDAITFTGETGTGQAIMQKAATGVRDISFELGGKNPAIVFADADLDKAVEGLSRSVFLNTGQVCLGTERVYVERPIFDAFVARMAAAAQDFKPGVTGDRAYLGPLISAEHREKVLGYYRRAVEDGATVVTGGGVPEISGAEAGGFFVEPTLWIDVAHGDTVMREEIFGPCCGILPFDSEDEVIALANDTVYGLCASVWTENLSRGHRVAAAMEVGVCWVNSWFLRDLRTAFGGSGHSGIGREGGVHSLEFYTEITNICVKL

SEQ ID NO: 16038 - protein, 312 aa, Pseudomonas fluorescens
MYLVCGEALFDFFSEEDASGQASKVTYKAIAGGSPFNVAVGLRRLGIEAGLFGGLSSDFLGRRLLQVLKDEGVSERFLVEFAAPTTLSMVAVGADGSPQYNFRGEGCADRLLEVAHLPVLGDEVRGLHIGSFSLVVQPIGDTLLSLVKRESGKRLISLDPNVRLNPQPDIQLWRDRVAELAKHADLIKVSDEDLHLLYPGQSPESVLQGWLQHRCQLVFLTRGGDGASVFSRQHGTWSQPAQRVVMADTVGAGDTFQAALIAWLTEHQLDSVQGLQQLTRVQIDAMLGFAIRAAALTCGKTGPDLPYRQQLG

SEQ ID NO: 16039 - protein, 161 aa, Oryza sativa (indica cultivar-group)
  misc_feature (156)..(156): Xaa can be any naturally occurring amino acid
  misc_feature (160)..(160): Xaa can be any naturally occurring amino acid
MAAPDVEYRCFVGGLAWATDDRSLEAAFSTYGEILESKIINDRETGRSRGFGFVTFSSEQAMRDAIEGMNGKELDGRNITVNEAQSRRSGSGSGGGYGQRGGSGSYGGGGYGGGGGGGGYCQRRESGYRGGGGYRGGRGGGNYRGGYGSRGGGNSXGNWXN

SEQ ID NO: 16040 - protein, 321 aa, Stellaria longipes
MENFPIINMENIERKNTRDMIKDACENWGFFELVNHGIPHSLLDKMEKLTKDHVRKCLEERFKEMVASKGLEAVEAEVTDLDWESIFFLKHLPVSSISELPDLDEEYREVMIDFSKRKEKKAETKKDKKCENKGKEKSYLKNTFYGSKGPNFGTSVSNYPPLPKPDLIKGLSAHTDAGGIILLSEDDKVSGLELLKDGDWIDVPPMRHSIVVNLGDELEVITNGKYWSVEHRVQIDTNITRMSTASFYVPGNDRVIAPAEALPKEFKKDEVYPKFVFKSYMKAYAKLIRQSGLKFEAKEPRFEAMKAHRIGSSCNSHLEHD

SEQ ID NO: 16041 - protein, 248 aa, Rhodobacter sphaeroides 2.4.1
MIELSGVTKSFGANQVLRGIDLRVESNSSMVIIGGSGTGKSVLLKCILGLVHPDRGQILLNDEDVTRAERDAFLARFGMLFQGAALFDSLHVWENVAFRLLRGAQKRPKAEAREIAIEKLRRVGLGPQVADLYPAELSGGMQKRVGLARAIAADPEIIFFDEPTTGLDPIMAGVINDLIREIVTEMGATAMTITHDMTSVRAIADNVAMLHRGKIRWTGPVSELDTTPDPYVQQFIHGRAEGPIEALR

SEQ ID NO: 16042 - protein, 442 aa, Rhodobacter sphaeroides 2.4.1
MPGHIFGRSTRGSLPVAAEGEGCYILDTEGRRYLDGSGGAAVSCLGHSNAAVRAALHDQLDRLAFAHTGFFTSEPAERLADRLAAAAPEGIERVYLVSGGSEAVEAALKLARQYFMEVGQPGRHRVIARRQSYHGNTLGALAAGGNEWRRAQFAPLLVETSHVSPCYEYRGRAEDESLEAYGLRVADELEAEIQRLGPETVMAFVAEPVVGATAGAVPAVPGYLKRVREICDRHGVLLILDEVMCGMGRTGHLFACAEDGVAPDMITIAKGLGAGYQPIGALLVQGRIYDAIAAGSGFFQHGHTYMGHAMAAAAANAVLDEIEGRDLLQAVRRQGARLEALLQERLGQHPHVGDIRGRGLFRGIELVADRETKEPFDPARKLHARIKAEAFAGGLICYPMGGTLDGVRGDHILLAPPFIISDAELDELVDKLSGALDRALAA

SEQ ID NO: 16043 - protein, 282 aa, Rhodobacter sphaeroides 2.4.1
MHLGCPHHWRFGAEGESEAEFCARLLREAEETILAEGPETVAAFIGEPVMGAGGVIVPPDGYWSGIEALCRKYDILLVSDEVINGFGRTGARWGCEKFGFTPDILVTSKQLTSSYMPLAAVLMTDKVYQTIADHTETLGTLGHGFTGSGHPVATAVGLENLTVIEERDLMGNAARLERPFQDGLRAFRDNPLVGEVRGTGLIAAIEMVADRATKRSFEPLGKVGARAAAFAAEEGLLCRALGDTLALCPPLIVTEADVGRILERMGRALDRTADWARAEGLI

SEQ ID NO: 16044 - protein, 186 aa, Rhodobacter sphaeroides 2.4.1
MQEGAMPTRPYVIDQLISPKQIAARVEVLARQITEHFAETEKLVVVGLLRGSFVFIADLVREIHLPVEVDFLEASSYGDAMTSSREVRILKDLRGEIAGRDVLVVEDIVDTGFTLSHVVRLLRSREPKRLEVCALLDKPSRREVDIRATWTGFEIPDEFVVGYGIDFAQRNRNLPFIGKVRFLEEG

SEQ ID NO: 16045 - protein, 425 aa, Rhodobacter sphaeroides 2.4.1
MSTIIDIHAREILDSRGNPTVEVDVTLESGAFGRAAVPSGASTGAHEAVEKRDGDKSRYMGKGVLEAVAAVNGEIAEMLVGFDATEQVGIDRTMIEMDGTPNKGRLGANAILGVSLAVAKAAAEFTNQPLFRYVGGSSARVLPVPMMNIINGGEHADNPIDIQEFMIMPVAAQNVREAIRMGSEVFHTLKKELAAGGFNTGIGDEGGFAPNISSTREALDYILRSIEKAGYKPGEDIYLALDCASTEYFKGGKYEMKGEGKSLTSAENVDYLAALCADYPIISIEDGCAEDDWEGWKLLTDKLGAKVQLVGDDLFVTNPKRLEQGIKAGVANSMLVKVNQIGSLTETLMAVDMAHRARYTNVMSHRSGETEDATIADLAVATNCGQIKTGSLSRSDRLAKYNQLIRIEEMLGEVAEYAGRSILKV

SEQ ID NO: 16046 - protein, 452 aa, Rhodobacter sphaeroides 2.4.1
MAKSSPVFTCQTCGAVHRKWAGRCDACGAWNSIVEETPLSSGPKALGSKGRTIALSDLATEEAAPPRTSSGIDELDRVLGGGLVPASAILVGGDPGIGKSTLLLQAAASFANGGVKCLYISGEEAAAQVRMRAQRLGLGQAPVALGAETNLRDILTTLDAERPALAIIDSIQTMWLDNVESAPGSVAQVRASAHELVTFAKRRGVAIVIVGHVTKEGQIAGPRVVEHMVDTVLYFEGERGHQFRILRAVKNRFGPADEIGVFEMTGGGLAQVANPSALFLSDRDQPAPGSAVFAGIEGTRPVLTEIQALVSPSPLGTPRRTVVGLDSGRLSTILAVLEARCGIPFAGLDVFLNVAGGMRVSEPAADLAVAAALVSAREDVAIPPDMVLFGEISLSGALRPVAQTESRLKEASKLGFSQAIAPTRSKVGQDEGMRVRQMPDLAAFVGEMFGAG

SEQ ID NO: 16047 - protein, 320 aa, Rhodobacter sphaeroides 2.4.1
MSVLPTDSLSTPRFVGLPSFMRLPMATELQGLDAAIVGLPSDSGAPFRTGARFAPNALRAMSVMLRPINPYRGHINIFEVLRVADAGDATCVPGYEIESLAALERALDAVVEAGAVPFGIGGDHSVSLAGLRAVAKRHGPLGLVHFDSHTDTWDSYFDGKRYSAGTMFRRAIEEGIVDPARSIQVGMRGSLFQPADVSQSVDLGLEVITCDEMFALGLPETARRIAARSAGHPAFLSFDLDFVDPAYAPGVETPECGGPTARETLSLLRSLQGLNLVGCDVVELNPSYDGPGQITALLGATVMAELLAILAEARVRERSR

SEQ ID NO: 16048 - protein, 232 aa, Rhodobacter sphaeroides 2.4.1
MKKVYDSAAAALDGLLFDGMLIAAGGFGLCGIPELLIRAIREAGTRDLTVASNNAGVDGFGLGVLLESRQVRKMISSYVGENAEFMRQYLSGELELEFNPQGTLAERMRAGGAGIPGFYTRTGVGTVIAEGKEHKEFDGETYILERGIVADLSIVKAWKADPSGNLVFRKTARNFNPPAATCGKVCVAEVEEIVPLGSLEPDSIHLPGIYVHRLIQGTHEKRIEQRTVRKRA

SEQ ID NO: 16049 - protein, 495 aa, Rhodobacter sphaeroides 2.4.1
MLQEIDWHARAKAVALPNRPFIDGQYVDSLSGETFACIYPGDGRPLTDVASCNAADVDVAVRSARKAFEAGVWSRMAPADRRRILLRFSELILANREELALLETLNVGKPIANAYNGDVVSAAACIAWYAEAIDKVYGEVAATAYDMTTLVMREPLGIVAAVVPWNYPMSMAAWKLGPALATGNSVILKPAEQSPFTALKFGELAIEAGMPPGVLNVVPGLGHIAGKALGLHMDVDCVGFTGSTEVGKYFMQYSGQSNIKRIGLELGGKSPQVVLADCDDLDAAAAGIAAGIFANTGQVCNAGSRLIVDEKIHDQLLEKIAAQAKVFAPGDPLDTATRMGSMVSEEQMDRVLGYIDAGRADGARPVIGGGRVKTETGGFYIEPTIFEGVRNDMKIAQEEIFGPVLSAIPVKGFDEAMATANDTVYGLAGAVWTGSVKNAHRAAKSLRAGVVWVNCFDRGSLAVPFGGFKQSGFGRDKSLHAMDKYTDLKAVWFAH

SEQ ID NO: 16050 - protein, 401 aa, Rhodobacter sphaeroides 2.4.1
MPDIVVVGAGQAGAALVAKLRALKFEGSILLAGEEPSPPYQRPPLSKAYLLGTMEEERLWLRNRAFYAEAGIELRLGAPVTAIDRAARTVTVGGEAIPYGRLALTTGSAARHLPEAAGGGLDGVYTVRTLADVDRMRPEFRAGRRLVVIGGGYIGLEAAAVGAKLGLAVTVVEMAPRILQRVAAPETADWFRALHAAHGVRILEGVALERLTGEGRVTGALLADGTHLPADFVIAGVGIRPVTELAEAAGLALDNGIAVDALGQTSDPAIWSAGDCASFPWRGGRLRLESVQNAIDQAEAVAANMLGAGAPYLPAPWFWSDQFDTKLQIAGLNLGYDRVVTRGPEGGSVSFWYYRGVELLAVDAVNEPRAYMVGKRLIEAGRSPAPDAVADAAVPLKSLLV

SEQ ID NO: 16051 - protein, 445 aa, Rhodobacter sphaeroides 2.4.1
MKDWLRKHPQVRTIRVAAADLNGQARGKRIPARFADKVVKDGTRFPFSVLNLDIWGEDIDDSPLVFEQGDADGILRPTERGFMPMPWLEAPTALLPIWMFREDGRPYEGDPRHALRAVLDRYKARGLTPVVAVELEFFLIDDSGKTLQVPPSPRSGKRRKAAEALSIRALDAFDIFFTDLYDACEEMDIPADTATSETGLGQFEVNLMHCDDALRAADDAWFFKLLVKGLARRHGFAASFMAKPYPEYSGSGLHMHFSVLDAQGRNVFDNGGPTGTAMMRHAVAGCLNAMHDSTLVFAPHANSYDRLVPGMHAPTAISWGYENRTTAVRIPAGNPAARRIEHRVAGGDVNPYLLVATILGAALTGIEDQEEPPQAIMGNAYALEDLPQIPPSWEAAIQSFENSAIMPRILPRELIRNYVLTKRQELHYLAELSPEEQVELYLDTV

SEQ ID NO: 16052 - protein, 452 aa, Rhodobacter sphaeroides 2.4.1
MAFDYDLFVIGGGSGGVRAARIAASEGGATVALAEESRMGGTCVIRGCVPKKLMVFASGYPDAVEDARAYGWDASIGGFDWPAFRGKLDRELDRLEAAYRSGLTSAGVEIFDERATVADAHTVALASGRKVTAKHILIATGGRPFVPDFPGCELAMSSDDVFQLESLPTSILVVGGGYIASEFACILHGLGVEVCQFYRGAQILRGFDDEARGHVASAMIDRGIHIKCGTDVIRLEKTERGVRAVTTDGSDQEFGAVLYATGRRPNTRGLGLEALGIELGRHGQIPVDGWSQTSVPSIYAVGDVTDRINLTPVAIREGHAFADTVFKGEPRQADHELVASAVFTQPELGSVGLSEEAAREQEPIEVYAAAFRPMQSLFAGRPDRVLMKLIVSQASRKVLGCHIVAPNAGEMIQLAAIAVKMGATKEDFDRTVAVHPTMAEELVTLRKPIRTA

SEQ ID NO: 16053 - protein, 1213 aa, Rhodobacter sphaeroides 2.4.1
MLAAAVHPTSSDTLDEAGLVARLIAEADLDPSARARIVDRGADLVRRIRQGSRPGLMEGFLAEYGLSTDEGIALMCLAEALLRVPDAETMDALIEDKIAPSDWNRHLGRSASSLVNASTWALMLTGKVLDDREPGVAGHLRGLVRRLGEPVIRKAVARAMKEMGRQFVLGETIEGAMARAAELEAKGYSYSYDMLGEAARTEADARRYHLAYSRAITAIAAAAKSRDIRDNPGISVKLSALHPRYEVAKRTRVLAELVPRVTALAGLARAAGLGFNIDAEEADRLDLSLEVIAAALAEPSLAGWDGFGVVVQAYGRRAGEVLDRLYGMAVRLDRKLMVRLVKGAYWDGEVKRAQVLGLDDFPVFTRKMATDVSYIAQARKLFSMSDRIYPQFATHNAHTVAAILELAEGRPFEFQRLHGMGERLHDLVLTEEKTRCRIYAPVGAHRDLLAYLVRRLLENGANSSFVNQIVDESVSPEAVAACPLTAMERTEPVRNPVLRAGTDLFPGRRNSRGFDLASAEDLALIESARSPHRTALFDARPILAESLAGGQRAEVTDPSTGARVGNVLPASLPDVETALHHAVPWEARPEDRAEVLRRAADLYEASFGPIFALLAREAGKTLPDAVGELREAVDFLRYYAAEGEALTAPPLGTVVCISPWNFPLAIFTGQIAAALMAGNAVLAKPAEQTPLIAALAVELLHRAGVPVTALQLLPGEGGTVGAALTRDPRVGGVVFTGSTETARAIRQSMAAHLDPAAPLIAETGGLNAMIVDSTALPEQAVRDILASAFQSAGQRCSALRCLYLQEDVAEGVLEMLFGAMDELQAGEPWDLATDLSPVIDAEAQAGIRDWIAAARAEGRVLKQLAVPARGTFVGPTVIRVGSIREMDREIFGPVLHVATFRATEIDRVIAEIDATGYGLTFGLHSRIDDRVQALVGRLRVGNIYVNRNQIGAVVGSQPFGGEGLSGTGPKAGGPAYLARLVSRPAPDCAGSEAPAQPAAEVQAALDRLAPKAGELIGTHALPGPTGESNRLSLLRRPPLLCLGPGAAAARAQAEAVRTLGGLAVEAPGLAPEALATLRGFAGALFWGGAGDARPRAQALASREGAILPLIGGLPDEAHVAVERHLCIDTTASGAMPNFSPRPPAGGRRPGRRTRLRRKRPVRWRKTDPERGRRAASSPARPAQGDGLRRPGCPCLGAVRAIASGGIRRAAFRA

SEQ ID NO: 16054 - protein, 243 aa, Rhodobacter sphaeroides 2.4.1
MAALARLFKADLDPGRVAAIIFEPVQGEGGFYPAPPDLVRAIRQLCDAHGIVMIADEVQTGFARTGTLFAMHGYDVAPDLVTMAKGLGGGLPIAAVTGRAEIMDAAHPGGLGGTYGGNPLGIAAAHAVLDVIEEENLCARATELGSRLKQKLAEIRATAPEIADIRGPGFMVGAEFADPGSKAPDAGFTNRVREEALKRGLILLTCGVHGNVIRFLAPITIPEPHFAEALEILEASVAAARQG

SEQ ID NO: 16055 - protein, 229 aa, Rhodobacter sphaeroides 2.4.1
MEGVTETTTRPPVLILLGPPGAGKGTQARMLEERFGLVQLSTGDLLRAAVAAGTPAGMAAKAVMEAGGLVSDEIVLAILADRMAQPDVARGIILDGFPRTAGQAAALDGLLERAGQRVTAAISLEVDDGAMVERVSGRSTCAACGEGYHDSFKQPARAGTCDKCGGTEFKRRPDDNADTVGARLAAYHAQTAPLIAYYDGCGVLERIDAMGAIDEIASALGRIVGRVSA

SEQ ID NO: 16056 - protein, 372 aa, Rhodobacter sphaeroides 2.4.1
MMVERAMTPEAALGTPEGPDHLVLSEVGMTFGTLDVIPSLSLSVRRGEMVAFLGPSGCGKTTTLRMIAGLLDPTRGRISVGGREITHLPVHDRDMGMVFQSYALFPHMTVSQNVAFGLEMRRMAKAEIRSRVERALAMVQLGHLAGRKPKALSGGQQQRVALARALVVEPSILLLDEPLSNLDAKLRDEMRVQIRSLQQQSGITAVFVTHDQVEALSMCDRIVVMRGGHVEQFGTPNEIYERPATPFVASFVGRTNRLSGRVDPSGRLLIEGRPVAAEGRLPEGAVEVLVRPHRMSLRAAAEDQPVGLNSLPGVLTGATFVGDLIQATVRIGGDEITVEQLTRRRSGLPEPGSAVTVAWEAGDTMVYPEGRA

SEQ ID NO: 16057 - protein, 511 aa, Rhodobacter sphaeroides 2.4.1
MTATLSDLFAFHRNDGLAVGAPDRPWLTYAGLRELVGHTVTALHAAGVGKGDRVAIVLPNGPEMATAFVALAEGAVTAPLNPAYRLEEFEFYLSDLGAKAIVLAEGYDGPALVAANHLGLAVLRLGHDAADPAGSFTLRAESVAPGEPERATARPRDLALILHTSGTTSRPKIVPLRHGNLSASAHHIAGSLALTPHDRCLNMMPLFHIHGLVAAVSASLAAGASVWCAPGFDALKVFGWIEAARPTWYTAVPTMHQAILARAPRNAEVIERVPLRFIRSSSASLPAQVMEALSATFRAPVIEAYGMTEAAHQMTSNPLPPRPQKPGSVGVAAGPQVRIADEASDRLIEGTGEVVISGPNVTAGYEANKAANAKSFFEAEGERWFRTGDQGRFDAEGYLTITGRLKEIINRGGEKISPLEVDGVLMDHPAVLQVVTFALPHPKLGEEVAAAVVLREGMAADEAAIRAFCADRLAEFKVPRRVVLLDEIPKGATGKLQRIGLAEKLGLVSPA

SEQ ID NO: 16058 - protein, 344 aa, Rhodobacter sphaeroides 2.4.1
MRIQRDLAEAIGNTPLIRLRKASELTGCEILGKCEFLNPGQSVKDRAALYIIRDAVAKGLLQPGGTIVEGTAGNTGIGLSLVGASMGFRTVIVIPETQSQEKKDMLRLAGAHLVQVPAAPYRNPNNYVRYSGRLAEALARTEERGAIWANQFDNTANRQAHVETTGPEIWEQTDGKVDGFICAVGSGGTLAGVAMALQPRGVKIGLADPEGAALHSFYTEGTFEAPGSSITEGIGQGRITANLEGLTPDFSYRIPDAEALPIIFDLMQEEGLCLGGSSGVNIAGAIRMAREMGPGHRIVTVLCDYGNRYQSKLFNPQFLRDKGLPVPQWLDEAPPAIPAVFEDL

SEQ ID NO: 16059 - protein, 176 aa, Rhodobacter sphaeroides 2.4.1
MTVRPHLALAFACLAGPALAAGPPPVTFDSIDGGQIRLDELRTAGPVLVVNTASLCGFTPQYDDLQALWDRYRDAGLTVLAVPSNDFKQELDDAGAVRDFCATNFDLTLPMTTITPVTGAEAHPFYRWLAEEHGVEPRWNFHKVLIDRDGDLVASWSSPVRPTDREIVGRIEALLP

SEQ ID NO: 16060 - protein, 352 aa, Rhodobacter sphaeroides 2.4.1
MAFLEIARLEKSFGPLRVVRDFNLSVEQGEFISLLGPSGCGKTTVLRMVAGFEAPDSGAIQIEGKNVVRQRPNARKIGMVFQAYALFPNLTVAQNVGFGLRVAGVPRREAEERVAEMLSLIGLPDLGARYPFQLSGGQQQRVALARALAVRPRVLLLDEPLSALDAKIRVSLRTEIRTIQQRLGITTIFVTHDQEEALSMSDRIVVMNGGIAEQVGTPFEIYNHPTTKFVANFVGTISTLVAEVEDPAGGAVRVAGQTIRLPQPVEAPRGGRIGLALRPEALHLGAGDGRDTMLPATIADVQFLGSVIRLQLHTGGTTVALDTFNRPDMPPPRVGEHTQVSFAARDVIVLEP

SEQ ID NO: 16061 - protein, 436 aa, Rhodobacter sphaeroides 2.4.1
MNRDAMPNAFRPGAVDLPPREADLVARRQALLGPAYRLFYERPLHIVRGEGVWLYDADGTAYLDAYNNVASLGHCHPRVVDAVARQAGQLATHTRYLHEGVLELAERLLATLPTELGHAMFTCTGSEANDLALRLAFAATGGTGVIVTENAYHGVTMGVAALSPSLGPGVPLGVHVRTVPAPDQDKGADVTFGAAVAAAAADLARHGIRPAALILDTVFSSDGVFTHPTDTLAPAAAAIRAAGGLFIADEVQPGFGRTGEAMWGFLRHGVVPDMVSMGKPMGNGYPVAALALRPELAERFGAGARYFNTFGGNAVAAAAALAVLDTLEAEGLQAHALNVGGQFRADLSALSARDPRLGAVRGAGLFLGVEVLEPESRAPDARMAARIVNGLREARVLISATGPHGHVLKIRPPLVFSDANAAFFLERFESVLAALR

SEQ ID NO: 16062 - protein, 468 aa, Rhodobacter sphaeroides 2.4.1
MEARMPAKSFDMIVIGAGPGGYVCAIRGAQLGLNVAIVERENLGGICLNWGCIPTKAMLRSAEVYHLMHRAKEFGLKAEGIGYDLGAVVKRSRGVAKQLSSGVAHLMKKNRITVVMGDATLAGKGRVSVRTDKGTEELEAKSIVLATGARARELPGLEADGDLVWTYRHALEPKRMPKKLLVIGSGAIGIEFASFFNTLGADTTVVEVMERILPVEDAEVSAFAKKQFVKQGMKILEKATVKKLDRAGGKVTAHVETGGKTETMEFDTVISAVGIVGNVEGLGLEAAGVTVDRSHVVTDEYCRTGVEGLYAIGDIAGAPWLAHKASHEGVMVAELIAGGHPHPIKPGSIAGCTYCQPQVASVGLTEAKAKEKGYEIRVGRFPFIGNGKAIALGEAEGFVKTVFDAKTGELLGAHMVGAEVTELIQGYVVGRALETTEAELMETVFPHPTLSEMMHESVLDAYGRAIHF

SEQ ID NO: 16063 - protein, 486 aa, Rhodobacter sphaeroides 2.4.1
MIEKRDFYINGGWTAPAEARDCEVIDPSTEEACAVISLGDQADTDAAVAAAKAAFEGWAATPPAERLRLVKGILAQYEARKEEMAQAISLEMGAPIDLARNSQAPCLPWHLTNFLKAFEEIEWVRPLGPHAPNDRIALEPIGVVGLITPWNWPMNQVTLKVIPALLAGCTCVLKPSEEAPLSSLLFAEFVHDAGLPAGVFNLVNGDGAGVGTQLSSHPDVEMISFTGSTRAGRAISKAAAESLKRVTLELGGKGANLIFADADERAVERGVKHCFNNSGQSCNAPTRMLVERPLYDRAVEIAAEVAAKTRVASAHEEGPHIGPVVNKRQFEQIQSYIQKGIDEGARLVAGGLGRPDGLNRGFFVRPTVFADVTPGMTIEREEIFGPVLSILPFETEEEAVRIANDTPYGLTNYVQSEDGARRNRLARRLRSGMVEMNGKSRGAGAPFGGVKASGRAREGGVWGIEEFLEVKAISGWDPEAEALAAE

SEQ ID NO: 16064 - protein, 335 aa, Rhodobacter sphaeroides 2.4.1
MAILFITHDLGIVQRFADRVYVMQAGEVVETGETAALFEAPSHPYTRMLLDAEPEGTKAPPPETAPVLMEGRNVEVVFSSGGGLFEAPNELRAVDGVSVRLRQGQTIGVVGESGSGKSTLGRALLRLLPSAGLVTFEGRELARDAAEMRPLRRRMQLVFQDPFGSLSPRMTVGRIITEGLKIHEPDLSTRERDRRAGAALAEVGLSPAMRNRYPHEFSGGQRQRIAIARSMILKPRVIVLDEPTSALDRSVQKQIVDLLRDLQARHGLSYLFISHDLAVVRALADYILVMKEGRIVEEGQTADIFDRPQEAYTRTLMAAALETRRFREEAERTSV

SEQ ID NO: 16065 - protein, 498 aa, Rhodobacter sphaeroides 2.4.1
MTLLTTEDYKAIAAGLTLPTGAFIDGRFRPAQSGATFETRNPATGQLLAEVAACGPADVDLAVQKARDAFEDGRWSRLPPRARKEVLIRLAKLLKRHARELAVMESLDSGKTIYDCETVDLPETIHCLTWHAELIDKIYDQTAPASDDHLALVLREPVGVVGLVLPWNFPLLMLAWKIGPALAAGCSVIVKPAEETPLTALRVAELATEAGVPPGVFNVLPGHGPEVGEPIGRHMDIDAVSFTGSTETGRRFLRYAAESNLKEVTLEMGGKNPAVVLDDAENLDRVAAHVVTGAFWNMGENCSAASRLIVQSGVKEALIARILAHAREWPMGDPLDPANRVGALVSPAHLDKVRSYLAEGPTVLLGGKAHGAFVEPTILEITDREAAPAREEIFGPVLSVLTVESFDEAIALANDTPYGLAASIFTANVKKALRGARALRAGTVTVNSFGEGDITTPFGGFRQSGFGGRDNGIHAHDQYTQLKTIWIDLADDAAEAVS

SEQ ID NO: 16066 - protein, 481 aa, Rhodobacter sphaeroides 2.4.1
MTDFRREKILVGGDWIQADAGGRIEVTNPATGAVIGTVPDAGAAETARAVAAAEAAFGPWRALTAAERATHLRRLAQAILDHREALAELLTEEQGKPLAEARGEVGMSAAYIQWFAEEARRVYGEVIPSPWPDRRLLVTRQPVGVVAAITPWNFPSSMLARKIGPALAAGCTVVAKPASQTPFSGLAWGVLGEMAGLPAGVLNIVTGSARAIGGELTANPSVRKITFTGSTPVGKVLLAQAAGTVKKMSMELGGNAPFLVFDDADLDRAVEGAIAAKFRNAGQTCVCTNRFYAQAGIHDEFVKRLAAATAALKVGPGAQDGSEIGPLIDAAAVAKTEEMVADATAKGGRIVTGGRRHTAGAGFYEPTVIADATDAMTFAREEIFGPVAPVFRFETEEEAIRRANATEYGLACYFYTSDLGRAFRVSEALDYGIVGVNEGLVTTEVAPFGGVKESGFGSEGSHHGMQDYLTLKYTAMGGLGR

SEQ ID NO: 16067 - protein, 470 aa, Rhodobacter sphaeroides 2.4.1
MERIETDLCVIGAGSGGLSVAAGAVQMGARVVLVEAGEMGGDCLNAGCVPSKALLAAGKAAQAMRTAGAFGIRPVEPEIDFAAVKDHVARTIAAIAPHDSQERFEGLGVRVLRDWGRFVSPTELRVGARTVVARRFVIATGSRPLLPPIPGLDRVKALTNETIFALRERPEHLIVIGGGPVGIEMAQAHRRLGSRVTVIAGEKALPKDDPELAAVLLDRLRAEGVEIVEGARAEAVQPLAHGLEVTAGDRRIAGSHLLVAAGRKPALDALDPAAAGVEVTEKGVKVGPDLRSSNRRIYAVGDAAGGPQFTHLAGYHASVVIRSILFGLPSKATALIPHVTYTEPELAQIGLTEAQAREIHGDRLEVLRVPVAGSDRAQAEAATEGLVKLMVARGRPVGVSIVAPHAGEMIGLWAMALASGAKLSTVAGLVLPYPTLNELSKRAAGAYFSPKLFDSRVVRTAVRTLQRLLP

SEQ ID NO: 16068 - protein, 501 aa, Rhodobacter sphaeroides 2.4.1
MANPLFDALFAPLEGRASDLIILKDGTRLSGDAFFRLLARTAHALRAEGLRPGDRIAVQVAKSPEALAVYGAAVALGAVFLPLNTAYTPAEVDYFLGDATPRIFLCDSAQAPALTPVAERHGARLLTLDADGTGDLAQRTRDRPEEIGAEPRDAEDLAALLYTSGTTGRSKGAMLSQRNLLSNAEALADLWRFTERDVLIHALPIFHTHGLFVASNVTLLTRGSMIFLPGFDLEAILRWMPAATALMGVPTFYTRLLSDPRLTRALAAGMRLFVSGSAPLLADTHAEFEARTGHRILERYGMTETNMSTSNPYEGERRAGTVGFPLPGVELRILDQGREVAPGEIGVIEVRGPNVFQGYWQMPEKTAEELRPDGFFVTGDLGCRDAEGYVQIVGRQKDLIISGGYNIYPKEVELLLDEQPGVLESAVVGLPLPDLGEAALAVLVPRPGVTLDPQAVLGAIADRLARFKQPRAAVLVEELPRNTMGKVQKTLLRARYAGLFA

SEQ ID NO: 16069 - protein, 443 aa, Rhodobacter sphaeroides 2.4.1
MSQLAPGVVPGRLPADAYARNFSDVEPPLDGHEAKVAADRCYFCHDAPCVTACPTAIDIPLFIRQIATGTPEAAARTIFNQNILGGMCARVCPTEQLCEEVCVRETAEGKPVEIARLQRHATDTLMARNVHPFERAEPTGKRVAVVGAGPAGLSAAHRLAMLGHEVTIFDARPKPGGLNEYGIASYKTPDNFAQAEVDWLLMIGGITLKTGQALGRDITLEGLRAEFDAVFLGMGLSGVNALRAEGEDREHVHPAVDFIAALRQAEDLASLPIGRDVVVIGGGMTAIDAGVQAKLLGAENVTIVYRRGQEKMSASRHEQDHATASGVRLIWHAAPVKVHGNGAVREVEFAYTEDGPGGLRLLSETFRLKADQLFKAIGQTLGEVPEGIALEGGKIAVDATGRTSLPGVWAGGDCAAGGEDLTVTAVAQGRDAAVDIHAELCPS

SEQ ID NO: 16070 - protein, 393 aa, Rhodobacter sphaeroides 2.4.1
MISAVLPTYNRAPLAFVAGEGSWLTAEDGSRYLDLGAGIAVNALGHANPALVEVISAQAAKLWHVSNLYRIPEQERLAEKLVEATFADTVFFTNSGTEAAELSIKMVRKYWSEKGQPDRIEILCFEGAFHGRSTGAIAAAGSEKMTKGYGPLMPGFRQLPFGDHEALRAAISEKTAAVMLEPVQGEGGIRVLPDVCLKGLRDACDAVGALLVFDEVQCGMGRTGRLFAHEWAGIEPDIMMVAKGIGGGFPLGAVLAKKAAAAAMTAGTHGSTYGGNPLGCAVGAKVMEIVADPAFLAEVNRKAALFRQKLEGLVAAHPQVFEEVRGAGLMLGLKCRAPNADLVKAAYGQHLLTVPAADNVVRLLPALNIPDEDIAEAVARLDRAAGTLDADAA

SEQ ID NO: 16071 - protein, 263 aa, Rhodobacter sphaeroides 2.4.1
MTRIDDTFRRLRAEGKKAFVAYIMAGDPDLETSLAVMRGLPEAGVDIIELGMPFTDPMADGPTIQTAGQRALEGGQTLTRTLEMVRAFRAENAETPIVMMGYYNPIYARGVETFLAEATEAGIDGLIVVDLPPEEDAELCLPAQAAGLNFIRLATPTTDSRRLPKVLQNTSGFVYYVSITGITGAAAAQAADVAPEVARIKAATDLPVIVGFGITTPEAAQDLAGIADGCVVGSAIVKLVGEGRPVAEVLDRVAALAAGAHAA

SEQ ID NO: 16072 - protein, 306 aa, Rhodobacter sphaeroides 2.4.1
MILCCGEALIDMLPRETTAGEAAFAPYAGGAVFNTAIALGRLGAPAGFFSGLSTDLFGVQLAETLAASQVETDLCARSDRPTTLAFVRLTNGQASYAFYDENTAGRLLAPADLPALPDRVSTLFFGGISLVNEPAAATYEALMAREAPRRVTMLDPNIRPGFIADAAAYRARIGRMIALADILKLSDEDLHWLEGPGQILSLARGLLARGPKLVLVTEGAVGARAVTATEDRFCAATPVQVADTVGAGDTFNAGVLAALHEAGALSRSAVASLSPETLAAALALGTRAAAVTVSRPGANPPWVDEL

SEQ ID NO: 16073 - protein, 321 aa, Rhodobacter sphaeroides 2.4.1
MALEDAKNEVDVAFGGRGPRGYAYENAFAGATSFLRRRYTKDLTGVDLAITGVAFDQAVTNRTGTRFGPRAIREASTLQPYDRPFGWGFDPLEELTVVDYGDLAFDYARTAEFPARLTAHVAGILAAGAGALTLGGDHSITLPILRAHAAVFGPLSVVQFDAHSDLWVDDDPGRIDHGTFMYKAVKEGLVDPARSVQVGIRTDTPDWLGMNVIDARTAHEQGPAAVAARVHAIVGHHPTYLTFDVDALDPAFAPGTGTPVWGGLASWQAAAILRDLAGLNLVGGDVVEVSPPYDPSGITAVAGAHVAYELICLYGWRRRKE

SEQ ID NO: 16074 - protein, 508 aa, Rhodobacter sphaeroides 2.4.1
MDGVAERQMMGEDSPPSGDDPRAEARALLAELTALRADLFRRADARMADWATRVRRLEFLPSVANMADWLALREADLTTLQPRLSRLGLSTLGRLDGHVPPSLEAVIAALSAIAGLEGPAFPDRESFDPELRSLHARRDALFGARDTAPGTRILVTLPSEAASDPAIVRELVAAGADAFRINCAHDGPEAWAAMIGHIRKSERMTGRKLPISMDLGGPKFRVTKTGGPLPKRLQAGDRFAFVEKPSLAPEGRGWAMLGHPALLAALAPGVQVSVDDGKLWATVIQTGRGHALLEVDRVGERGLKLKPGRGVNLPGSHLDVAALTEEDLAALDVVVAEADLVAFSFVQTPGDVRALIAAMEARACHPRPLPAILLKIETPMGLHLLPELIVEAGGSLPVGVMIARGDLAVEIGFDRLSEIQEEILWLCEAAKVPVVWATQVLEGMVKEGQASRAEVTDAAMSQRADCVMLNKGPHVAAAIEFLRDILIRMDRHQTKKSARLGPLRVWAG

SEQ ID NO: 16075 - protein, 374 aa, Rhodobacter sphaeroides 2.4.1
MKITAAVLERDGIAGNYAEERPLAIRELDLAEPGPGEVLIRVAAAGICHSDLSVINGTRRRPLPMVLGHEASGHVEALGEGVEDLEHGDHVVCIFAPGCGRCTPCAEGRPALCEKAARHHAVGELMTGHRRLSLGGRSVHHHLGISGFATHAVVARPSLVRVPREVPPHVSALFSCAMLTGAGAVFNTAQIRPGSKVAVVGLGGVGLSAILGAAAAGAAEIVAIDPFPAKMEAARAMGATLSVPADGDTVAAVRDLTAGGVDYAFELAGSVRALETAFAVTRRGGMTVTAGLPHPDDRMSLEALKLVAEERTLKGSYIGSCVPQRDLPRMLALHRRGLLPVEKMLTHRLKLDEINLAMDRLAKGSAIRQVVDLG

SEQ ID NO: 16076 - protein, 236 aa, Rhodobacter sphaeroides 2.4.1
MSFDRRIKIAPSILSADFANFGAECRAIEAQGCDWVHVDVMDGHFVPNLTFGPAMCAAIRPHIKGVMDVHLMIAPVDPYIEAFAAAGADVITAHLEAGPHIHRTLQAIRGTGRKAGLALNPGTGLDAVGHLLDLLDLVCIMTVNPGFGGQKFIASQVDKVRDLRAMIGDRPIHIEIDGGVTPETAPLVAAAGADVLVAGSAVFKGGSVDNPEPYGANIRAIRAAAEASLGRAFAAK

SEQ ID NO: 16077 - protein, 257 aa, Rhodobacter sphaeroides 2.4.1
MQKEVLIEVRGLKNQFGPNVIHEDLDLDIYRGEVLGIVGGSGTGKSVLLRSIVGLQAPRAGSVKVFGTDVRTASKAEMAKVENRWGVMFQDGALFSSLTVRENVEAPMRERTGLDPETRTALADLKIAMVGLPPKARSLYPSELSGGMRKRAGLARALALDPDIVFLDEPTAGLDPIGASEFDALIRNLQTSLGLTVFLVTHDLDTLHATCDRIAVLAERKVLVTGTIRELMEVDHPWVREYFHGPRAHAALVAAEG

SEQ ID NO: 16078 - protein, 362 aa, Rhodobacter sphaeroides 2.4.1
MTEKLFTPIAVGDLTLKNRVVMAPLTRNRAEPEGDLPTDLTVEYYRQRAGAGLIVTEGSQISPEGKGYAWTPGIHSEAQVAGWRKVTDAVHARGGHIAIQLWHVGRISHTSLLDGQKPVAPSALAAASRTFDGTGFVATSEPRALETDEIARVVEDYRKAARNAKAAGFDAVEIHAANGYLIDQFLRDTSNKRTDAYGGSQENRVRFLEEVVGAVVAEMGPGRTGIRFSPFSNANDVGIDSDTVGLFSRAIDVLNRHGIAFLHMVEGQTGGAREWPEGALETLRERFGGTYVANNGYDREMAVAAVESGKADMVAFGKLYISNPDLAERLAARAPLAPLPTEGLYGGGAEGYTDYPTLTPAA

SEQ ID NO: 16079 - protein, 364 aa, Rhodobacter sphaeroides 2.4.1
MKAARLYEYDPAMNVRLKIEDVPSPTIDRPDEVIVKVGAAGLCRTDLHIIEGVWRDIMDSHGSLLPYIMGHENAGWVEDVGSGVTSVKPGDAVICHPLRTCGICLNCRHGHDMHCQNNLFPGLGLDGGFAEYFKTSERSLIKLNTGITPLSVAPMADAGITAYRAAKRAAKLLNPGDWALILGVGGLGHIALQVLNEMAGCRTIAVDREPGAQVLAKELGADKVLSGGPDLIEEVRQITGGGARVVIDFVGELGVENLCWKLLKNGGDLIMVGYGGTIEIPTLELVAREIRIGGSLVGDYTELVELMELNADGKVKMHQTEFALEDINTAIDDFKNRRFTGRGVIVPGAPSARRVEERTAEAVK

SEQ ID NO: 16080 - protein, 475 aa, Rhodobacter sphaeroides 2.4.1
MITQVLLCGGSGTRLWPLSRKGYPKQFASILGEHSLFAASARRLSGPGFGRPVIVTGSDFRFVVTEQLAEAGIDPGTILIEPEPRNTAPAILAAALHVAAGDPEALMVVAPSDHAIADPAAFRAAVMQGVPAARAGRIVTFGIVPTRAETGYGWLELDGAEDGAAVPLRRFVEKPDLDRAEEMLASGGFLWNSGIFLFSARTILATFEEHAPALLAPVRRAVEGAVPDLGFLRLDPQPWAEAEPISIDYAVMERTRNLSVVPFRGSWNDLGGWDAVALEMGTDGQGVSLSGGATAIDCRNALLRADSEGVELVGIGLDNIIAVAMKDAVLVAERSRAQEVKQAVEALKAKGARQAESFLRDRRPWGFFETLALGERFQVKRIVVHPGGALSLQSHLHRSEHWIVVRGTARVTIDADVHLMTENQSVYIPLGARHRLENPGKVPMELIEVQTGSYLGEDDITRYEDVYARGQGARG

SEQ ID NO: 16081 - protein, 462 aa, Rhodobacter sphaeroides 2.4.1
MATFDVIIIGAGPGGYVSAIRCAQLGLKTAVVEGREALGGTCLNVGCIPSKALLHATHNLHEVHENFEKMGLMGAHPTVDWSKMQGYKQEVVDGNTKGIEFLFKKNKITWLKGWGSIPEPGKVKVGEEIHEAKSIVIATGSEPASLPGVEADESVIVTSTGALSLGRIPETMVVIGAGVIGLELGSVYARLGTKVTVVEYMEAILPGMDAEVVKTTQRILAKQGLSFVLGAAVKGATVSDGKATVTWAAKKDGKETSLTVDTVLVATGRKPFTEGLGLEALGVEMLPRGVVKIDDHFRTSVPGIYAIGDCVPGMMLAHKAEDEGVALAEILAGKHGHVNYGVIPGVIYTTPEVASVGRTEESLKEEGRAYKVGKFPFMGNARAKAVFQAEGFVKMIADKETDRILGCHIIGPAAGDLIHEVCVAMEFGASAQDLAMTCHAHPTWSEAVREAALACGDGAIHA

SEQ ID NO: 16082 - protein, 506 aa, Rhodobacter sphaeroides 2.4.1
MTAPKPVVLCILDGWGLRAEREANAVALAETPTFDRLMATCPNATLVTHGPDVGLPRGQMGNSEVGHTNIGAGRVVAMDLGAIDLAIEEGSFPQNPALRDFIGKVKAKSGTAHLMGVVSDGGVHGHIQHLISAVEVLAGEGIPVVIHAITDGRDVAPTSAGEFVGQLVRVLPEGARIGTVIGRYWAMDRDKRWDRVKRASDAMLHATGEHAPDAEAAVAAALARGETDEFIAPTVVGDYAGARDGDGFFCLNFRADRAREILAGLAQPGFDAYDTGARPDWSAFLGMVDYSKEHDRFMTTAYPKPVIRNTLGEWVASHGLRQFRIAETEKYPHVTFFLNGGREAPETGEDRYMANSPKVATYDLQPEMSAPDVSDHLVEAIGAGYDLIVVNYANPDMVGHTGDLKAAMAAVEEVDRGLGRAVEAVTKAGGAMIVTADHGNCETMVDPETGGPHTAHTTNPVPVILVNGPAGARLHAGRLADLAPTLLQLMQLPQPEEMTGRSLIDA

SEQ ID NO: 16083 - protein, 162 aa, Rhodobacter sphaeroides 2.4.1
MERTIDPLTLPYRPCVGIVLINREGLIFAGQRIDSPVPAWQMPQGGIDEGEKPREAALRELWEETGIPAERVEFVAKAPDWVTYDLPPELLGRVWGGKYRGQRQKWFLYRYLGTDEEVGIGTDHAEFSCWRWIGAEEMVAAIVPFKRAVYEEVVATFRPHLA

SEQ ID NO: 16084 - protein, 308 aa, Rhodobacter sphaeroides 2.4.1
MRKTCILIGAPIDSGQRRPGCLMGPAAYRVAGLGRALADLGHAVEDRGDVALGPLPEMTPPEGPVHDLPETIGWTAALKTAVEEALGDGFPIVMGGDHSLALGTVAGAAAHAAAVGRPLFLLWLDAHSDFHTLQTTTSGNLHGVPVAYAAGRDGFDGFPPFPAPLPPERICLFGIRSVDPEEHAALLLHDVSIIDMRVIDEFGICAPMREFLEKVRAANGMLHVSLDVDFVDPAHAPAVGTTVPGGATVREAHLVMELLHESGLVTSLDLVELNPFLDERGRTARLMVELAASIMGRKVFDRPTRSFG

SEQ ID NO: 16085 - protein, 119 aa, Rhodobacter sphaeroides 2.4.1
MAFDPASLTFDANGLIPAVAQDHATGEVLMMAWMNAEAVARTVETGCVTYWSRSRQAFWVKGETSGHVQRLIELRIDCDRDCLLLLIEQEGPACHTNRRSCFYTALREGEERIILDPMV

SEQ ID NO: 16086 - protein, 451 aa, Rhodobacter sphaeroides 2.4.1
MVRSSTFTSHARAILALGLPLVGSHLAQMSLHVTDTVMLGWYGVTELAAVVLGASLFFVTFILGSGFAQAVMPMVAEALGRGDETQVRRDTRMGLWLSIAFGLLVYPLFWFSGSILLALGQQPEVAALAQDYLRIAGLGMVPALLIMVLKSYLSALERTQIVLWATLAAVVVNAGLNWVLIFGRFGAPELGVEGAAIASVGAQIMSLAALGLYAALLPPLRRFNLFQRFWRPDWHALARVFALGWPIGFTGLAEGAIFQAAALMMGWIGTVPLAAHGIAPEVTALAFMVHVGISNAATIRTGRADGAGNTEGLRDGAKVAILLSLGFGLVMVAIFLLFPGPIIALFLDRANPEFDEIVAFGSVLLAFAALFQIADAMQVIALGLLRGLRDTQVPMWLASFSYWMVGIPASYVLGFPMGLGGPGLWLGLVVGLTLAAILLMTRFWLRAPRLA

SEQ ID NO: 16087 - protein, 305 aa, Rhodobacter sphaeroides 2.4.1
MLTVLINAYGANDVVEVAEVERPSPQAGEVLIKVSAAGVNPIDWKIRDGAGERMGLTLPIHLGGEFVGAIEDIGPGVAGFERGEIVFGMVRTGAFSQYVAVNAADIVRKPGNLDITQAAALPLAGTTAWQAMFDEAGLRAGQRLLITGASGGVGSLAVQLAKAKGAHVTAMTSARNAEFVRALGADEVVDYTARPFEEIVHDMDVVLDTVGGDTFQRALTTLRKGGIMVTIVAFPDGEEAKAHGVRVKRAFTAANAGSIRAITALVEAGKVTPHVEKTFPFVDVKAALALSAAGRVRGKIVLTIE

SEQ ID NO: 16088 - protein, 323 aa, Penicillium janthinellum
AASGVATNTPTANDEEYITPVTIGGTTLNLNFDTGSADLWVFSTELPASQQSGHSVYNPSATGKELSGYTWSISYGDGSSASGNVFTDSVTVGGVTAHGQAVQAAQQISAQFQQDTNNDGLLGLAFSSINTVQPQSQTTFFDTVKSSLAQPLFAVALKHQQPGVYDFGFIDSSKYTGSLTYTGVDNSQGFWSFNVDSYTAGSQSGDGFSGIADTGTTLLLLBDSVVSQYYSQVSGAQQDSNAGGYVFBCSSSVPBFSVSISGYTATVPGSLINYGPSGNGSTCLGGIQSNSGIGFLIFGDIFLKSQYVVFDSDGPQLGFAPQA

SEQ ID NO: 16089 - protein, 394 aa, Escherichia coli B
  misc_feature (1)..(1): Xaa can be any naturally occurring amino acid
  misc_feature (45)..(59): Xaa can be any naturally occurring amino acid
XSKEKFERTKPHVNVGTIGHVDHGKTTLTAAITTVLAKTYGGAAXXXXXXXXXXXXXXXGITINTSHVEYDTPTRHYAHVDCPGHADYVKNMITGAAQMDGAILVVAATDGPMPQTREHILLGRQVGVPYIIVFLNKCDMVDDEELLELVEMEVRELLSQYDFPGDDTPIVRGSALKALEGDAEWEAKILELAGFLDSYIPEPERAIDKPFLLPIEDVFSISGRGTVVTGRVERGIIKVGEEVEIVGIKETQKSTCTGVEMFRKLLDEGRAGENVGVLLRGIKREEIERGQVLAKPGTIKPHTKFESEVYILSKDEGGRHTPFFKGYRPQFYFRTTDVTGTIELPEGVEMVMPGDNIKMVVTLIHPIAMDDGLRFAIREGGRTVGAGVVAKVLG

SEQ ID NO: 16090 - protein, 478 aa, Xylella fastidiosa Dixon
MSEHYDVVVIGAGPAGYHAAIRAAQLGLKVACVDAALGKDGKPALGGTCLRVGCIPSKALLDSSRQYWNMGHLFNEHGISFKDAKMDVATMIARKDKIVKQFTGGIAMLFKANKITPYYGFAQLQPGNVVKVKQHEGKNIELKGANVILASGSDSVELPFATFDGETIVDNIGALDFTKVPKRLAVIGAGVIGLELGSVWKRLGAEVTILEAMPNFLAAVDADVAKTAAKEFKQQGLDIKLGAKVSRTEISSKNNKKEVIVTYTDASGKQTLTVDKLLVAVGRKAATKGLLADGTGVQLNERGQIVVDEHCHTGVDGVWAIGDCVRGPMLAHKGFEEGIAVAELIAGMPGHVNFETIPWVIYTEPEIAWVGKTEQELKADSIPYKAGSFPFAAVGRAVAMAEPSGFVKVLAHAETDRVLGLHLIGVNVSELVHEGVLAMEFSGSADDLARICHAHPTLSEAIHDAAMAVSKRAIHKAN

SEQ ID NO: 16091 - protein, 413 aa, Xylella fastidiosa Dixon
MPPTKTSFPKQDIRILLLEGVSHSGIETFRAAGYSQIKIHTTSLPEEALQAEIAEAHIIGIRSRTQLNAAVLGHAKRLMAIGCFCIGTNQVDLDTAELSGIPVFNAPYSNTRSVAELIIAEAILLLRKIPQKNAECHRGGWSKSAINSHEARGKVLGIVGYGHIGTQVSVLAEAMGMQVIFYDIESKLSLGNARPAASLDELLGIADVVTLHVPETAATKNMLGHAELARMKPGAHLINASRGTVVEIDALDAALVSGHLGGAAVDVFPSEPKGNSDPFISPLSRHDNVILTPHIGGSTLEAQDNIGIEVAAKLIRYSDNGSTLSAVNFPEVSLPEHVGSMRLLHIHRNVPGVLSHINELFSRHNVNIDGQFLRTDATLGYVVIDIGASQTQALALKEALTQVPGTLRTRLLY

SEQ ID NO: 16092 - protein, 223 aa, Xylella fastidiosa Dixon
MSNCLIAPSILSADFARLGAEVDAVLAAGADWIHFDVMDNHYVPNLTFGPMVCKALRSYGITAPIDVHLMVEPVDRIVPDFAQAGASMISFHIEASRHVHRTIQLIKSHGCMAGLVFNPATPVDMLDWVLPELDLVLLMSVNPGFGGQRFIPGTLDKLRLVRKKIDLLGRPVRLEVDGGVGIDNIGAIAEAGADTFVAGSAIFHARDYGDVIAQMRAVVAAVR

SEQ ID NO: 16093 - protein, 273 aa, Xylella fastidiosa Dixon
MFLFRASRYLAELSTFQPAIAEACQRAWSAAKRDTDFIRLDKEAFESSPADSIDYAVMEHTADAVAVPLDAGWNDVGSWSALHEVSKQDNDGNAHQGDVIQIDCRNTYAYGSRLIAMVGLENVVVVETDDALLVGHRDSIQTVKEIVGKIKANGRPEATRHRKVYRPWGAYDSIDTGQRFQVKRITVKPGGTLSLQMHHHRAEHWIVVSGTAEVTRGSEILLLTENQSTYIPLGVTHRLRNPGKLPLELIEVQSGSYLGEDDIVRFEDTYGRT

SEQ ID NO: 16094 - protein, 402 aa, Xylella fastidiosa Dixon
MKLTDLSNPAILENPYPLYETLRAQAPFVSIGPNALMTGRYSLVDSLLHNRNMGKNYMESMRVRYGDSAADMPLFQAFNRMFITINPPAHTHLRGLVMQAFTGRESESMRPLVIDTAHQLIDNFEQKPSVDLVAEFAFPFPMQIICKMMDVDIGDAVTLGMAVSKIAKVFDPSPMSADELVHASTAYEELAQYFTKLIELRRTHPGTDLISMFLRAEEDGEKLTHDEIVSNVIMLLIAGYETTSNMIGNALIALHRHPEQLTLLKSDLSLMPQAVSECLRYDGSVQFTMRAAMDDIEVEGELVPRGTVVFLMLGAANRDPAQFTHPDQLDITRKQGRLQSFGAGIHHCLGYRLALIELECALTALFERLPHLRLAHLDALNWNQRSNLRGVNTLIVDLHAKN

SEQ ID NO: 16095 - protein, 453 aa, Xylella fastidiosa Dixon
MAVSFVISRFGSEVRPTLLLALPLVLGHVSTGLIGFVLNVIAGHHSTVTLAASTIGTALLWLPMLVPMGTLISLTVLVSQLHGAERERDIGPLFRQALWLAMLLGLVMFTFLSVVPALLPLFGIVPDIVPGAAKFLHVVRWGSLAFPLYFCMRYFCEGMHCTFPTMLLGFGGLLVLVPLSYALTYGRFGFAEYGVEGLGIATVTVMWLQAVVFALYLWRSRRFAHLQLFAHLELPCWARIRDLLNIGLPIGISILMEGGLFIVTTLLIGRFGTDEIAAHQIALSVAQLCFMIPMGVAEATTVRIGHAVGRCDLLVMRRVAWAGYAIVIGTQTLSASVLLLGYDVIVAAYTDDLVVASLASKLLLFAAIFQFPDGLQMLSSGVLRGMKDTRVPMLLAMISYWGLGMPLGLGLGFALEWNSRGMWIGLIIGLTAASVLLGWRFRVVSERMFAGIP

SEQ ID NO: 16096 - protein, 444 aa, Xylella fastidiosa Dixon
MNHSRSHALFVQAQTRIPGGVNSPVRAFRSVGGEPFFVARADGPYLFDVDGHRYIDYVGSWGPMIVGHNHPGVREAVQVAISNGLSYGAPCAAEVTMAETIARLVPSCQMVRMVNSGTEATLSAIRLARGATGRNYIVKFEGCYHGHGDSFLVKGGSGMLTLGLPSSPGVPAELSKLTITLTYNDFDAATALFEEMGHHIAAVIVEPVIGNANCIPPRPGYLQHLRTLCTQYGVLLIFDEVMTGFRVALGGAQALYGVTPDLTTFGKIIGGGMPVGAYGGRRDLMQHIAPAGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPNIIEATLEAARTAFQTIANEAAILSKSETPIKMR

SEQ ID NO: 16097 - protein, 502 aa, Xylella fastidiosa Dixon
MHNGFDALQLHANRLRGVTIPDLLAAELKRPEQYARQVGPLYFNFARQKYDCVALEALFALARNHNVTGAFQRMFCGEQVNVTEGRAVLHTALRGDLSGTSVAVAAYTAAAKVRERMYALIAGLDASEVTDIVSVGIGGSDLGPRLVVDALRPISQGRFRVHFVSNVDGAAMRRTLDMLDPSRTAGILISKTFGTQETLLNGRILYDWLGGSERLYAVSANPERAVHAFDIVPTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDLYTENHFALNANLLAQIEVLANGQLSDDPHRVYPGGNPSTLILLDALTPQALGGLIAMYEHSVYVQSVIWGINAFDQFGVELGKHLAVQLLPALKGESVEVVDPVTRAVLVRLRG

SEQ ID NO: 16098 - protein, 485 aa, Xylella fastidiosa Dixon
MLRILAEALTYDDVSLVPSHSTVLPKDVNLETRLTRNIRLKLPILSAAMDTVTEARLAIVMAQLGGIGIIHKNLTIEQQVAEVTKVKKYESGVIRDPITVDPETSIRDVLALTRAKNISGVPVVDKGQLIGLVTHRDMRFESELDDPVRHIMTKKEALVTVKEGADSQEVLQLLHKHRIEKILVVNDAFELRGLITVKDIQKKSDYPNAAKDAVTRLLVGAAVGVGGETERRVETLATAGVDVIIVDTAHGYSQGVLDRVAWIKRYFPQLQVIGGNIVTGDAALALMDVGADAVKVGVGPGSICTTRMVAGVGVPQITAVQMVSDALQDRIPLIADGGIRYSGDIGKALAAGASTVMIGGLFAGTEEAPGDVELFQGRTYKSYRGMGSLAAMEKGSKDRYFQEASDVDKLVPEGIEGRVPYRGSVSGIVHQLMGGLRATMGYVGCATIEEMRTKPQFVKITGAGQVESHVHDVQITKEPPNYRMR

SEQ ID NO: 16099 - protein, 472 aa, Xylella fastidiosa Dixon
MSTDHEEEHMTKNAASKARIAYVCTECGTEYSKWQGQCTECGTWNCLSQITLGNAGSVKNPTMKHGNWTGQLDPPKITALKDVQHSEQARISTGIGEFDRVLGGGLVAGAVVLIGGDPGIGKSTLLLQALARMASNLPTLYVTGEESLAQVAGRAVRLDLPLEGLNALAETGIESILQHASSARPRLIVADSVQTLWTEALTAAPGSVSQVRESAAQLVRYAKETGTTVFLVGHVTKEGGIAGPRVLEHMVDAVLYFEGESGSRFRLLRAFKNRFGAVNELGVFAMSEKGLKEVANPSAIFLSGRNSDQPGSCVMVTREGTRPLMVEVQALVDTSPLSNPRRVTVGLEQNRLAMLLAVLHRHGNVLVGDQDVFINIVGGIRVQETAADLPVLLAVRSSLCNRALPEKTIAFGEVGLSGEIRPVPNGEERLREAATHGFKHAIVPKANAPKSAIKDMQIIAVERLDQALEASY

SEQ ID NO: 16100 - protein, 249 aa, Xylella fastidiosa Dixon
MTRKLVLLRHGQSQWNSMNRFTGWVDIGLTEQGHQEATMAGHLMKEEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVTESLKNTLERVLPYWNDAIAPQLNDNKTVLISAHGNSLRALYKYLNQESDEKILNVNIPTGIPLLFELSDTLQVVSYRYLGDPDAAQRAAEMVANQGKAK

SEQ ID NO: 16101 - protein, 168 aa, Xylella fastidiosa Dixon
MTSIYTFTFTRLDGRPQALADWRGQVLLLVNVASHCGFTPQYAGLEMLWQRYRDAGLIVIGFPCDQFAGQEPGDEAKIAEFCTLTYGVDFPMAAKIKVNGADAHPLWQWLKHRRRGLFGVAAIKWNFTKFLIGRNGQPIARYSPIKSPEQLEVHIVRALGEEGGGNTH

SEQ ID NO: 16102 - protein, 338 aa, Xylella fastidiosa Dixon
MSVALSIDLSKKKTILCFGEALIDMLAQPPVKKGMPRAFLQCAGGAPANVAVAVARLGGAVQFVGMLGSDMFGDFLFDSFAEAGVVTDGIVRTSTAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGQVPTFRVQVQDSNAAGDAFVGGMLYTFAQQFDDAAALIDFCHDPESIVSTLRFAAAVGALAVTRQGAFTAMPMLSEVLSLIQEQS

SEQ ID NO: 16103 - protein, 374 aa, Xylella fastidiosa Dixon
MTKPVNTTADKVALSDTALADIRTKIDKIDRDIQTLIAERACYAQQVGQAKSKLAAAMDYYRPEREAQVLRMVVERNEGPLSDEVLVRLFREIMSACLAQQEPLKIGYLGPEGTFSQQAVLKHFGHYVLGEPMASIEEVFQEVEAGHTDFGVVPVENSGHGTIQVTLDLFLNSKLKICGEIELRVHQYLMSRSGRLEDIHRIYAHPQSFAQTACWLRANLPHAEKIPVSSNAEGARRASNANDAASIGSESAARVYALSKVFIHSIEDEQDNTTRFLVIGRRIFAPSGCDRTSILVFIRDNPGALFEVLGSFARHGINMNRIESRPSHQVRWEYVFFIDLLGHVEDEPMKQALAELEQHAVKVKILGAYPIALL

SEQ ID NO: 16104 - protein, 411 aa, Xylella fastidiosa Dixon
MSAVSESVLSLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWSAAQGRLPEHRTIVTFRGSFHGRTLGAVTATAQPKYQEGYEPLPGGFRYVDFNHIEALEAAMVGGDVAAVMLEPIQGEGGVMPVVPGYLAQVRALCDRYGALLVLDEIQCGMGRTGTLFAYWQEEVVPDIVTLAKGLGGGFPIGAMLAGPKVAEVMQFGAHGTTFGGNPMAAAVARVALRKLVSVEIAANVQRQSVALRAGLEEISEAFGGVFTQVRGRGLMLGAVLAPLYAGQASAILEVAAEHGVLLLQAGPDVLRFVPALNVSDEELADGLVRLRAALGDYVSRFGG

SEQ ID NO: 16105 - protein, 285 aa, Xylella fastidiosa Dixon
MTTKDTWFTEHFQATGSAIGFRVTGKLDEVQSPFQKIEIYNSTDWGKLMVIDGALMLTSRDNFIYHEMISHPALFTHTAPKCVVIIGGGDCGTLREVLKHPDIEQVTQCDIDEQVTRMAEKHFPELCTSNNDPRATLLFSDGVAYMADCPTNSVDVIIVDSTDPIGPAKGLFNRTFYESCFRALKNDGLLIQQSESPLALLELIKEMRHEMSKAGFKAFKTLPFPQPCYPTGWWSVTLSSKQPNANFAFRQTDAQTKPFDTLYYNAHLHHGVLAPPPFIAHALGE

SEQ ID NO: 16106 - protein, 249 aa, Xylella fastidiosa Dixon
MRPKIVVGNWKLHGSHAFAQALVAQVAAGLPLPGVSVIILPPLLYLSDLTQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 16107 - protein, 456 aa, Xylella fastidiosa Dixon
MVIHSSVLELIGNTPIIKAQRLDTGLCDLFLKLESANPGGSIKDRVGLSMIEAAECRGHIKPGATLVDGAASSTSMGLAFVARQKGYRLILVVPDNMGWEKISNLKAMGAEVILTRSDVSKGHPEHYQDLAEKLAAETPGAYFINQFGNADNPAAHEFGTGPEILKQMGGHVDAVVLGCDSAGTITGLSRAFDSVASDVELILADPVGSILTQYINEGTRSDKSGTWLVEGIGSDCLPPISDFRRIKKTYAISDAESFHTARELLSKEGILGGSSTGTLLAAALKYCREQIERKRVLVFVCDTGNKYLLNMYNDDWMLDNGFLKRPHYGDLRDLILHPYSQRHTVVVDPNDLLTVAYQRMKRYGVSQLPVIEDRQLVGILDESDVLLHVYGDETRFCDPVSTAMVSKLHRLDVKSPIEALLPVFERGQVAIVMEDDQFLGLITRIDLLNYLRRRMQ

SEQ ID NO: 16108 - protein, 496 aa, Xylella fastidiosa Dixon
MSAPFALYDTAAAAALDARLAAHLGDDGDLLMQRAGRAAWDLLRQRWPDARQVLVACGTGNNGGDGYVLACLAHRAGLQVQVVHLPGRGPASLLAQRAYDAYLAAGGQVMLFSGVLETADVLVDALFGIGLNRPLDVPTQGLINALNAAGRPVLALDVPSGVDAERGAVFGTPVCAHVTLQFMVPHVGLYTGPALEAVGERVLAALDVSPALRDALPPCAERWGPQRLASRFRPRRRNSHKGEFGRVLCVGGNWGSGGAIMLSAEAALRSGAGVVHVATREAHVAPLLARCPETMPRGVAGSAELMPLLAAADVVALGPGLGQDSWGQALLAASLDSGCALVIDADALNVLAAAPGSLPPGAILTPHPGEASRLLGCTTAQVQADRRAAAQALAARFAAVVVLKGAGSLIAAPGCLPCVIDAGNPGMAVAGMGDVLTGVIAALRAQGDSVFDAALFGALLHAAAGDLVARDGGERGLLPRDVLPVLRRLINPDSAP

SEQ ID NO: 16109 - protein, 190 aa, Xylella fastidiosa Dixon
MIDPDGYRPNVGIVLMRRDGQVFWGRRVRRDGWQFPQGGMHSDETPVEAMYRELNEEIGLLPEHVQLVGATPGWLRYRLPSQAVRCNRSQMCIGQKQVWFLLQLIGDESHVQLDQSENPEFDHWRWVSFWYPIEHVVMFKRGVYARALCQLASLAQQVVGLEVGTMPQYVQDICLLNVGYKHLPNWVSRY

SEQ ID NO: 16110 - protein, 264 aa, Xylella fastidiosa Dixon
MILPTPAVQLSGVRIERGGRTVLSNVALQVPRGSITTVLGPSGSGKSTMLAALTGELRPTEGEVRLFGDGIPQGPQALLEMRRNLGVLLQGNGLLTDLSVAENVALPLRAHTRMPEPLLQRLVLMKLHAVGLRAVAEAMPRELSGGMARRVALARALALDPPLMIYDEPLTGLDPIASGVIVSLIKRLNDSLGLTTIIVSHHVHETLPICDQAVVIANSTVIFAGTPAQLEASNDALVHQFMHGQPDGPIPFDAAPRTSERSSA

SEQ ID NO: 16111 - protein, 187 aa, Xylella fastidiosa Dixon
MRLVLLGPPGSGKGTQAAQMKETLQIPHISTGDLLRSEVVAGTPLGLQAKQVMAQGDLVSDAILIGMLESRLSHTDVVKGFILDGYPRNLSQAAALDGLLAKFGHPLNAVVQLEVPTDVLVERIAGRAQAEGREDDTPDAVRKRLQVYNDSTAPVIGFYQQRGILLRVDGVGRLDEVSQRIAVALGC

SEQ ID NO: 16112 - protein, 444 aa, Xylella fastidiosa Ann-1
MNHSRSHALFVQAQTRIPGGVNSPVRAFRSVGGEPFFVARADGPYLFDVDGHRYIDYVGSWGPMIVGHNHPAVREAVQVAISNGLSYGAPCAAEVTMAETIARLVPSCEMVRMVNSGTEATLSAIRLARSATGRNYIVKFEGCYHGHGDSFLVKGGSGMLTLGIPSSPGVPTELSKLTITLTYNDFDAATALFEEMGHHIATVIVEPVIGNANCIPPRPGYLQHLRTLCTQYGVLLIFDEVMTGFRVALGGAQALYGVTPDLTTFGKIIGGGMPVGAYGGRRDLMQHIAPTGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPNIIEATLEAARTAFQTIANEAAILSKSETPIKMR

SEQ ID NO: 16113 - protein, 456 aa, Xylella fastidiosa Ann-1
MVIHSSVLELIGNTPIIKAQRLDTGLCDLFLKLESANPGGSIKDRVGLSMIEAAECRGHIKPGATLVDGAASTTSMGLAFVARQKGYRLILVVPDNMAWEKISNLKAMGAEVILTRSDVSKGHPEHYQDLAEKLAAETPGAYFINQFGNADNPAAHEFGTGPEILKQMGGHVDAVVLGCDSAGTITGLSRAFDSVASDVELILADPVGSILTQYINEGTRSDRSGTWLVEGIGSDCLPPISDFRRIKKTYAISDAESFHTARELLSKEGILGGSSTGTLLAAALKYCREQIERKRVLVFVCDTGNKYLLNMYNDDWMLDNGFLKRPHYGDLRDLILHPYNQRHTVVVDPNDLLTVAYQRMKRYGVSQLPVIEGRQLVGILDESDVLLHVYGDETRFCDPVSTAMVSKLHRLDVKSPIEALLPVFERGQVAIVMEDDQFLGLITRIDLLNYLRRRMQ

SEQ ID NO: 16114 - protein, 285 aa, Xylella fastidiosa Ann-1
MTTNDTWFTEHFQATGSAIGFRVTGKLDEVQSPFQKIEIYNSTDWGKLMVIDGALMLTSRDNFLYHEMISHPALFTHTAPKCVVIIGGGDCGTLREVLKHPDIEQVTQCDIDEQVTRMAEKHFPELCTSNNDPRATLLFSDGVAYMADCPTNSVDVIIVDSTDPVGPAKGLFNRTFYESCFRALKNDGLLIQQSESPLALLELIKEMRHEMSKAGFKAFKTLPFPQPCYPTGWWSVTLSSKQPNANFAFRQTDAQTKPFDTLYYNAHLHHGVLVPPPFIAHALGE

SEQ ID NO: 16115 - protein, 190 aa, Xylella fastidiosa Ann-1
MIDPDGYRPNVGIVLIRRDGQVFWGRRVRRDGWQFPQGGMHSDETPVEAMYRELNEETGLLPEHVQLVGATPGWLRYRLPSQAVRCNRSQMCIGQKQVWFLLQLIGDESHVQLNQSENPEFDHWRWVSFWYPIEHVVMFKRGVYARALCQLASLAQQVVGLEVGTMPQYVQDICLLNVGYKHLPNWVSRY

SEQ ID NO: 16116 - protein, 485 aa, Xylella fastidiosa Ann-1
MLRILAEALTYDDVSLVPSHSTVLPKDVKLETRLTRNIRLKLPILSAAMDTVTEARLAIVMAQLGGIGIIHKNLTIEQQVAEVTKVKKYESGVIRDPITVDPETSIRDVLALTRAKNISGVPVVDKGQLIGLVTHRDMRFERELDDPVRHIMTKKEALVTVKEGADSQEVLQLLHKHRIEKILVVNDAFELRGLITVKDIQKKSDYPNAAKDAVTRLLVGAAVGVGGETEKRVETLATAGVDVIIVDTAHGYSQGVLDRVAWIKRYFPQLQVIGGNIVTGDAALALMDVGADAVKVGVGPGSICTTRMVAGVGVPQITAVQMVSDALQDRIPLIADGGIRYSGDIGKALAAGASTVMIGGLFAGTEEAPGDVELFQGRTYKSYRGMGSLAAMEKGSKDRYFQEASDVDKLVPEGIEGRVPYRGSVSGIVHQLMGGLRATMGYVGCATIEQMRTKPQFVKITGAGQVESHVHDVQITKEPPNYRMR

SEQ ID NO: 16117 - protein, 478 aa, Xylella fastidiosa Ann-1
MSEHYDVVVIGAGPAGYHAAIRAAQLGLKVACVDAALGKDGKPALGGTCLRVGCIPSKALLDSSRQYWNMGHLFNEHGISFKDAKMDVATMIARKDKIVKQFTGGIAMLFKANKITPYYGFAQLQPGNVVKVKQHEGKNIELKGTNVILASGSDSVELPFATFDGETIVDNIGALDFTKVPKRLAVIGAGVIGLELGSVWKRLGAEVTILEAMPNFLAAVDADVSKTAAKEFKQQGLDIKLNAKVSRTEISSKNNKKEVIVTYTDASGKQTLTVDKLLVAVGRKAATKGLLADGTGVQLNERGQIMVDEHCHTGVDGVWAIGDCVRGPMLAHKGFEEGIAVAELIAGLPGHVNFETIPWVIYTEPEIAWVGKTEQELKADSIPYKAGSFPFAAVGRAVAMAEPSGFVKVLAHAETDRVLGLHLIGVNVSELVHEGVLAMEFSGSADDLARICHAHPTLSEAIHDAAMAVSKRAIHKAN

SEQ ID NO: 16118 - protein, 496 aa, Xylella fastidiosa Ann-1
MSAPFALYDTAAAAALDARLAAHLGDDGDLLMQRAGRAAWDLLRQRWPDARQVLVACGTGNNGGDGYVLACLAHRAGLQVQVVHLPGRGPASLLAQRAYDAYLAAGGQVMLFSGVLETADVLVDALFGIGLNRPLDVPMQGLINALNAAGRPVLALDVPSGVDAERGAVFGTPVCAHVTLQFMVPHVGLYTGPALEAVGERVLAALDVPPALRDALPPCAERWGPQRLASLFRPRRRNSHKGEFGRVLCVGGNWGSGGAIMLSAEAALRSGAGVVHVATREAHVAPLLARCPETMPRGVAGSAELMPLLAAADVVALGPGLGQDSWGQALLAATLDSGCALVIDADALNVLAAAPGPLPPGAILTPHPGEAGRLLGCTTAQVQADRRAAAQALAARFAAVVVLKGAGSLIAAPGCLPCVIDAGNPGMAVAGMGDVLTGVIAALRAQGERAFDAALFGALLHAAAGDLVARDGGERGLLPSDVLPVLRRLINPDSAP

SEQ ID NO: 16119 - protein, 472 aa, Xylella fastidiosa Ann-1
MSTDHEEEHMTKNAASKARIAYVCTECGTEYSKWQGQCTECGTWNCLSQITLGHAGSVKNPTMKHGNWTGQLDPPKITALKDVQHSEQARISTGIGEFDRVLGGGLVAGAVVLIGGDPGIGKSTLLLQALARMASTLPTLYVTGEESLAQVAGRAVRLDLPLEGLNALAETGIESILQHASSAQPRLIVADSVQTLWTEALTAAPGSISQVRESAAQLVRYAKETGTTVFLVGHVTKEGGIAGPRVLEHMVDAVLYFEGESGSRFRLLRAFKNRFGAVNELGVFAMSEKGLKEVANPSAIFLSGRNSDQPGSCVMVTREGTRPLMVEVQALVDTSPLSNPRRVTVGLEQNRLAMLLAVLHRHGNVLVGDQDVFINIVGGIRVQETAADLPVLLAVRSSLCNRALPEKTIAFGEVGLSGEIRPVPNGEERLREAATHGFKRAIVPKANAPKSAIKDMQIIAVERLDQALEASY

SEQ ID NO: 16120 - protein, 268 aa, Xylella fastidiosa Ann-1
MHRIDETFRRLRAQSRKALIPFITAGDPSLEAAVPVMHALVRAGADVIELGVPFSDPMADGPVIQHSSERALQRGVGLAYVLQTVDVFRQSDAVTPVVLMGYLNPLEIYGIARFTQQALASGVDGVLLVDLPPEEADEIRAIFSAAGLALIVLASPTTSASRLATLSEVAQGYLYYVSFAGVTGADRLDAQSAGDRLRGLRAQTQVPVVVGFGIRDAASATVVAVDADGVVVGSALVTALSDAPDVDTACRRADAFLAPLRQALDAVK

SEQ ID NO: 16121 - protein, 500 aa, Xylella fastidiosa Ann-1
MDGLVVVAVALMVPQARCMMSFACVGLGGEDRRGIARDAGIFWCVVRGITGIGGVSDACLPVLAGVGTAWRCSQAVAVIGGRLVGWTLGVYLLPDEPGQWPFVSIKEIEMSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAQNDEALARKYAALCDVFVMDAFGTAHRAQASTHGVICCAAIAAGGPLLMAELDALSRGLKHPVKPLLAIVGGSKVSTKLELLSNLVNNVEQLITGGGIANTFLAAAGYSIGKSLYEADLIETAREIIIVAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 16122 - protein, 223 aa, Xylella fastidiosa Ann-1
MSNCLIAPSILSADFARLGAEVDAVLAAGADWIHFDVMDNHYVPNLTFGPMVCKALRSYGITAPIDVHLMVEPVDRIVPDFAQAGASMISFHMEASRHVHLTIQLIKSHGCMAGLVFNPATPVDMLDWVLPELDLVLLMSVNPGFGGQRFIPGTLDKLRLVRKKIDLLGRPVRLQVDGGVGIDNIGAIAEAGADTFVAGSAIFHAPDYGDVIAHMRAAVAAVR

SEQ ID NO: 16123 - protein, 502 aa, Xylella fastidiosa Ann-1
MHNGFDALQLHANRLRGVTIPDLLAAELKRPEQYARQVGPLYFNFARQKYDCVALEALFALARNHNVTGAFQRMFCGEQVNVTEGRAVLHTALRGDLSGTSVAVAAYTAAAKVRERMYALIAGLDASEVTDIVSVGIGGSDLGPRLVVDALRPISQGRFRVHFVSNVDGAAMRRTLDMLDPSRTAGILISKTFGTQETLLNGRILYDWLGGSERLYAVSANPERAAHAFDIVSTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDLYTENHFALNANLLAQIEVLANGQLSDNPHRVYPGGNPSTLILLDALTPQALGGLIAMYEHSVYVQSVIWGINAFDQFGVELGKHLAVQLLPALKGESVEVADPVTRAVLLRLRG

SEQ ID NO: 16124 - protein, 374 aa, Xylella fastidiosa Ann-1
MTKPVNTTADKVALSDTALANIRTKIDKIDRDIQTLIAERACYAQQVGQAKSKLAAAMDYYRPEREAQVLRMVVERNEGPLSDEVLVRLFREIMSACLAQQEPLKIGYLGPEGTFSQQAVLKHFGHYVLGEPMASIEEVFQEVEAGHTDFGVVPVENSGHGTIQVTLDLFLNSKLKICGEIELRVHQYLMSRSGRLEDIHRIYAHPQSFAQTACWLRANLPHVEKIPVSSNAEGARRASNANDAASIGSESAARVYALSKVFIHSIEDEQDNTTRFLVIGRRIFAPSGCDRTSILVFIRDNPGALFEVLGSFARHGINMNRIESRPSHQVRWEYVFFIDLLGHVEDEPMKQALAELEQHAVKVKILGAYPIALL

SEQ ID NO: 16125 - protein, 349 aa, Xylella fastidiosa Ann-1
MFINAYGAHAGDKPLESMQIARRAPGAHDVQIDIHYCGVRHSDIHQVRAEWAGTLFPCVPGHEIVGRVSAIGTHVQGFKAGDLVAVGCMVDSCKDCQECDAGLENYCDGMIGTYNFPTQDAPGHTLGGYSQKIVVHERFVLRIRHPEAQLAAVAPLLCAGITTYSPLRHWNAGPGKKVGIVGIGGLGHMGIKLAHAMGAYVVAFTTSESKRQDAKALGADEVVVSRDEERMAAHVKSFDLILNTVAASHSLDSFLTLLKRDGTLTLVGAPVTPHPSPEVFNLIFKRRSIAGSLIGGIAETQEMLDFCAEHGIVADIELIRADGINEAYERMMKGDVKYRFVIDNSTLAA

SEQ ID NO: 16126 - protein, 413 aa, Xylella fastidiosa Ann-1
MPPTKTSFPKQDIRILLLEGVSHSGIETFRAAGYSQIKIHTTSLPEEALQAEIAEAHIIGIRSRTQLNAAVLGHAKRLMAIGCFCIGTNQVDLDTAELSGIPVFNAPYSNTRSVAELIIAEAILLLRRIPQKNAECHRGGWSKSAINSHEARGKVLGIVGYGHIGTQVSVLAEAMGMQVIFYDIESKLSLGNARPAASLDELLGIADVVTLHVPETAATKNMLGHAELARMKPGAHLINASRGTVVEIDALDAALVSGHLGGAAVDVFPSEPKGNSDPFISPLSRHDNVILTPHIGGSTLEAQDNIGIEVAAKLIRYSDNGSTLSAVNFPEVSLPEHVGSMRLLHIHRNVPGVLSHINELFSHHNVNIDGQFLRTDATLGYVVIDISASQTQALALKEALTQVPGTLRTRLLY

SEQ ID NO: 16127 - protein, 249 aa, Xylella fastidiosa Ann-1
MRPKIVAGNWKLHGSHAFAQALVAQVAAGLPLPGVSVIILPPLLYLSDLVQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLDLVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 16128 - protein, 411 aa, Xylella fastidiosa Ann-1
MSAVSESVLSLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWAAAQGRLPEHRTIVTFRGSFHGRTLGAVTATAQPKYQEGYEPLPGGFRYVDFNHIEALEAAMVGGDVAAVMLEPIQGEGGVMPVVSGYLAQVRALCDRYGALLVLDEIQCGMGRTGALFAYWQEKVVPDIVTLAKGLGGGFPIGAMLAGPKVAEVMQFGAHGTTFGGNPMAAAVARVALRKLASVEIAANVQRQSVALRAGLEEISEAFGGVFTQVRGRGLMLGAVLAPLYAGQASAILEVAAEHGVLLLQAGPDVLRFVPALNVSDEELADGLVRLRAALGDYVSRFGG

SEQ ID NO: 16129 - protein, 192 aa, Xylella fastidiosa Ann-1
MNMLNVLRFPVLALALAFVSSGVLADVGSLLDLDYRPLAGKETVNLQRLYGGKVLLVVNTASKCGFTPQYEGLEALHQKLSPLGFAVLGFPSNDFKGQEPGDEQQIQEFCTLTYGVKFPMFQKVHVKGDEVTPLYQRLTQTTGVAPGWNFHKYLIARDGHVVAQFDSRTRPDDPILLEAIKRELAKSVQVVH

SEQ ID NO: 16130 - protein, 244 aa, Lactobacillus gasseri
MTAMIKVEHLKKSFGKKEVLKDISANVDKGKVISIIGPSGSGKSTFLRCLNVLETPTSGKIVFDGQDLTHINEKELDILREKMGMVFQSFNLFPNMNVIENIKLAPMKVKGVNEQDAEKQALELLDKVGLKDRAEQYPSSLSGGQQQRVAIARALAMDPEVMLFDEPTSALDPEMVGEVLKTMQDLADSGMTMVIVTHEMGFAREVSDEVWFMADGYLQEQGSPEQIFENPQSPRAQDFLSKVL

SEQ ID NO: 16131 - protein, 306 aa, Lactobacillus gasseri
MIQLEQLVQKNLAKEKEGKVASYIPALAEVNPKQLGVALYDLDDGEIGEAGQSEVRFAIESISKVITLMLAIKKMGIQEVFKHVGSRQTGFAFNSILNMEIEKAKYPLNPFINAGAIATTSMVVSKTGEGAFEEILSFARDICNDPNLYLDQIIYHSERRTGNLDRSLAYYMESKNMMLGDVVTSLDTYFKQCSMMVTAHSLANLGAVLANGGVKPWDNKRIISDEEARCVKSLMMTTGLYNQSGTYSRLIGVPTKSGVGGGLMSAAPHKYGIGIFSPALDKAGNSVAGLDLLRDIVEGLELDIFD

SEQ ID NO: 16132 - protein, 475 aa, Lactobacillus gasseri
MKEFKFPKGFYFGGATAAYQCEGATKEDGKGEVIWDKYLREQGTINPDPACDFYHRYPEDLELCKEFHINAIRVSIDWARIFPEGEGRIEPRGVEYYHKLFKKCHEEGVEPFVTLHHFDTPQALQDKGGWLSQEMLDAFVEYAKFCFKEYAGEVRYWITINEPTSMAGQQYVGGTFPPAYKDQFDKCFKAEYNQNLVHARIVNAYKEAGYTGQIGIVHALQTVYPATDSEGDKHAAELKDVLENKFYLDGTLAGKYSKHTLALVKEIIDANGQQMIDIKPEDEKVLLKAAKQLDFVGVNYYFSKFMKEYHGDTEIIHNGTGEKGTDVNRMKGVGEEIHPKDLPATDWDWIIYPQGMYDQLKRVYDDYPLVHSIYITENGMGYKDKFEGEDKIIDDTPRIDYLKQHMEEVAKAIEAGIPVNGYFVWSLQDMFSWTNGYSKRYGLFYVDFKTQKRYAKKSAYWYKKLAETREIPPVD

SEQ ID NO: 16133 - protein, 454 aa, Lactobacillus gasseri
MDKCKIVIVGASHGGHESAIELLDKYNDVDVTVYEAGDFISFMSCGMQLYLENKVTAEDDVRNFAPEDVEKKGGHVYANHEVTAIHPENKTVTVKDLTNNSEEEVQYDRLILSSGVTPKVLPVPGNDLKNIYLMRGRDWASKLMSAVNDPAIKNVAIVGAGYIGTEASEVFAKAGKHVTLMDMIDRPLGTYLNSELLDVLEPTFKKNMDLKMGVKIEGFNGNGKVESVKTDQGDVPADLVVVSAGVMPNTDWLKGVVDLDQRGWIKTDPYLRTNVKDVYAIGDAILPLSIPAGKPMPIALATTTRREAQYVVDHIFEDKPDRAFKGVIGASALSVFDYHFATAGLNQFSAAKNKLDYQTSFYEDNMRPAYVPEADNPKVYVSLTFNPYTHQILGGAVLSKYDITAQGNVLALAISHKMRLEDLAEQDFFFQPGFDRQWSLLNLAAQHALGMARF

SEQ ID NO: 16134 - protein, 192 aa, Lactobacillus gasseri
MKIGFIGIGVMGTGIINNLRKNNYDVTVYNRTKAHAQTVLDNGAKWANNPAELTKKVDILFTMVGFPKDVEDIYFGQDGILIVAKAGQYIVDMTTSKPSLAQKIGQIGEEKGLHILDAPVSGGDIGAKNGTLTVMIGGHKEDLNHLHDLFITFASKLNYFGSYGSGQHAKMANQIMIAGTNHDWHDRNAGIC

SEQ ID NO: 16135 - protein, 447 aa, Lactobacillus gasseri
MSKVVHFDASKLTPFVHENELKEMQAMVTAADQELREGTGAGSDFRGWIDLPINYDKDEFDRIKKAAKKIQNDSEVLVGIGIGGSYLGAQASIEFLNSSFYGREKEKYPTVVFCGNSLSGSYLYDLLEWLGDKDFSINIISKSGTTTEPSIAFRVLKDKLIKKYGKEEAAKRIYATTDRAKGALKTEADAEGYEEFVVPDDIGGRFSVLSAVGLLPIAVAGGDIDAMMKGAADARAAYTDPDVSKDNPYQYAALRNILYRKGYTTELLENYEPSLRMFGEWWKQLMGESEGKDQKGIYPSSANFTTDLHSLGQYIQEGRRNLMETVIRVESPEHDVTIPDDKENLDQLNFLSGKTMNYVNDRAYEGVVLAHTDGGVPVMTVDIENQSAHTLGYLIYWFELAVGISGYLNGINPFNQPGVESYKRNMFGLLNKPGYEDLHDDLTKRLK

SEQ ID NO: 16136 - protein, 491 aa, Lactobacillus gasseri
MSFPKNFLWGGATAANQIEGAYDEDGKGLSVTDITTAGSLDAPRMLTYKLNGKLEKTPAIPGAGLPEGAVGAIDPNEYYPNHVAIDFYHHYKEDIKMFAEMGFKTFRLSIAWTRIFPKGDEEKPNQAGLDFYRHVFEECKKYGIEPLVTISHYEDPLYLSEKYHDWGDRKMIDMYVKYATTLFEEYRGLVKYWLTFNEINSTLLMLSSFGNNVTDDKVYQHAYQKLHYQFVASARAVKIAHALDPNYVVGNMICGIVDYPLTPDPKDILANRHMWEQNIFYCGDVQAKGKYPTYAKRLWNEHNVHLDITEQDRKDLLEGKVDIYTFSYYMSNIITTHEVKDKVGGNFAAGVKNPYLKYSEWGWATDPDGLQYYLEVMYDRYDIPMMVVENGLGAVDKISDDGKIHDDYRIDYLRMHIKAMERAIDDGVDLIGYTTWGCIDLVSAGTGQMSKRYGFIYVDRDDEGKGTLKRMPKDSFYWYKKVIESDGKDLD

SEQ ID NO: 16137 - protein, 457 aa, Lactobacillus gasseri
MSKNNSETSEIKTMKRSLTNTHIQLIALGGTIGTGLFLGVGNSIELAGPAVIFIYCLVGFFLFLLMRALGELILSDIKKNTYIDFITEYLGKSIGTTTGYLYWFSWLTLAMAEITALGIYFQYWWPNLQSWIPGLITLLVLLSINLISARVFGNLEFSFAIIKIVTIIAFVILVFYLLITNSATKYGHVSWQNMVIDGGIFAKGPKGFLLGFQMVIFSFIGVELIGLTAAEAKEPKKTITRAIDQLPIRIILFYVLAILSILLAIPWDKVSTSSSPFVQALGATGIKNAGSIINFVVISAAISSTNSFIYSAGRLLFSINYKGKTKLSKHLGKLDRRQLPKNALIFSTILIALAPLLNFFLKDTFTFISATATSMFLVIWSIMIITHMTYRKKTPENELPTFKMPLYPLSDVAVLTFFLAMIIILLIFPNYRIPMISAGIIFVVLVCITHFIQKKMN

SEQ ID NO: 16138 - protein, 443 aa, Lactobacillus gasseri
MKTIKNIIIGFGKGGKTLAKFLAQKSEEVLVIEKSNKMYGGTCINIACLPSKRLIIEAANGVSYVDAVSGKNEMTAQLRNKNYHMLADEQTVTVLDGEAHFIADHEIEVVLTNGKKEQFKGERIFINTGAVPVMLPIPGLKESKYILDSTQAMDEKKMPENLTIIGAGYIGLEFASMFAKYGSKVTVLDHSREFLSREDDDISQLVKKDLEDAGVHFELGADIEEIIDEENEAKVRYQINGQEKEISANRILAATGRKPNIENLGLENTSIEITDRGAIKVDDFLRTTVDNVWAIGDVKGGLQFTYISLDDFRIIKDQLFGTGARMISDRKVVPYSVFISPALSQVGLNEKQARNQNKEYKLFKLPVAAIPKAKVAKDSRGLFKALVDPETEEILGATLYGIESYELINLISLAMKAHLSYTVLRDQIYTHPTMSEAFNDLFK

SEQ ID NO: 16139 - protein, 189 aa, Lactobacillus gasseri
MQNSDNIDNIIDRVLFSQDDIEEICQRLGKQLTEDYAGKFPLVIGVLKGAVYFMTDLTRHMNVKMQNDFMDVSSYGDGFESSGKVRLDIDVQADVKDRDVLLVEDIVDTGHTLKFMKDLLNKRGAKSVKCCALLNKTERREDNVVVDYYGSKVENAFVVGYGLDYLNAYRNLPYVGVLKPEVIQANLNR

SEQ ID NO: 16140 - protein, 428 aa, Lactobacillus gasseri
MLKSVIENVHALEIFDSRGNPTVEVFVTLSNGVVGKAEVPSGASTGENEAVELRDGGSRLGGKGVMNAVNNVNTEINDALKGLDPHDQPNIDATMIALDGTPNKGRLGANAILGVSMATACAAAKDNHQPLYRYLGGTDLEMPQTFHNVINGGEHADNGIDIQEFMITPVAKTSFRDGFEKIVNVYHTLKKVLEDMGYETGLGDEGGFAPNMKNSEEALKALHESIIKAGYKPGEDIAIACDCAASYFYNKEDGKYHLEGKVLTDEELADYYDKLLDEFPELISMEDPYDENDVEGMVKFTESHKDRIQIVLDDFICTNPKLLNKAIHEGAGNASLIKLNQIGTVTETLETIRLSRKNGYNTMISHRSGETGDTFIADFAVAVNGGQLKSGAPARSERVEKYNRLLEIEEELGKGERLAFFPDNVDLD

SEQ ID NO: 16141 - protein, 388 aa, Lactobacillus gasseri
MAQRDYYDVLGVDKNASESDINKAYRKLAKKYHPDLNHEPGAEEKYKEVNEAYEVLHDKQKKAQYDQFGQAGVNGQAGFGGQGYGGFGGQGGYSSQGFGDFGDIFGDIFGSAFGGGRSRVDPTAPQKGQDLDYTMTIDFMDAIKGKKTDITYTRSEVCPTCDGSGAEKGTHPITCDKCHGTGVMTVTRQTPLGVIQQQTTCDKCGGRGTIIKHPCQTCHGKGTIDKKQTLEVKVPAGIDNGQQIRLSGQGEAGKNGGPYGDLYIVFRVKPSKEFRRNGTTIYSEAPISFAQAALGDKIRVNTVHGPVDLTIPAGTQPNTNFKLRGQGVPKINGTGNGDQEVTVKVVIPKKINDKQKEALVDYVKAGGGNISPQEKNFFERLKDKLNGE

SEQ ID NO: 16142 - protein, 492 aa, Lactobacillus gasseri
MKYYHVPQDFRWGVATAANQVEGAWNEDGKGLSIADCERYDPKKAKAGYKVANDITSSEIQKAIKDKKSDGWGKRHGVNFYHTYPEDIKKLAATGINTFRTSIAWSRIFPNGDDPEPNEKGLKFYDNLFDELHKYNIEPIITLSHYEMPLNLVLNYDAWYDPKVRDYFMRFAKIVVDHFHKKVKYWIPINEIDSILRHPFSSAGLVKDRFPNKNFEKVIYQAMHNQFVAAALITKYIHENYTDLVVGSMITSTMVYPYNSDPRNSLKSVQVMRESYNFSDIQIRGNYPLNLLSKLKKLNVKITEKELKVIRDNTADFVAFSYYSSICTAFDTIGLKITKANRTEGVYNKYLPTSDWGWQIDPVGLRIILINLYDRYQKPLFIVENGLGAKDSLTESGKVHDDYRIDYLRKHIRQMLISLENDGIELMGYCMWGMTDMISASTTQMSKRYGLIYVDLDDLGNGSYRRYLKDSYFWYQKLLSFGDKIPKDYLDK

SEQ ID NO: 16143 - protein, 443 aa, Lactobacillus gasseri
MKKYDYIILGTGPAAYQFIKLLATQRKSILVIESGLFGGTCPNVGCEPKIYLDGAVQAALLSRQLESHGIEQAATINWSQLMKEKKERFASWPSETRKNISKICDVVSGSAHFIDQQTIAVNQRYFQGNKIIIATGRRPHELSIPGAKFLHDSSDVLSLNKVSEHVTFIGAGYVAMELATFLAAAGSQVTILVRGKHVLRHFYQKYSAELVTRMVQRGIQFKFATEATCITQLSDKYVVELNQGSSLVTDYVVNASGRTSNIEKLDLSAAQIDYSPKGINVDQHLQTSVKNIYAIGDVTSQDVPNLTTVAEFQSHYLFNSLEKGLSQPINYPAIGTGVFAFPQLAQAGINPDSVSEDKDNFEIVEYELSQSSLYAGQKEKGLLTVVYDKANYIVGVSEISTSAVNDVNYFVPIIGLRIRKNEWHQNVLPIYPALADKIEGILR

SEQ ID NO: 16144 - protein, 384 aa, Lactobacillus gasseri
MSLWETKFAKKGLTFDDVLLIPAESHVLPNEVKLDTKLAPNLQLHIPLISAGMDTVTEGDMAIAMAENGGLGVIHKNLSIEAQVEEVKKAKTKAVDPNLSHPAVDTQGRLLAAAAVGVTSDTFERAEALLKAGADAIVIDTAHGHSAGVLRKIKEIRDHFPKATLIAGNVATGEGTAALFDAGVDVVKVGIGPGSICTTRIVAGVGVPQITAIYDAANVAQKYGKKIIADGGIKYSGDVVKALAAGGNAVMLGSMFSGTTEAPGTIFTNEGKKFKSYRGMGSVGAMSQQHGSSDRYFQGGVNEANKLVPEGVEALVPYKGDVSNIIYQIDGGLRAGMGYVGAGTIEELIENSQFVQITNAGLRESHPHDVQMAKEAPNYGGSDL

SEQ ID NO: 16145 - protein, 156 aa, Lactobacillus gasseri
  misc_feature (96)..(155): Xaa can be any naturally occurring amino acid
MENKKSMPKLKRSMTAGQMEMISLGGAIGVGLFMGSTSTIKWTGPSVLLAYMFVGLILYIVMRALGEMLYVNPGTGSFADYATEYVHPLAGYLAEXXXXXXXXXXXXXXXXXXXXXXXXXXXXXXXXXXXXXXXXXXXXXXXXXXXXXXXXXXXXG

SEQ ID NO: 16146 - protein, 466 aa, Lactobacillus gasseri
MNENETSKLGFWSIVLLAINSIIGSGIFLTPGSVVQQAGSKALIVYFIAAIFASILAISFAAAAKYVTKSGAAYAYSKAAFGNNVGFYMGILRYFSASVAWGVMAVGVIKSTISIFGGNPNKTMSVTIGFLILMAVITIINLFGQKVVKYVMNLATIGKLAALVLIIVAGVVLLIMTGASSNLNEVDQITQNGQKIVPTLTTTGFVMAIVSAFYAFTGFESVASGSDDMKNPAKNLPRAIPLAIIVIAIVYIGVVAVAMMLDPKSLMTTKQVVAIAAIFKNEILRDVILVGALISMFGINVASSFNAPRILEAMARENQFSKSLTKRTKNNFPIRTFFISVLLAILIPMAFEYNMVNLITLSAMVRFLGFIVVPLAVIQFYRGKTAETVLNAQKNIWTDIVVPILSIVLVIFLLVEYNWKAQFGVVNASGQVTGINWYAIAMMIFGFIVLPLIMFFISRKDRKASK

SEQ ID NO: 16147 - protein, 448 aa, Lactobacillus gasseri
MCTMSKTITAEDIKKSVKDNDVRFLRLAFTDINGTSKAVEVPTSQLDKVLTNDIRFDGSSIDGFVRLEESDMVLYPDFSTWAVLPWGDEKGGKIGRLVCSVHKTNGEPFEGDPRNNLKRILKEMNDMGFTDFDIGFEAEFHLFKLGEDGNWTTEVPDHASYFDMTSDDEGARCRRDIVETLESIGFEVEAAHHEVGDGQQEIDFRFDDALTTADRVQTFKMVVREVARKHGLYATFMAKPVEGQAGNGMHTNMSLFKDGKNVFYDKDGEFHLSDTALYFLNGILEHARAITAIGNPTVNSYKRLIPGFEAPVYISWASKNRSPLVRIPDAEEINTRLEMRSADPTANPYLLLAACLSAGLNGIKEAKKPMAPITSNVFEMSEEERAERGIKPLPSTLHNAVKAFKADPLIQKALGEHLTQSFIDSKNLEWSKYNQSVSDWERDRYMGY

SEQ ID NO: 16148 - protein, 449 aa, Lactobacillus gasseri
MDEKEKLKLKRSLKSRHVTMIAIGGAIGTGLFLGSGTAIQSAGPSIILSYLIVGIISFFMMRALGELILAEPDQHSFIESVKKYLGNRMEFVAGWTYWLCWLSLAMADLTATGIYLKYWFKDLPQWVGPLVIVVLLMLVNMVNVGLFGELESWFSMIKVLAILALIVTGLILLVMHSKIDSRTVSLSNLINYGGFFPTGSWGFLKSFQMVVFAFVGIEIVGLTAGETANPDKDIPKAINTLPVRIGLFYVGSMIAIMAVYPWNKIVTTTSPFVQVFGAIGIPAAAGILNFVVLTAAMSATNSAIFSTSRSLYALSRGNNAPKRFGKLSRKAVPNNALTFSSLILFIVVILNYIMPAQVFDIISSVSTINFIMVWIIIMWTHLKYRAENKGKLGSFRMPGFPITSWVTIIFYLVILIILALIPATRLPLLISIIFILALALSYTLLERKN

SEQ ID NO: 16149 - protein, 252 aa, Lactobacillus gasseri
MNNNNEENILQVQHLQKKYGDHTVLKDISFDINKGEVMTIIGPSGGGKSTMLRCINLLEEPSNGKILFHGNNILDSHFDRNKFRSKVGMVFQQFNLFNNKNVLQNCMIGQEMVLGRSKEEAKKVAIENLKKVGMEPFLTAKPQQLSGGQQQRVAIARAISMDPEILLFDEPTSALDPEMVGEVLNTMQLLAKTGLTMVIVTHEMGFARDVSDQVIFMSDGVITEQGTPQEIFNDPQEEKTKKFLRNFRSNEL

SEQ ID NO: 16150 - protein, 497 aa, Lactobacillus gasseri
MTKTYSMPKNFYWGGASAANQYEGGYNEGGKGLNAIDVLTNGSATEPRKVTWKTNDGKTGVTPMTWGKEFKLPDGAKPALLDNYYYPSHEGTDFYHHYQEDIKYMAEMGFNMFRLSLNWSRILPNGDDQEPNKEGLAFYDKVFDECAKYGIEPLVTLSHYETPLSLINRFGGWKDRKMIDIFVHYADIVMNHYKGKVKYWLTFNEINAMDMAPYMGGGLIDGSKQNRAQGAHNQFVASSKVVKLAHEIDKNNQVGQMLAYSAYYPYTSDPADQLLVMKAKQEMLFYSDVQTGGRYPEYRLKEYERDGIKLDDRPEDYELIEKYPVDFLSFSCYTSNVLTTHEADAKANGNMSAGGVKNPYLDYNAWGWATDPDVLRIALNDLWDRYHKPLFIVENGLGWGDELTKDHKVHDDYRINYLRAQIKSMEEAVNEDGIPLMGYTMWSAIDLVSNGTGEMKKRYGFVYVDRDDKGNGSLKRYPKDSFNWYKKVIASHGKDLD

SEQ ID NO: 16151 - protein, 459 aa, Lactobacillus gasseri
MAKVKTRYKCRNCGYISASYLGRCPNCGAWNQFEEETQEVKKVSTKATASRLMTKIGNNDPVKLNEVKAEKEKRIVTPFEELNRVLGGGIVPGSLVLIGGDPGIGKSTLMLQITGALAKEHSVLYVSGEESASQIKMRADRLGVSNSGILLYPETNMQNIREQIDEIKPDFLVIDSIQTMNEPSLDSMVGSASQVREVTSELMKIAKNDQITTFVIGHVTKEGAIAGPKIMEHMVDTVLYFEGDGHHSYRILRSVKNRFGAANEIGMFEMKNEGLTEVNNPSAIFLDERLPNSTGSAVVVSLEGTRPLLADIQALVTPTAFGYAKRTTSGLDFNRVALLLAVLEKRGNLMLQNQDAFLTATGGIKLNEPAIDLAICMAVASSYKNKEISATDCFVGEVGLTGEIRRVNQIEARVKEAAKVGFKRIFIPKHNLTTELKNNSAIEVIGVASLPQALKLVFN

SEQ ID NO: 16152 - protein, 215 aa, Lactobacillus gasseri
MSGNKVLELKNISKSFGTRKIIDKLNLSLDQGDILSIIGPSGAGKTTLLRLIAGLESADSGKFIHNGKEFDPTDRNNHLLGMVFQDYNLFPNLSVMDNITLAPIMVNKMSKADAEKVAEPVLKQLDLEKFKNLYPYQLSGGQKQRVAIARALQMKPEILCYDEPTSALDPELVGKVKEIFLKLKQTGMTQVVITHDHQFGKAVADKILKVEPIEK

SEQ ID NO: 16153 - protein, 462 aa, Lactobacillus gasseri
MQQFGVIGLSVMGKNLALNVKNHGYSVSGFSIDKPEVDALAKYEDKDLKPTYTWEEFVNSLEKPRKILVQIMAGKPVDETLQKLLPLLDKGDIVIDGGNSNFYDTNRRYEEMEKHGIHFIGMGVSGGEEGALNGPALMPGGDEKAYEEVSPILEAMAAKTPTGQPCVGYIGPAGSGHYVKMVHNGIEYGIMQIISEVYDVLRTVGHYSNDEMSEIFKNWDKGALQAYLIEITAKVLKQKDNLTDDHIIDHILNEASYKGTGNWMLEDAIRLGAPITVIAEAVLARFMSKATLRDDPEPKIDPEKAPKDLVDQLAKALYLAMAVSYGQGFEQLTMAAKAYNWRLHYSTIAQNWEAGCIIRSQMLHDIKFAYNADKDLPNLFKAPFFDKVKKENISALREVVKIAADAGVPTPTLSAALNYLESIFNPRLPQNIIQGQRDYFGAHTYQRNDRPGTFHTEWYEEK

SEQ ID NO: 16154 - protein, 490 aa, Lactobacillus gasseri
MFYPQIDQDDSLILHTDLYEINMMYTYFKKGISERNSVFEVFFRKEPFGNGYAVNAGLSHVIQYLNNLHFKESDLKYLKETCGYDDEFIDYLRNLKLKLTIRSAREGELVFANEPIMQIEGPLAQAQLVETAILNIINFQTLIATKAARIKVAVGNDGLMEFGSRRAQETDAAIWGTRAAYIGGFDATSNVRAGKLFGIPVAGTHAHSLVEAFNNEYDAFKAYAETHKDCVFLVDTYDTLRSGVPTAIKVAKEMGDKINFQGVRIDSGDMAYISKKVRKQLDDAGFPDAKIYASNDLDEKTIQNLKMQGAKIDVWGIGTKLITAFDQPALGGVYKLVAIEDKDGNMRDTLKISSNAEKVSTPGKKQVWRIQANSEKKNEGDWVSRYDEDPRKFDALFMFHPQYTYINKVVTDYTARPLLHEIFHEGKLVYQEPTLKETKEFAANNLDGLWDEYKRSLNPQDYPVDLSQKLYDNKVNLINDIRSRIVKRGY

SEQ ID NO: 16155 - protein, 230 aa, Lactobacillus gasseri
MSKLVLIRHGQSEWNLSNQFTGWVDVNLSEKGVEEAKKAGRLIKEHGLEFDQAYTSLLTRAIKTLHYALEESDQLWIPETKTWRLNERHYGALQGLNKKATAEKYGDEQVHIWRRSYDVLPPAIDDDNEFSQAHDRRYANLDPHIVPKAENLHVCLDRVMPFWEDHIAPDLLDGKNVIIAAHGNSLRALTKYIENISDDDIMNLEMKTGEPVVYTFDDKLDVVNKEKLDD

SEQ ID NO: 16156 - protein, 178 aa, Lactobacillus gasseri
MNNDIERILYTQSDLDSRMDEMAAELNVKYKDEEPIVVPVLNGAMIFASDMIKRLNFKLTIDPIKASSYAGTQSTGEVKITQDIKSDVKDRPVIFMEDIIDTGRTLQALSEVMKGRGAKSVEVVAMLDKPETRVVDFHADYYGFKAPDEFLVGYGLDYNGLYRNLPYVGILKHEVYAN

SEQ ID NO: 16157 - protein, 149 aa, Lactobacillus gasseri
MINLILLGLPGAGKGTASESIVDKYHLAHISTGDMFREAMANETPVGLEAKSYIDKGDLVPDEVTAKLVEERLKQPDTKNGFILDGFPRTTVQAELLEGITKRLEKPLTNVIAIDVDEDVLIKRLSARYICKNCGATYNKISNPTKVEG

SEQ ID NO: 16158 - protein, 432 aa, Lactobacillus gasseri
MSVITDIHAREVLDSRGNPTVEAEVYTELGGFGRAIVPSGASTGEHEAVELRDGDKSRFGGQGVLTAVENVNGEIAKAVIGLDVTDQRLIDQTMIDLDGTPNKGRLGANAILSVSLASARAAADELGLPLYEYLGGPNAHVLPTPMMNVINGGKHADNNVDIQEFMIMPVGAKSLHEAVRMGAETFHTLKGLLQERGESTAVGDEGGFAPNLKNNEEPFEILVEAIQRAGYKPGQDIAIAFDCAASEFYNKDTKKYVTVADGREYTAEEWTSLIEDLVDKYPVISVEDPLDENDWEGWKTFTERLGDKVQIVGDDLFVTNTSYLEKGIKMGVANSILIKLNQIGTLTETFEAIEMAKEAGYTAVVSHRSGETEDTTIADLVVATNAGQIKTGSMSRTDRIAKYNQLMRIEEALGSTAQYKGIHSFYNLHKQF

SEQ ID NO: 16159 - protein, 251 aa, Lactobacillus gasseri
MRTPIIAGNWKLHMNPEQTVEFVNAVKGKLPDPSKVESVIAAPAVDLYVLKKAAEGSDLHTGAENAYFEVEGAFTGETSPKVLNEMGIDYCIIGHSERRGYFHETDEDINKKAKALFANGVTPIICCGESLETREANKQEDWVVAQIKAALDGLTAEQVSKLVIAYEPIWAIGTGKTASADQAEEMCKTIRETVKDLYNEETAENVRIQYGGSVKPANVKELMSKPDIDGGLVGGASLDPESFLALVNYQD

SEQ ID NO: 16160 - protein, 403 aa, Lactobacillus gasseri
MAKLIVSDLDLKGKKVLVRVDFNVPIKNGVIGDDNRIVAALPTIKYIIEHGGKAILLSHLGRVKSDADKKELSLRPVAERLSELLKKPVTFVPENEGKEVEETIDKMKDGDVIVLENTRFQDIDNDFGKRESKNDPKLGEYWASLGDVFVNDAFGTAHRSHASNVGIATAMKKAGKPAAAGFLLEKEIKFLGDAVENPVHPFVTILGGAKVSDKIGVIENLIPKSDHILIGGGMAYTFLAAQGHKIGKSLFEADKVELAKELLAKAGDKIVLPVDNVAATEFSNDAPHEVVGDDIPDNEMGLDIGPKTVEKFRDILKDAKTVVWNGPMGAFEMPNYAEGTLEVGRALADLKDAVTIIGGGDSTAAAKQLGIAPKISHISTGGGASLNYLEGKELPGIACVSDK

SEQ ID NO: 16161 - protein, 151 aa, Lactobacillus gasseri
MSNNLDTTLPLFVEAGADILEFHYEATNKPDYWLDYLKDHNVRCGMAINPSTPVNKLKPFLNKLDQVLLMTVKPGFGGQKFEEAAVERLAELQDMIKDENLDLPIEVDGGLDRETLKLTRDAGAKIFVAGSYIFKNGSIEDQVIKLKKEDK

SEQ ID NO: 16162 - protein, 184 aa, Lactobacillus gasseri
MNFIKNYFHLEKLGTNVRTEFIAGLTTFISMSYILFVNPSVLGASGMNTGAVFTATALAAALGTAIMGIVANYPIGEAPALGINAFFAYTVCIGMKVSWETALASVFVASIIFILITLFKLREKIIDSIPSDLKFAISSGIGLFIAFLGLQNGGLIVANKSTLVGLGSLHNPLVWITIFGLIVT

SEQ ID NO: 16163 - protein, 211 aa, Magnetospirillum magnetotacticum MS-1
  misc_feature (178)..(178): Xaa can be any naturally occurring amino acid
MNAPTGRLGHGALTPLVVASTVGAALGGFMFGFDTAVVNGAVDALKAELGVGSALVGVIVASALLGAAVGAFAAGTIADRFGRRRLMMVAGTLFVTTSVLCAVAHDGPTLALWRFLGGVGVGMASVVAPLYIAEIAPARLRGRLATAQQMSIVLGIFAALVSNAFLVRAAGGAEAELXLGLSDWRWMFLVAVVPSLAYVVPGGLVAEFPGT

SEQ ID NO: 16164 - protein, 170 aa, Magnetospirillum magnetotacticum MS-1
MVLTRFPRAPLTEGPTPIRSLDRLSTHLGAELNGVRLFVKRDDVGPVGLGGNKLRKLEFLLGQALADRADTVITVGALQSNHARLTAAAAARMGLACELFLTRSVPRDDADYTGNGNRLLQDLFGARIHLLPGEADSLAEAEARADMLRSQGRRVCVFPSGGSSPLGWLG

SEQ ID NO: 16165 - protein, 397 aa, Magnetospirillum magnetotacticum MS-1
MIVIEEGLPTPLGAHFDGRGVNFALFSQNATRVDLCLFEPGARHEHRTIRLPCRTDDVFHGYLHGLLPGQLYGYRVFGPWDPAAGHRFNPSKLVLDPYAREIAGRIRWHDALYGHRRGGAREDQIDRRDSAPFLPRGVVTRPETPDPIALPASRPLHETVIYEAHVKALTMTHPALSDAERGTYLGLAHPAIIEHLLKLGVTALELLPIQAFADDRFLVEKGLVNFWGYQPYNYFAPEPRYLGDGDASGLRFAIRELAAAGIETLLDVVYNHTAEGDHLGPTLSFRGIDNASYYKLDPDDPRRTVDCTGCGNTLNVAHPRVMRMVLDSLRHWVTAYGVAGFRFDLASSLGRAPLDFSPQAAFFQAVQQDPVLSRVKLIAEPWDIGMGGYRLGGYLNA

SEQ ID NO: 16166 - protein, 210 aa, Magnetospirillum magnetotacticum MS-1
MEITLEHGDALEAMDQSVRYIRLVKAVAHKHGMQATFMAKPFDHLAGTGMHMHVSLADAEGRNLFASEDPAGTPLLRTAIGGMLASLLDSLLLFCPYANSYRRFQANSYAPLAPTWGVDNRTVSLRVPGGPANTRHIEHRICGADANPYLAAAAILAGIHRGIKEDIDPGEPVEGNGYAQAKELLPTDWLTSLTALENSVWARDALGQEF

SEQ ID NO: 16167 - protein, 160 aa, Magnetospirillum magnetotacticum MS-1
MVAPPILSLRFSETGRTRFTVHVEPGPHIHRSLQTIRALGRRAGVALNPGTPASAIEPLLDMVDLVLVMTVNPGFGGQSFIHSALETVSRVKALVGGRNIDISVDGGITPETAGPAAQAGANILVAGSAAFKGGPAAYQKNIAAIREAAGAATGRDGVRC

SEQ ID NO: 16168 - protein, 156 aa, Magnetospirillum magnetotacticum MS-1
MRRAKIVCTIGPATESKEQLRALVDAGMDVARINRSHGSAEEHAAVYHGVREAAAESGRSVAVLVDLQGPKIRLGRFAGDEKHWLEEGDTFTITTEDVVGTKELVSTTHKGLPGDARVGDPILIDDGKVLVRVTGVEGPRVVTRVEVAGPVSNNRA

SEQ ID NO: 16169 - protein, 110 aa, Magnetospirillum magnetotacticum MS-1
QRQASDFFYKEELNGLKDQKVLTRLSLAWSRDGGEKTYVQDRMRENGAELWKWLEGGAHFYVCGDAKRMAKDVERAIIDIAAQFGGKNPDEAVAYLAALKKAGRYQADVY

SEQ ID NO: 16170 - protein, 297 aa, Magnetospirillum magnetotacticum MS-1
CAIRQDATPKLRTSRTRIREGSPHPRGATWDGRGVNFALFSAHATKVELCLFDDAGEKEIERIALPEYTDEVWHGYLPDARPGTIYGYRVHGPYEPEAGHRFNPNKLLIDPYAKGLVGTIEWNPALFGYKMETGDDLTFDERDSAPYTRRSRVIDPAFTWGRDAKPRVPWERTIVYETHVKGFTKLHPAVPEKLRGTYAGMGHPAVLDYIKSLGVTSVELLPVHSFVQDDYLQQKGLINYWGYNTISFFTPARRYAAVPDFAFSEFKEMVARMHGAGLEVILDVVYNHTAEGNEGDP

SEQ ID NO: 16171 - protein, 265 aa, Magnetospirillum magnetotacticum MS-1
MPTTIFHENERTMASKRVPTSPYPDQKPGTSGLRKKVPVFRQPHYVQNFVQAIIDCIPDHRGATLVIGGDGRFFNKEVAQIALKIAAANGFGRVLVGRDGLLSTPAASCVIRKHKAVGGIVLSASHNPGGPQGDFGIKFNGSNGGPAPESVTTAIYERTKAIGEYRISDAPDLDLGQIGTTVIDGMTVEVIDPVADYAALMRERSFRRLSNWSPPLPMASCAWGTGPCRGLRGLGPRRLTGPAVGPPTYAVPPYILGTVGLRGQL

SEQ ID NO: 16172 - protein, 157 aa, Magnetospirillum magnetotacticum MS-1
MAEASRENILPVILCGGSGTRLWPASRESMPKQFTPLVDPETSTFQATVRRVADGSVFARPTVIASAESRFIVAEQLAQARIAADILLEPERRDSAAAVAVAALHGARLGPETVVLVMAADHVIEDSAAFTQAAQQAAIGARLGQIMTLGITPTRAA

SEQ ID NO: 16173 - protein, 217 aa, Magnetospirillum magnetotacticum MS-1
MVISSDPCANALKIITRFPRIEGLPVAFFANQPLVLPGVLDSNASRKPARFVRFCNAFSIPIVTFVDVPGFLPGTAQEYGGLIKHGAKLLFAYSQATVPLVTIITRKAFGGAYDVMASKHVGADLNYAWPTAQIAVMGSKGAFEIIFRAEMGDEGKIAERTKEYEDRFLSPFVAAERGYIDEVIMPHSTRKRIARALGMLRTKEMEQPWKKHDNIPL

SEQ ID NO: 16174 - protein, 294 aa, Magnetospirillum magnetotacticum MS-1
MSPTIASPRGTGLDKVVASAAEAVADVPDGASLAVGGFGLCGNPIALIEALLAQGTRDLWVVSNNCGVDDWGLGVLLGAGRIRKMTSSYVGENKEFERQFLSGELELELTPQGTLAEKLRAGGAGIAGFWTRTGVGTQVAEGGLPQRYDGAGGVAQASAPKEVRTFGVGPRGRDGSFADEAEFVLEDAISTDYALVHALRGDRHGNLVFHRSARNFSPLAAMAGRVCVAQVEELVEPGEIDPDAVHLPGVFVHRVVEVGPDVPKRIERRTVRSAAATDQPAPAPSGTATTVKEG

SEQ ID NO: 16175 - protein, 345 aa, Magnetospirillum magnetotacticum MS-1
GLFAILDEVGALAGWNVTVGGGMGMTHGEADTFPRTADVMCFCEPEDALKVAEVVMTVQRDWGNRKSRKNARLKYTIERFGLDAFRAEVERRVGKAFAEPKPFRFENNGDRYGWTEGEDGRHHLTLFIQNGRVRDFKGGPQLLTGLRRIAEVHQGEFRLTANQNVLVANVPAEKRAEIEALVAEHGLTAHAGTLRRNSMACVALPTCGLALAESERYLPTLIDELEACLARHGLAEDEITIRMTGCPNGCARPYIAEIGLVGKGPKRYNLYLGAAFDGSRLGKLYAEDVADSAIVEVLDPLLAAYKVQRSYGERFGDFLVRTGYVAMTTNGPNFHEQTGCLRGLS

SEQ ID NO: 16176 - protein, 365 aa, Magnetospirillum magnetotacticum MS-1
MKDILEKLEERRAQARLGGGERRLEAQHKRGKLTARERIELLLDHGSFEEFDMFVQHRSTDFGMENQKIPGDGVVTGWGTVNGRTVFLFSKDFTVFGGSLSEAHAAKIVKVQDMALKMRAPIIGIFDAGGARIQEGVAALGGYGEVFRRNVAASGVIPQISVIMGPCAGGDVYSPAMTDFIFMVRDTSYMFVTGPDVVKTVTNEVVTAEELGGAKVHTSKSSIADGSFENDVEAILQIRRLLDFLPANNIEGVPEIESFDDVNRLDKSLDTLIPDNPNKPYDMGELIRRVVDEGGFLRDPAAYARNIITGFAASRGVRSACPNHPLCCRVLDRRFAQPPLLRFATPFDSDLHLSTPAPSERAICA

SEQ ID NO: 16177 - protein, 388 aa, Magnetospirillum magnetotacticum MS-1
PPHSLPRGSLSLLLTSVFAGGAVGAPVFGLLGDRFGRRRALQASLGLMAIGSIAAAMSSGLTSLTIARAVSGFAIGGFPPLVATYLAEVMPPRRRGAMLMTCAGIGFLGGSAVISLIQVLSPAAPLGIEPWRWALIVGAVLSALAAALFAFVSESPRWLASTGRAREADRACREFEQAARMRPAAAPAGPFPEPPHSGQADARPPLARRSATRRTALFVALYALAPWATLGFPLLSAVVLLEKGYRIDQSLLFAALSMLGPPLGTLLAALVIDRLERRACLAALAGTMAILGTVFAASDAFLTLVLVGIAFNTAAASYGAILSIYATEVLATRLRASVLTWAWAGGRVASALAPFVFCLPWPPTVPRAVNRVRASPAGGASGGPRVSA

SEQ ID NO: 16178 - protein, 431 aa, Magnetospirillum magnetotacticum MS-1
MFETDPDTFERAGLGQLDEAGSAALMKSIFSDILGDHPVLTNRSIWRQFPMIRNARWVRGNRVLLGDAKATAHFSIGSGTKLAMEDAIALYEALVAEAEVPAALDRFEKGRREEVEKIQHAADVSLVWFEHVARYLDFEPVQFAFGAMTRAKAITYDNLRLRAPGFVAQMDRAFAEGVRREGFDVSLDKPAAPMFQPLRLREMVVPNRVAMSPMCLYAATEGVPNDFHLVHYGSRAIGGPGLMFTEMTCVSRDARITPGCAGLWNDAQETAWRRIVDFVHANAATKFCLQLGHAGRKGATKRMWEGIDRPLESGGWEVMSASALPYFPDSTVPREMTRADMDAVIADFVAATRRAERAGFDMLELHCAHGYLLASFLSPLTNHRSDVYGGSVENRLRFPLEVFTAMRAAWPAERPMSVRVSATDWAEGGLT

SEQ ID NO: 16179 - protein, 182 aa, Magnetospirillum magnetotacticum MS-1
MARRGWTVADIPSQAGRRAVVTGASAGLGYETALALAGAGAAVVLAVRDAAKGARAAEAIARAHPGADLAVRLIDTASLASVRAFAADWPARQPIDRLILNAGIAAVPSREESVDGFERQLATNTLGHVALTGLLLPVLSPTAGSSRWRASPIAAAGSASTTSTGARVTGRRPPTVRASSRS

SEQ ID NO: 16180 - protein, 335 aa, Magnetospirillum magnetotacticum MS-1
FRDDVRGYWKGDAGLLPGLASRITASADKFNKRGRRPWASVNFITAHDGFTLNDTVSYNEKHNEANGEGNRDGHGHNLSYNYGVEGPTDDPEIRSVRLRQMRNMLATLFLSKGTPMLLAGDEFARTQQGNNNAYCQDNEVSWVDWGAIGPEERDLAEFTQRLILLRNALPMLSRGRFVTGAYDEEFGVKDVTWLTPTGTEMTPENWNDGNSRTLAVLLDGRAQASGIHKRGGDATLLLFYNAYHDVVDFTFPEAPGGTAWTRLLDTNLPDSQEIASFAVGESYSVTGRSMLMFVLKPVESEGEDHTEMERSYQYVMQAFERANVESVSFGIDDEA

SEQ ID NO: 16181 - protein, 339 aa, Magnetospirillum magnetotacticum MS-1
HNLTGPGGTVLVQRGTLFTGDIVVAGAEWGRIRALIDDTGKHFPYAGPSVPVEVLGFNGTPDAGDRVIVVPNEARAREVTEYRARIKRERLNARTGGANRSLVDMMREAKEGSGRKELPIVIKGDVQGSVEAINGALTALGNDEVGVRILLSGVGGITESDITLANASKAVVIGFNVRAHKEARNAAERDGTEIRYYSIIYDLVDDIKATLSGMLPPTLREERLGEAQILQIFDVSKVGKIAGCRVMEGVVQRGAHVRLLRNDVVIHEGKLSQLKRLKDDAKEVTAGYECGMSFENYQDMRSRRLHRVLPGRGDPPNPLSGLLPPNPRKRGRSESWRTH

SEQ ID NO: 16182 - protein, 219 aa, Magnetospirillum magnetotacticum MS-1
MTLLLAAQDPETGRGLSDIEVKANIVTFIAAGHETTANALTWALYCLSQDGAARARVEAEADAAAGPEGNLRLDRLPFTKAVMEETMRLFPPVPFLSRQALRDDRIGRVKIPRNSTVIVAPWVMQRHRKLWDEPDAFIPDRFFGSRRESIERYAYLPFGAGPRVCIGQSFSVQEATLVLAHVARAVRFTLPDEHPPVTPLHRVTLRPKDGLRMVARRRM

SEQ ID NO: 16183 - protein, 307 aa, Magnetospirillum magnetotacticum MS-1
GAPDLHRVARFVEKPDAAGAERLIGEGALWNSGYFLFRADVMIAELEAHAPQVLEAARGALAKAATDLDFIRLEASAFAQAPKTSIDYAVMERTTRAGVLKVSFAWSDVGTWDAVWQVLERDAHGNAVRGRVELVETTGSLVHSEGDGLTTVVGLDDVVVVSTPDAVLVAAKAHSGKVKDLVGVLREKAHPEADAHRRIYRPWGWYQRIDIGERFQVKRIMVTPGGRLSLQKHFHRAEHWVVVKGTAEVTLNEQILLVHENEAVYLPIGSMHRLTNPGKIPLELIEVQVGSYTGEDDIIRVEDVYGR

SEQ ID NO: 16184 - protein, 197 aa, Magnetospirillum magnetotacticum MS-1
MPARIQPVILCGGSGTRLWPTSRTSLPKQFVPLLGPHSTFQQTLLRLQSPLFARPIIVANRDHRHLVEKQAAAIDAPISLLLEPERRDSGPAILAACTLVAQDEPEAVVLVLPSDHIVTEPRAFRRAVASALPAARAGRLVTFGIEADHASTEYGWIRPGERVEARCHAVCKFAEKPTRCGRPPTCRTGGCGIPATS

SEQ ID NO: 16185 - protein, 330 aa, Magnetospirillum magnetotacticum MS-1
MIRRNAERVNASRYPVNIPVIADRLAARFSAWYEIFPRSQSGDPNRHGTFKDVIRRLPEIRELGFDVLYFTPIHPIGKTNRKGKNNTLKAEPGDVGSVYAVGSEEGGHEAVHPELGTLDDFRQLVAASHAHGMEVAIDFAIQCSPDHPWIKQHPEWFEWRPDGTLKFAENPPKKYEDISNVHFYGGALPSLWIELRDIVLGWCAHGARIFRVDNPHTKPIPFWEWMLRQVNAQYPDAIFLAEAFTRPKMMKKLAKAGYQQSYTYFTWRNTKQELTDYAPGAGRRDGRVLSSQLLRQHAGHQPVLPPDQRPAGLHRKGDARGDALLDLRHL

SEQ ID NO: 16186 - protein, 276 aa, Magnetospirillum magnetotacticum MS-1
MIDRSDPQWYRDAIIYQIHVKSFFDSSNDGIGDFEGLTQKLDYVRDLGVTAIWLMPFYPSPLRDDGYDIADYRDINPSYGTMDDFRRFVDAAHERGLRVITELVINHTSDQHPWFQRAREAPAGSPERDFYVWSDTDDKYSDTRIIFLDTEVSNWTWDPVAKQYFWHRFYSHQPDLNFDNPAVLEAVIEVMRYWLDMGVDGLRLDAIPYLIERDGTNCENLAETHTVIKAIRAALDAEYPDRMLLAEANQWPEETAQYFGDGDECHMAFHFPLSSV

SEQ ID NO: 16187 - protein, 185 aa, Magnetospirillum magnetotacticum MS-1
MTNQTIAYQGEPGANSHIICSQAYPGWTALPCATFEDAFAAVSEGKAALAMIPIENSIAGRVADIHHLIPTSRLHIVAEHFLPIHFQLMVLPGTRAESLTSVHSHIHALGQCRRIIRRLGLRAVVAGDTAGAAREVAEAGDPTRAALAPALAAEVYGLDIIARDVEDEAHNTTRFVVFSPETSSR

SEQ ID NO: 16188 - protein, 348 aa, Magnetospirillum magnetotacticum MS-1
KRDPARRRPCVEQDFYAAHAVDAVRGSATRIDPAGRSVTLEDGRTISGDALLIATGSRAVLPDFPGADLDGVVTLRSLDDAVVLSERAQKAARIVVVGGGFIGLEAAAFLTKRGRAVTVLAREEWPLAKRFGEAVARGLKRFHEGKGVGFRQGEVGRIVGDGTVAGIELKDGGRLDADLVLIGAGAAPESGMIDGVEPREDGGLAVGSDLALAPQVWIAGDIAAFPEHGSGSRARIEHWRLAQQHGMHVARAILGEAKPFRDAPFFWSNQGEKRLDYGGYAPGFDRIVMRGNPDELDFIAFYVKEDRAVAACSIGRNAEFTAFLHLLGEGRLPSPADLDRGVELTGLL

SEQ ID NO: 16189 - protein, 180 aa, Magnetospirillum magnetotacticum MS-1
MITRRWEFERMQLGMIGLGRMGGNIVRRLLRDGHTAVVYDRDPKAIEALTAEGATAAESLEDLVAKLEAPRTAWVMLPAGQITEETVTALGGLMAADDCIIDGGNSFYQDDVRRAQDLDRRGIHYVDVGTSGGVWGLERGYCMMIGGHKEAVDRLDPIFRTLAPGLGDIPRTPGREARDP

SEQ ID NO: 16190 - protein, 380 aa, Magnetospirillum magnetotacticum MS-1
  misc_feature (325)..(325): Xaa can be any naturally occurring amino acid
MKTIGECNTAHGPEAIGLTGLAAIHWNLEAPRLYEESLRRGEAQLARGGALVATTGSHTGRSPKDKYVVRDASTENEIWWDNNGAITPDQFATLLDDFRAHARGKELFAQDLYGGADPAHRVRARVYTELAWHSLFIRNLLIRPERDALASYVPELTIIDLPSFQADPARHGCRSKTVIAIDFAQKIVLIGGSAYAGEMKKSVFTYLNYVLPGAGVMPMHCSANAALDETGDSALFFGLSGTGKTTLSNDSSRKLIGDDEHGWSRDGIFNFEGGCYAKTIRLSRNAEPEIYATTERFGTVMENVVIDPVTAPRHTPTPPSRKKPXAYRSFIAWRQRRPDPKMDVPELGNRDAARGTDILGTRCDNAKREFRWTNRTEEGG

SEQ ID NO: 16191 - protein, 239 aa, Magnetospirillum magnetotacticum MS-1
MPDLDTIVRDIAEEMRARPDRGEVARYIPELAGVDPQAFGLVVIDGDGRAAVGGDADIPFSIQSISKVFTLTLALGMVGDRLWRRVGREPSGSPFNSIVQLERENGIPRNPFINAGAIAVTDVILSGHQPREALGEILRFMQFLAQDNGIAIDEKVAASEKRTGFRNAALANYMRSFGVIENPVDYTLGVYFHHCAIAMSCRQLATAGLYLAYSGLHPLADTRDLGRAARGQLNHGQVP

SEQ ID NO: 16192 - protein, 200 aa, Magnetospirillum magnetotacticum MS-1
MRIILLGPPGAGKGTQSERIVERYRVPQLSTGDMLRAAVAAETPVGLEAKSIMESGGLVPDAVVVGIVADRIEEADAKNGFILDGFPRTVEQAKALDAMLAEKGIALDAVVEFVVDENALVGRIAKRAEETAARGQPVRKDDTPEVFKTRLDAYKKQTAPLSDYYAGTGLLRKVDGMKPIDEVTGDLTGLLDGFREKAAS

SEQ ID NO: 16193 - protein, 343 aa, Magnetospirillum magnetotacticum MS-1
MPEGGADDTAGARTERLARFRPASGMETPRFSGLSSFMRLPVIDPRAAPGLIEIGLIGIPFDGTTTNRPGARLGPRAVREASTGTRALNHATGVAPYDLAACADLGDVPVNPVDAAETDRRIEAFYRPLAEGGIVPLSVGGDHFVTYPVLRALGADRPLGLIHIDAHSDTDDAQYGGARLTHGTPFRRAVEAGVLDPRRCVQIGIRGSMDAADERAWALGQGIRIIEMEEVCARGLPEVAAEARAVVGEAPAYLSFDIDALDPAFAPGTGTPEIGGFTTREALHLLRGFRGLDLVGADLVEVAPPLDPAGITALAGAGLAFEILCLLAERVAARHRAAREGEG

SEQ ID NO: 16194 - protein, 217 aa, Magnetospirillum magnetotacticum MS-1
MNLVLLGPPGGGKGTQAKRLQEKYGLVQLSTGDMLRAAVAAGSDVGKKAKAVMDAGQLVSDEIVIAIIDERLDQPDVAKGAIFDGFPRTVAQAEALDAMMARKGKKLEFAIEIQVPDAYIVERITGRYTCAKCGAGYHDKFQLPKVAGKCDSCGGTEFARRPDDNVETVTKRLDAYHAQTAPLLPYYDKKGALKLVDGTMDIADVTKALEGILDAAK

SEQ ID NO: 16195 - protein, 207 aa, Magnetospirillum magnetotacticum MS-1
MNAPAAPQIVSCWSCKGPVATRALFCSVCGAVQGPGTIDHFSRLGIAPSFDLDLDALQRQYFGFQKRLHPDRFASKSPKERALSQSQATALNEAYETLKDPLKRAAYLLNHLGHPVDLTACGTINDRELLMEQMEKREALAEASSPEQIAKLAMQAESEVIACQCHISAAINADHLEEAGHLTIRLKYLAKLAEEARAKKTRALRLP

SEQ ID NO: 16196 - protein, 448 aa, Magnetospirillum magnetotacticum MS-1
SHGSHDDHKTRIFTIRELEKKVKRPIAILADLQGPKLRVGDFVDGRARLEAGAVFRLDMDDALGTALRAPLHHPEVFAALKPGSELLIDDGKLRLAVESCGPDFAETRVVVGGEISNHKGVNVPNVMLPISPLTEKDRRDLEFAVEMGADWIALSFVQRPSDVQEARKLIAAYVGSRVRILSKLEKPSAIEHLASIIEWSDAVMVARGDLGVECPPETVPILQKRIIKACRRAGKPVVVATQMLDSMVHSPSPTRAEASDVATAVYDGSDAVMLSAETASGEYPMEAVTMMDRIIQQVEHDKNYLLITDASRLDPEHTTRDAISAAARQVAHTLGAAAIVTYTSSGSTTLRAARERPEQPILSVTADIEVARQMALVWGAHSIMAKDVRSFTEMVTKAVHFAQGEGFARVGDRVVITAGVPFGHSGTTNILRVAEVEDSGHHHKHESD

SEQ ID NO: 16197 - protein, 280 aa, Magnetospirillum magnetotacticum MS-1
MSPRHLSHAARQVFEFDRDRFATALFAPPDRRESLMLLYAFNLEIAKVQESVREPMAGMIRLQWWRDTLISGAEGGTCDNHPIARPLAELIRRHDLPLQAFDDLISARQDDLEGFAPADMAEAERYVQRSSAALTQLALAVLGGTSEEIRRAGDHVGTAWGMIGNLRALGHHLSMGKLTLPEGLLGQYGSRGEEVLAGRASMEALTAAVQVMGERARHHLSEARKFKAGRQGLAALLPAILADGYLQVIEKSGWNPFDSRVPRPNPRPIRLVIAHLMGRF

SEQ ID NO: 16198 - protein, 1039 aa, Magnetospirillum magnetotacticum MS-1
MIFTQPLPSPTAERLAIHQAAARDEADLVSGLAAAVPLEDEARRRAVNHAVNLVDGARQNRRSLGLDGFLNEYRLSTREGVVMMCLAEALLRIPDDHTADLLIKDKIGSGDWDDHLGHSPSLFVNASTWALVLGDRLLHLEEDGRATLGRMAGRLGEAVVRRALRQAMGLMGRQFVMGRSIAEALDHARAWEAKGYLHSFDMLGEAARCEATALDYVRAYTTAIEALGRHATGDGVIAGPGISVKLSALHPRFEMAQRGRVMAELVPRLRDLCLKARHAGIGLTIDAEEADRLEISLDVIEAALSDSGLDGWSGFGMAIQAYQKRARPVIAWAGALAARRQCRLMIRLVKGAYWDGEIKRAQERGLHGFPVFTAKEATDVSYLACAADLLARPDLFYPQFATHNAHTVAAIVEMTGGPGDWEFQRLHGMGEALYAQLVPQFACRIYAPVGSHQDLLPYLVRRLLENGANSSFVSRLADEDIPAHVVAADPLAILGRITPQMVAAPSALFEPQRRNSSGLDLSSPAVLAQLDLALAAAATPERAHPIIDGQMLDTDNATPVLDPADHRRIVGEVVDAHPAQVAAALASAHAAFPAWDDLGGEGRAAILDKAAEMLEDQRARFMALAIREAGKTLPDALGEVREAVDFLRFYAAEARTRFAHPLPLPGPVGESNHLMLGGRGVFACISPWNFPLAIFMGQVAAALAAGNTVVAKPAPQTPLMAAAAVRLLHAAGVPPKVLHLVPGGPSVGEALVSSPMLDGISFTGSTATARQINRIRAAMDGPLLPLIAETGGLNAMIVDSSALAEQVVADCQESAFRSAGQRCSALRIAFIQREAWTRIEPLLAGAMAELSLGDPALLSTDVGPVIDEAARQRLLAHGGKLRHAGRAIGQSPFPADCRFGTFFAPMAYELENLDLLRAEVFGPILHVITWESGHLDKVLDAVAATSYGLTLGIHSRIDATIAQVVARARIGNIYVNRAMIGAVVGSQPFGGLGLSGTGAKAGGPNTLIRYGVERCLSVNTAAAGGDAALMAGPQRGHAK

SEQ ID NO: 16199 - protein, 462 aa, Magnetospirillum magnetotacticum MS-1
MAENSFDIIVIGGGPGGYVAAIRAAQLGMNTALVEREHLGGICLNWGCIPTKALLRSAEIYRNMQHAESYGLSAPGASFDLAKIVARSRGVSAQLQGGIKHLLKKNKVTVIEGTAKLAGGGKVAIEGKPTISAPHIILATGARARILPGFEPDGKFIWTYKEALVPDTMPKRLLVIGSGAIGIEFASFFNALGAQVTVAEAMDRVLPVEDAEISAMAQKSFEKQGMKILTSANIKGLKKNAADVTVTIEAGGKTQDITVDRIITAIGIVGNVENIGLEGTKIRVERTHVITDPYCRTDEPGIYAIGDIAGAPWLAHKASHEAMICVEKIKGLADVHPLDMRKIPGCTYCHPQVASVGLSEAKAKDKGYTVKVGRFPFMANGKAIALGETEGMIKTVFDAKTGELLGAHMIGAEVTEMIQGYVVAKTLETTEAELMHTVFAHPTLSEMMHESVLDAYGRAVHF

SEQ ID NO: 16200 - protein, 317 aa, Magnetospirillum magnetotacticum MS-1
  misc_feature (291)..(291): Xaa can be any naturally occurring amino acid
  misc_feature (296)..(296): Xaa can be any naturally occurring amino acid
MLETGFFSLGTPGRLDADLEFILAKVAELKLPKLYELGPVGARTEFALRLSRSNPPAPHGVEAEDITIAGIPARRYQPQGGPKAKAMLLYFHGGGFVVGDLETHDPHCRALAAESGSVVVALHYRLGPEHPYPAAIQDGIAALKWAAAEYAGWTLGVAGDSAGGTLSAVVALHARDLNIPLALQMLIYPAVDQKGDFPSRTRLADGYLLTQGDIEWFTQQYFVGHEGPVLEPDASPLRAASHGGLAPALVLTCGFDPLVDEGDAYAQALIGAGVPVRHVRLEGSIHGCLGXWPGLXVALGQASLGGGLRGLAVRSSP

SEQ ID NO: 16201 - protein, 213 aa, Magnetospirillum magnetotacticum MS-1
MTVKIAPSILSADFARLGEEVKAIDEAGCDWVHIDVMDGHFVPNLTFGPAIIKAIRPYTTKVFDVHLMIDPAQPYIEDYAKAGADIIVVHAEADKHLDRSLQLIRSLGKKAGVSLNPATPESVIEYVMDKLDLVLVMSVNPGFGGQSFIEAQLDKITRIKKMIGHRMIDLEVDGGVTADNAHRVAAAGANVLVAGSAVFKTKDYAANIAALRR

SEQ ID NO: 16202 - protein, 471 aa, Magnetospirillum magnetotacticum MS-1
MPRKMLQFTHLHQRQPDKRGAAERRKDFGEISTAFETERAAEQASRCEQCGIPFCSIHCPLGNNVPDWLMLVAQDRMEEAYAVSSSTNTFPEICGRICPQDRLCEGNCVLEQSTHGNVTIGAVEKHITETAFAQGWVKPVLAGVESGRSVGIIGGGPAGLAAAESLRRKGHSVTVYDRHDRMGGLLIYGIPGFKLEKDVVERRIRLLAEAGVKFETGVEIGKTVSFAELRKRHDAVLIATGVYKAKPLGIPGSDLPGVHAALDYLIAQNRRDLGDTVESLDAKGKNVVVIGGGDTAMDCVRTAIRQGAKSVKCLYRRDRANMPGSKREVAHAEEEGVEFVWMAAPEMVNGKAKAEGVKAVRMHLGMPDASGRQSPVAIEGSGFQLPADMVIAALGFDPEDVPALFGAPELKVSKWGTVETDGDLMASLPGVFGAGDIVRGASLVVWAIKDGRDAAESIHRYVSGVAMKAAE

SEQ ID NO: 16203 - protein, 390 aa, Magnetospirillum magnetotacticum MS-1
MKKSTRILHAGRKPEQFHGAVNPPVYHASTILHPSVEAMEKSGRNPFEGVRYGRFGTPTTFALEEAVAELEGGHRTVATSSGLAAITGALLAFLKAGDHLLMVDTAYFPTRKFCDTVLSGLGIEITYYDPLAGAGIKALMRPNTKVVFTESPGSLTFEVQDIPAIAEAAHAAGAIVMMDNTWGVLHFQPFTKGVDVSIQAATKYIVGHADAMLGTITAATPELWLKVKTSLAAFGASPGTEEMYLGLRGLRTLAVRLRQHAETALRLTQWLETRPEVESILYPPLASDPGHALWKRDFTGGCGLFGVILKPASKAAVDAMLDGYSHFKLGFSWGGFESLVIPTSGHSIIRTATSWAPKGPSLRFHAGLEDADDLMEDLERGFGRLACAGS

SEQ ID NO: 16204 - protein, 512 aa, Magnetospirillum magnetotacticum MS-1
MHEIIQQLEEKREGARMGGGEKRIAAQHKRGKLTARERIELLLDPDSFEEWDMFKEHRCTDFGMDSDENMIPGDGVVTGYGTINGRLVFVFSQDFTVFGGSLSEAHAEKICKIMDKAVQVGAPVIGLNDSGGARIQEGVASLAGYAEVFQRNVMASGVVPQISMIMGPCAGGAVYSPAMTDYIFMVKDSSYMFVTGPDVVKTVTHETVTAEELGGAVTHSTKSGVADLAFENDVEALLQLRRFMDFLPSSNREKPPVRPTNDGPERIEASLDTLIPDNPNKPYDMKELILKVVDEGDFFEVQPGYAGNIIVGFARMEGRTVGIVANQPMVLAGCLDISSSIKGARFVRFCDAFNIPVVTFVDVPGFLPGTSQEYGGIIKHGAKLLYAYAECTVPKITVITRKAYGGAYDVMSSKHLRGDVNFAWPTAEIAVMGPKGAVEIIFRSDIGDAEKIAARTEEYRQKFANPFIAGHRGFIDDVIMPRNTRKRICRSLAMLKDKDVKNPWRKHGNIPL

SEQ ID NO: 16205 - protein, 194 aa, Magnetospirillum magnetotacticum MS-1
MSRLLPTNPLGSFVASVVAAIGLAGGVAWGATGDHLDWSSLPLPAIAGGQVPADAFKGKVVLVVNTASQCGFTPQYQGLEALWREYRGRGLVVLGVPSNDFGAQEPGSNPEVASFCEINYGVDFPLLEKQVVTGTGAHPFYRWAAERTGALGVPRWNFHKILVGRDGQLVDWFASTTAPDSARLRAAIDKALTP

SEQ ID NO: 16206 - protein, 381 aa, Magnetospirillum magnetotacticum MS-1
MCGGGLVPGSCLLVGGDPGIGKSTLLLQATARLSAQVSVAYISGEEAVDQVRMRAARLGYAKANVALASAGSLRDIIASLDQPDAPQVVVIDSIQTVYADNIESAPGTVSQVRACAAELIRLAKRRGFVLFLVGHVTKEGTIAGPRVLEHMVDTVLYFEGDRGHQFRILRAVKNRFGATDEIGVFEMTEGGLSEVANPSALFLAERRGNVSGSCVFAGMEGTRPMLVEIQALVAPSSLSSPRRAVVGWDTNRLSMVLAVLDARCGLALSGNDVYLNVAGGLRIAEPAADLAVAAALVSSASDVPVPADMVVFGEIGLSGEVRAVAQADTRLKEAAKLGFDQALVPARPRKDKGGGAAGAASPLAIRSIGHLQDVLGLFRHE

SEQ ID NO: 16207 - protein, 330 aa, Magnetospirillum magnetotacticum MS-1
MLPETMTCVEISTPGGPEVLVPITRPLPQPKPGEVLIKVAAAGINRPDVLQRAGAYPAPPGASDLPGLEVAGTIVALGEGVTSPALGAEVCALAPGGGYAQYCTVDARHCLPIPKGYDMIRAAALPETFFTVWHNVVERGQLKSGDRFLVHGGAGGIGTTAIQLAKALGATVFATANGEAKCTACRELGADMAIDYSTADFVEVIRAETKGKGIDVILDMVGGDYMARNIKSLAADGRLVSIAFLRGSSAELNMMPVMLKRLTLTGSTLRPQSNDAKARMARGLAETIWPLLDKGAIAPLIHAVFPLAEAAKAHALMESNAHMGKIVLQV

SEQ ID NO: 16208 - protein, 496 aa, Magnetospirillum magnetotacticum MS-1
MPLTPELDPFKLAKALSGKHLIGGKFVPAKGGKTFPVDNPATGEEIGTAAFGTKADVDAAVANAKAAQKEWAKQSARARGKLVAECGRVLSAHVEELGRLVALETGKALRTESRVEAGVLADMFVFFGGLGSELKGETIPFNPDMLTVTVREPVGVVGCIIPWNVPLLLMAMKAAAALVAGNAVVVKSAEEAPLTVLRVAEIMNTVLPPGLFNMLSGFGPECGAPLVEHPDVKKVTFTGSVETGRIVYKAAAEKLIPVTLELGGKSPMIVCADADMDQAVAGALAGMRFTRQGQSCTASSRLFVHESIHDEFVARVKAKVDAMVMGDPLDEKTDIGTIVSDGQLERVKSYIKLGEETKGATKHVCSAMPTDPKLAKGRFVQPVIFTGMKNSDRLCQEEIFGPVCAVIKWTDYEDVLAQANDSEYGLAASIWTRDFKVAMDATRRLEAGFVQVNQNLVVQPMLSYGGVKTSGIGKEASLESMLEHFTHKKTIIFNMK

SEQ ID NO: 16209 - protein, 286 aa, Magnetospirillum magnetotacticum MS-1
MGKATGFKEFERKTPGYEAPAERVKHYREFTTPLTNEELACQGARCMDCGIPFCHQGCPVNNIIPDWNDLVYRNRWQEAAEVLHSTNNFPEFTGRVCPAPCEAACTLNITDSPVAIKTIEHAVVERAFAEGWLVPDLPKRETGKMVAVVGGGPAGMAAAQQLARAGHAVTLFEKNAQVGGLLRYGIPDFKLEKAVIDRRVAQMEAEGVTIRANTHVGVTFPVKDLLDGFDAVVLTGGSEKPRDLPVPGRELNGVHFAMDFPHPAEPTQFGRGGRRRRYPAKGRRSW

SEQ ID NO: 16210 - protein, 158 aa, Magnetospirillum magnetotacticum MS-1
MPRPPEKEDKGLSWPLWPNRLRTSSSHDEGCERRWAVSTVRFTGKDGQVTGLDCTEVDAKFQPIPGTEFKLEADLVLLAMGFVHPVHEGLVEGLGLEKDGRGNVKADTIAYQTNNPKVFAAGDIRRGQSLVVWAIREGRQAARAVDAFLMGSSDLPAC

SEQ ID NO: 16211 - protein, 390 aa, Magnetospirillum magnetotacticum MS-1
MQNFKWDDPFLLEDQLSEDEKLIRDSAHAYCQEKLQPRVMKAFRDESFDREIMNEMGEMGLLGPTIPEEYGGPGVNHVAYGLISREVERVDSGYRSAMSVQSSLVMHPIFSYGTEEQKKKYLPRLATGEIIGCFGLTEPMPSDPGGMRTRAKKWTAAIAERLQDVDHQFAHLGHRLVWAKSDAHEGKIKGFIVERGTKGFSTPKIEGKLSLRASITGEIVLDEAFVPDDALMPNASGLGGPFGCLNKARYGIAWGVIGAAEFCWHAARQYMLDRKQFGRPLAANQIPQLKLANMMTEITLGLQACVRVGRMMDDHTWAPEAVSLIKRNNCGKALDIARMARDMHGGNGISEEFHVIRHMVNLETVNTYEGAHDVHALILGRAMTGIQAFS

SEQ ID NO: 16212 - protein, 489 aa, Magnetospirillum magnetotacticum MS-1
MILKDSSLLKSRAFVNGAWTDADNGATFDVLNPATGEILASVPDMGAAEARRAIEAANAAWPAWKAKTGKERGAILRNWFNLIMAHQEDLAVLLTAEQGKPLAEARGEIAYGASFIEWFAEEAKRVYGDTIPGHAPDKRIVVVKEPIGVVAAITPWNFPNAMITRKCAPALAVGCPVVVKPAEDTPLSALALAELAVRAGIPAGIFNIVTARHGALVGGELSGNPLVRKLSFTGSTQVGKLLMSQCAATVKKVSLELGGNAPFIVFDDADLDAAVAGAMASKYRNAGQTCVCANRMLVQDGVYDEFARRLAKAVSQLKVGDGLASDANQGPLINAKAVEKVERMLADAVSKGATIVCGGKRHALGRTFFEPTIVTNVTSTMSMAREEIFGPVAPLFRFKTEAEAIAMANDTEFGLAAYFYAGNIARVWRVAEKLEYGMVGINDGIISTEVAPFGGVKESGIGREGSKYGIEDFLEIKYLCLGGIKEAAQ

SEQ ID NO: 16213 - protein, 170 aa, Magnetospirillum magnetotacticum MS-1
MSKKKHKAPLPYDQRPYRPGIGLVLLNTQGLAFVAQRVDTPGTAWQFPQGGIDEGEDPRATVLREMEEEIGTAKAEIIAESRDWISYDLPPDIADKSWKGRFRGQTQKWFCARFTGSDADINLETEHPEFCRWRWMALEEIPPLIIPFKRVLYDKVVAEFLPIAQAMASK

SEQ ID NO: 16214 - protein, 371 aa, Magnetospirillum magnetotacticum MS-1
MTQPHLFQPLSLRGLTLPNRVAVAPMCQYSAKDGVVQDWHLMHYGSLAASGPGMVVIEATGVTPEGRISPKCLGLYDDATEAGFIRLVAAIKGFGGNGAIGVQLGHAGRKGGAAAPWEGGKFSPDGWQTISASDIAFDEGWPSPKAATIEDLDRLKQAFVIAAQRALRIGFDFIELHSAHGYLLHQFLSPLSNRRDDQYGGSLENRMRFPLEVITAVRAVWPADKPLGLRISATDWVEGGWDADQAVNYAKAFKAAGIDFVCVSSGGLVSYAKVPVGPGYQIELAARIRREAGIPTRAVGLIATPHQAETALTEGAADLIAIGRGFLDNPRWVWHAAQALGAQMTYPPQYLAAGTRAWPGVALARPTLAAE

SEQ ID NO: 16215 - protein, 425 aa, Magnetospirillum magnetotacticum MS-1
MTAIIDIHGREILDSRGNPTVEVDVVLETGVIGRAAVPSGASTGVHEACELRDGDKKRYLGKGVQKACDSVNGEIYDALSGMDVEDQILIDKTMIDLDGTPNKSRLGANAILGVSLAAAKAAAEESGLPLYRYVGGAFASILPVPMMNIINGGAHADNPIDIQEFMIMPVGASSCSEAIRMGAEVFHALKKTLKDAGHNTNVGDEGGFAPNLKSAEMALDFIMKSIETAGYKPGDDIMLALDCASSEFFKEGKYVMAGAKKTYDQKGLVKFYAKLVGSYPIISIEDGCAEDDLVGWELLTDALGAKVQLVGDDLFVTNPERLSMGIDKGLANSILVKVNQIGTLSETLEAVDMAHKAGYTAVMSHRSGETEDSTIADLAVATNCGQIKTGSLSRSDRIAKYNQLIRIEELLGSAARYAGQTIMKR

SEQ ID NO: 16216 - protein, 485 aa, Magnetospirillum magnetotacticum MS-1
MTDLDASLLKTHAYIDGHWAEADDGRRFDVLDPATGHLLASVPDMGGAETRRAIEAAEMAWGPWRRRTAKERAAILMAWFEQIIAHKDALARLLSAEQGKPLPEAQGEIVYGAAFIQWFAEEGKRAYGDLIPTTASDRRLLVMKQPIGVVAAVTPWNFPMAMITRKCAPALAAGCPVVVKPAEDTPLSALVLAELAERAGLPRGVFNIVTTRQPGAVGGEMTANPLVRKLSFTGSTRVGKMLMAQCAETVKKVSLELGGNAPFIVFDDCDLDAAVAGALASKYRNSGQTCICTNRFLVQAGVYEEFGRKLAEKAAAMVVGHALKGPVQQGPLINAAAVAKVASHVADAVSKGARVLTGGRPHELGGGFWQPTVLADVTAQMLCFQEETFGPVAPLVRFETEEEAVELANASQFGLAGYFYSRDLARVFRVAEAMECGMVGVNESLISNEVAPFGGIKESGLGREGSKYGLDDFMETKYVCIGGLS

SEQ ID NO: 16217 - protein, 390 aa, Magnetospirillum magnetotacticum MS-1
MFPDNLLAVFDRTDVIFEHGEGAWLTAADGRRFLDFGAGVAVNALGHAHPRLVAALGEQAGKLWHCSNLYRVPGQERVAQRLVDASFADTAFFCNTGAEAMELVIKIARRYHHCAGHPERNRIIACTGSFHGRTIATLAAAGTAKYLEGFGPVAQGFDHVPYGDLEAVQGAIGSNTAAILVEPVQGEGGIRPGDPAYLRGLRALADEFGLLLLMDEVQTGIGRTGKLFAHEWSGIAPDVMGLAKGLGGGFPVGAVLATEKAAACMTPGTHGCTFGGNPLAMAVAEAVLDEIMAPGFLDRVQAVAAMLRGKLDDLARRYPQAIAEVRGQGLMLGLKTVPLNTEFNAKLFAAGLLAVGAGDNVVRLVPPLIIGEAEVVRAVEIIEGVCASFS

SEQ ID NO: 16218 - protein, 421 aa, Magnetospirillum magnetotacticum MS-1
MHHLIVGAGPAGVTAAEIIRELEPEATITLVGDEPEPPYSRMAIPYMLVGKVGEDGTYLRKGPNHYDRLGITLMPGRRMTGLDPAAKRIALDGGESLAYDRLLLALGARPMRPPIEGLDLPGVHTCWTLADARKIAEEAIPGSHVVLMGAGFVGTIVLEALALRQVSLTVVEMGDRMVPRMMDEVAGGMLKRWCEAKGVRVLTGTGIRRITQAESAADTRDSLVVELSDGATLPAHLVVVSAGVRSNTEAVAASGIALGNGILVDDHMRTSLPHVFAAGDVAQGRDFMSGEAHVHAIQITAAAHGRIAAYNMTGNDQAYHGSLNMNVLDTLGLITCSFGSWQGNGGHCARLVDEAGFRYLRLEFDGTSDVVIGAQAVGTTDHVGALRGLIQSKRRLGPAVKEQMMADPTRFMNGFVQTLHR

SEQ ID NO: 16219 - protein, 416 aa, Magnetospirillum magnetotacticum MS-1
MARRYVVVGGGPAGVVCAETLRRQDAEGSITLVCAEPGPPYSRMAIPYAMSGKIDESGTWLRKDWGHYEALGIALLHDRVTGVDSGARQVRLESGAPLSYDALLIATGSSPARPRVPGLDLPGVHSCWTLEDLRRIDPLLKPGRRVLLLGAGFVSCIILQSLVQRGAKVTVSCGSSGRMVRSMMDETAGGMIMRWCRAKGVEVLTAGRPTAIEQRDSGLLVTLDSGKSAEADLVIVGTGVKTNTAFLEGSGIAIEDGIIVDQYLGTNVPGIWAAGDVAQGFNCCTGLTEVHAIQPTAVEHGRVAAMNMSGHPTPFGGSLSMNTLETLGLISCSFGQWMGAEGGKQVRMVDEEHFRYLRLEFQGDRLVGANTVGMTNEIGIIRGLIQTKLRLGEWLERLTQDPSRLAEAYVACAQGV

SEQ ID NO: 16220 - protein, 405 aa, Magnetospirillum magnetotacticum MS-1
MFRTIDSFDVKGKRVLVRADLNVPAKDGKVTDTTRIDRSAATLKELAGKGAKVIVLTHFGRPKGRDAKYSQKLLVEPLARAVGQPVLWADDCIGVEVEQMIAKMKDGEIALLENVRFYENEEENDIGFAKMLAGLGDIYVNDAFSTAHRAHASTEGVAHLLPCAAGRLMQAELEALGKALEHPEKPVAAIVGGAKVSTKLDLLGNLVARVDYLIIGGGMANTFLFAQGKQVGKSLCEKDLADTAREILEKAKAAHCHIVLPVDAVVAGEFAENAANQVVSVDAVPADKMILDAGPASAEAIIDRLGGCKTLVWNGPLGAFEIAPFDKATNAVAQWAAERTVQGKLLTVGGGGDTVSALAKAGVEDKFSYISTAGGAFLEWLEGKVLPGVAALEVKNCGSGCGCGG

SEQ ID NO: 16221 - protein, 289 aa, Magnetospirillum magnetotacticum MS-1
MTDQPTPDSSIAFQGEPGAYSHLACRNAYPGMQPLPCATFEDTFAAVREGRARYAMIPIDNSVAGRVADVHHLMPYAGLHIIAEHFERISHHLLAVPGATLATIKSVKSHVHALGQCRNLIRELGLKVIVGTDTAGAAAELAERQDPTMAAIASELAAEAYGLVSLKAGIEDAEHNTTRFVVLAREALEPNPNQPCVTTFVFRVRNVAAALYKALGGFATNGINMTRLESYMVGGEFAATQFYADVEGHPTQRNLRLALEELDFFSHEVRILGVYPRHPFRMKQQGGGQ

SEQ ID NO: 16222 - protein, 398 aa, Magnetospirillum magnetotacticum MS-1
MSNSDSKPARTWRPRTQAVRGGLSRTNFRETSEAMFMNSGYVYDSAEEAEASFDGTLDRMVYSRFKNPTIAVFEQRLAEIEGAPACRATASGMAAVHAALLCQLKAGDRVVASNALFGSCHWIINELLPRYGIERVFVDGTDLKSWEAALSRPTACVFLETPSNPTLEIIDLAAVCDLAHKAGAKVVVDNVFATPILQSPLELGADIVVYSATKHIDGQGRCLGGAVLGSTEFCADILGPFLRNTGPCMSPFNAWVLLKGLETLDLRMERHCSNALKLARFLETRGEVARVLYPGLESHPQHDLAKRQMRGWGSIVALELKGGKQAAYDLLNGLDLIDISNNLGDAKSLITHPWTTTHQRLSPEDKLSMGITEGLLRLSVGLEDGDDLADDIAQALES

SEQ ID NO: 16223 - protein, 506 aa, Magnetospirillum magnetotacticum MS-1
MLYASPNTSGAKVQYKAKYDNFIGGKWVAPVKGEYFDVITPINGKAYTKAARSGAEDIELALDAAHAAADAWGKTPPAERANILLKIADRLEANLELLAYAETVDNGKPIRETLAADIPLSVDHFRYFAGCLRAQEGGMSDIDENTVAYHFHEPLGVVGQIIPWNFPILMAAWKLAPALGAGNCVVLKPAESTPISILILAELIADLLPPGVLNIVNGYGREAGMPLASSKRIAKIAFTGSTSTGRVIAQAAANNLIPATLELGGKSPNIFFPDVAQADDGFFDKAIEGLVLFAFNQGEVCTCPSRALIHESIYDKFMDRVLGRVAAIKQGSPLDTDTMIGAQASKEQMTKIMSYLDLGKQEGAQLLIGGERAYLGGELNDGYYIQPTLFKGHNKMRIFQEEIFGPVLAVTTFKDEAHALELANDTLYGLGAGVWSRNGNVAYRMGRAIKAGRVWTNCYHAYPAHAAFGGYKESGIGRETHKVMLDHYQQTKNLLVSYSESKLGFF

SEQ ID NO: 16224 - protein, 459 aa, Magnetospirillum magnetotacticum MS-1
MPTRASNRTITEKDVDSVLHPYTNLKRHPEVGPLVITRGKGVRVYDEAGKDYIEGLAGLWCTSLGWGEERLVEAAARQMRTLPFYHLFSHKTHDVGVELCARLLEMAPVPMSKVFLAGSGSEANDTAIKLIHYRSNALGLPHKKKIIAREKAYHGVTVATASLTGLVNNQRSFDLPIPGVLRAGCPHHYRFARQGESEEDFSSRLAAELEALILAEGPDTVAAFFAEPVMGAGGVIVPPAGYFPKIQAVLDRYDILLVVDEVICGFGRTGKMFGTETFGIRPDMMTLAKGLSSGYAPISALMVNERVYGPVAEESGRIGVFGHGYTYGGHPVSAAVALETLNIYAERDILAHIAKVGPVLQEGLGSFRDHPLVGEARGIGLIGALELVADKTSRAPFPPERTMGAKVVARAQDKGVILRAMGDAIAFAPPLIITEAEIGDMLRRFKAALDEAHGALGLG

SEQ ID NO: 16225 - protein, 199 aa, Magnetospirillum magnetotacticum MS-1
GAEIVLTPASKGMTGAVRQAEELLASTPGAIMPQQFKNAANPAIHERTTAEEIWNDTDGKVDIIVSGVGTGGTISGIGRVLKARKPGLKMVAVEPEDSPVLSGGAPGPHKIQGIGAGFVPDILDRGVIDEILQIGNETALSTARKAAKLEGVPVGISSGAAIAAALELGSRPENAGKVIVAIIPSFAERYLSTALFDQV

SEQ ID NO: 16226 - protein, 296 aa, Magnetospirillum magnetotacticum MS-1
MASIGFIGLGNMGAPMMRNLIKAGHKLAAFDLSEAALKAATAAGATACSKAVDAARGAEVVVSMLPAGAHVKSVMLGDGGLFAAAPKGCLFIDSSTIDVASARLLSDEAAKAGHALIDAPVSGGVGGAEAGTLTFMVGGTEPAFARAEPILAAMGKTIVHAGGPGNGQAAKICNNMLLGISMIGTCEAFALAEKLGLDAQKLFDISSKSSGQNWSMTSYCPVPGPVPTSPANRDYQPGFAAAMMLKDLKLAVEAAQGCGATVPLGAEAAQLYAMMAGMGQGGLDFSGIIHMLRGKA

SEQ ID NO: 16227 - protein, 280 aa, Magnetospirillum magnetotacticum MS-1
MAAPPDSAKGNSIEVSNLVTHYGSRQILHNVSLTVGKGEIMVIMGGSGSGKTTLLSHLLGLKKPSSGTVRILGHDIAKLSPIALQRLRTRTGVAFQSGALFSSMTVGDNIALPLREHTELDETTIGIVTRLKLEVVSLAGFENLKPAELSGGMIKRAALARAIVMDPDLLFCDEPSAGLDPVVASSIDDLILRLRDAMGMSIVVVTHDLDSTFKIADRICVLDRGHVLALDTVDAIRASTDPRIQNLLNRRTEEAEPDAESYLRRLTGGPAPTQTRTRSS

SEQ ID NO: 16228 - protein, 278 aa, Magnetospirillum magnetotacticum MS-1
MMEKRRIGPFNATALTLGCMNLSHAYGTPPGREAAEALLRRALEAGVDFFDTAALYGFGSNESLVGAVLKPHRQHITLASKCGMTGVDGKKVIDGRPETILRTCEESLTRLGTDVIDLYYLHRRDFQVPIEESVGALARLVEQGKVRTIGLSEVSAATLRRAHAEHPITAVQSEYSLWTRNPEIGVLDACRELGAAFVAFSPLARGFLTGNLTDPATQLEPKDIRCQMPRFEPENYARISLLDDYSHRLALHPRHWAWPVLPGDTFALFGPILPDDAG

SEQ ID NO: 16229 - protein, 272 aa, Magnetospirillum magnetotacticum MS-1
MSDACASPLEIRIEGLTKAFDGHEVLCGVDLEITAGAFIAVVGGSGCGKSVLLNHILGLMQPDSGRVLVADPDRGDGTLLDLAALDADRMADIHVHWGVVFQRNALFSGTVLDNIGLWLEEIGHQSEDAIAATAGRVLAAVGLPSSPDFLAERVEALSGGMAKRIAIARALAMEPRCLFFDEPTTGLDPVTASQIQDLLQSTHVDDRDGRARTTIVVTHDKDLLCRLRPRVVMLHQGRVSFDGPFEAFESSRSPIIRPYFELMPVLHQRGPS

SEQ ID NO: 16230 - protein, 486 aa, Magnetospirillum magnetotacticum MS-1
MIIKEALTFDDVLLVPAESNVLPAQADTRTRLTRSIELGIPLLSAAMDTVTESRLAIALAQDGGIGVIHKNLDMDAQAAEVRKVKKFESGMVVNPLTIHPDQTLADALRLMSDYKISGIPVVERGSGKLVGILTNRDVRFANDAAQPVYELMTKDKLVTVREGVDKEEAKRLLHQHRIEKLLVVDSDYRCIGLVTVKDMEKAQAHPTAAKDEKGRLRVAAATSVGADGFARAMKLIEAEVDVVVVDTAHGHSRGVIDTIAEIRKASPHIQLVGGNIATPEAALALIKAGADAVKVGIGPGTICTTRMVAGVGVPQLSAIMEVAEVAHKHGVSVIADGGIKYSGDIAKAIAAGADCVMIGSLFAGTEESPGEVFLFQGRSYKSYRGMGSLGAMARGSADRYFQAEVSDKLKLVPEGVEGRVPYKGPVSTVIHQMIGGLRAGMGYTGNATIKDMQTRCTFRRITSAGLRESHVHDVSITKEAPNYKTD

SEQ ID NO: 16231 - protein, 319 aa, Leuconostoc mesenteroides subsp. mesenteroides ATCC 8293
MKIVLLDGYNLNQDLNWETLKNLGDFEFYSRTSVDNDTEILQRIDDAEVVITHKTPLDDSVISRASQLKYIGIMGTGYDVVDIDSANNHNIIVTNVPTYATDAVAQFTFSLLLEITGQVGLHNQLVHDGKWSSVDDFTFWDKPLFELKGKTLGLIGYGRIAQKVAELANAFSMKVIFYNHRPSVATQKWVNQVSLDELFQKADIISLHVVQTPETINLINKTTISKMKDGVILINTARGKLISENDIAEALNNEKVYALATDVVQKEPIEKDNPLLKAKNCFITPHIAWAPLETRERLLRITVDNLNAYLSGEAKNVIG

SEQ ID NO: 16232 - protein, 312 aa, Leuconostoc mesenteroides subsp. mesenteroides ATCC 8293
MKAAVINHYGGREQLEVIDMPIPKIKSDEVLVENMATSINPIDYKAREGLLKRMFPWQFPVILGWDIAGIVASTGDDVTSFKVGDPVFARPDIDTKGVNGSYAEYTAVKADKLALKPNNISFVEAAAVPLAGLTALQMLRKLQLSSNQKILIQAGAGGVGIYAIQLAKMIGAYVVTTASQNNHEFVKSLGADSVIDYHKNNIQDVLSDFDTVLDTVGDVDNGIAILKSGGHLVTISNALTDQQKNTSDKTVTEGWLNPNGQDLAILASYIAKGELQIVVDSLYPLTTEGIQSAHERSETHHARGKVVVQIKE

SEQ ID NO: 16233 - protein, 474 aa, Leuconostoc mesenteroides subsp. mesenteroides ATCC 8293
MSKNHFPQSFLWGGSFSANQAEGGYKSAGKGVSQTDLIPLNKSSKITSSFELNNYLADENSYFPRRTGIDFFNQFDEDLALISELGINSLRISIAWSRIFPNGDETTPNEQGLAFYKKVIDKLSLLGIEPVITISHYEMPVKLITNYGGWKNRKLIDFYTNYVQTLLHAFPEVKYWLTFNQINSGLTDPFSALGLLINDYASKELLQHDKFQAMHHQLVATAKVKQIAQQMNSSVLIGASVYDMTSYPRSPEPNDVLSNQESILISDFCSDVLVRGRYSKFILNNFKKNGVDLDITAEDQRLLLHNTIDFLGISYYVTTVVDQSTPSLFEINDWNIRDETSNKHLKATKWGWGIDPVGLRIALRRYTDKYPSMPIMILENGLGAEETLFSKKKIHDSYRIDYLRKHLSQLQLSIQEGVNVIGYFYWSPIDIVSSGSGQMHKRYGLIYVDLNDFGIGSGKRIKKDSFYWYKQYIE

SEQ ID NO: 16234 - protein, 478 aa, Leuconostoc mesenteroides subsp. mesenteroides ATCC 8293
MSKRLSEDFLWGGAVAAHQLEGAWQEGGKGVSVADIMTVGGPDKERNITKGVVSGEYYPNHEAIDFYHRYKADIALFKEMGFKCFRTSIAWTRIYPTGEESEPNEAGLKFYDDLFDELIKNNIEPVITLSHFELPYHLVTKYGGFRNRKVIDLFVKFATTCLKRYKDKVKYWMTFNEINNQANYDNDFLVFTNSGLHFNPGENREEGMYQAAHNELVASARVVKMGHDINPNFQIGCMIAMGPIYPASMNPDDVLAAQKSMEKNYFFADVHVNGQYPAFLTKYWTRKGFNIDVTQEDLADLQAGTVDYIGFSYYMSHAVKKPEGLNFDDMTPENSQVRNTYLAASDWGWQIDPKGLRYALNWFTDKYHLPLFIVENGFGAYDKVEEDGTIHDSYRIAYLQEHIREMKLAVVEDGVDLIGYTPWGCIDLVSAGTGEMDKRYGFIHVDKNNQNEGSLKRSKKDSFYWFKDVIATNAENIN

SEQ ID NO: 16235 - protein, 218 aa, Leuconostoc mesenteroides subsp. mesenteroides ATCC 8293
MSGIIAPSILSADYTNLERDVKLVEAAGAEYLHIDVMDGTFVPAISYGPNWVKQLRPETDLVLDVHLMIQNPERFVEEFADAGADIIGVHVEATPHIHRALQMIKNKGVKAEVVINPGTPVSAIEAVLDMVDQVLVMTVNPGFGGQKFLPSTLQKIEQLQTFREERGFDFDIEIDGGVNNETIKSAYDAGAKVFVAGSYVYDKVDPAAKIGILKDLIK

SEQ ID NO: 16236 - protein, 273 aa, Leuconostoc mesenteroides subsp. mesenteroides ATCC 8293
MKTLTEDILYRVIKKRAKDSHKGTYGRVLIIGGTAQFGGAVIMNALAAVNSGAGLVTVATDPSNFTALHSHLPEAMVVDFNEDLTEYIKKSDVVLIGSGLGDRIDLVQHTFYAILPRQILIVDGSALTLVAEHKLKWPKSRLVLTPHQMEWQRLSGVTINEQAFEAFNMLAQQRMNVEPILVLKQHHTQIYTNDCAFEIPVGGPYQATGGMGDTLAGMIAGFTAQFMLSFSEAILAAVYAHSAIADELAETRYITLPTEISASIPEFMHRYSR

SEQ ID NO: 16237 - protein, 487 aa, Leuconostoc mesenteroides subsp. mesenteroides ATCC 8293
MEGKDLNMYSDDSLVLHTDAYQINMIYTYWKQGIDQKPVVFEAYFRKMPFNNGYVIFSGLERIVKILNQLKFTDDDIDYLQSLDLYDTEFLTYLKNWHLTATIRSAYEGEVMFNNEPLLQVEGPLVDAQLLETLLLNIINFQTLIATKAARIASVTNGDPLLEFGTRRAQELDAALWGTRAAFIGGFDATSNVRAGKLFNIPISGTHAHALVQAYHNDYDAFHAYAATHKNVVFLVDTFDTLKSGVPNAIKVAREFGDKINFQGVRIDSGDMAYLSKKVRIMLDEAGFTNAKIYASNDLDENTILNLKIQGAKIDVWGIGTKLITAYDQPALGAVYKMVSIDGDDTIKLSNNVEKISTPGKKQVWRITDSKDGKSEGDYLTFDDENPSQLETLHMFDPNHPVISKNIKNFDAQPMLHDIFVEGDLIYDLPDITTIKSYAKHSLNDLWDEYKRILNPETYPVDLSQKLYDAKMNLIHDIRNNIQEMTK

SEQ ID NO: 16238 - protein, 132 aa, Leuconostoc mesenteroides subsp. mesenteroides ATCC 8293
MIGTEPDFNKQSQNGLIPAVIVDAETKAFLMLGYMNKESYSLTKSTGQTWFWSRERQELWHKGETSGNIQQVVSMTLDCDLDTLLIHVNPAGPACHTNAYSCFFNTIKGEGLADANQATIANKWTDGYFPKE

SEQ ID NO: 16239 - protein, 454 aa, Leuconostoc mesenteroides subsp. mesenteroides ATCC 8293
MVANEFKEEFRMAEQYDVVVIGGGPAGNAMASGLKAQGKTVLIVEADLWGGTCPNRGCDPKKILLSAVEARQAAQHLQGQGLIGAPKIDWPALMALKRGYTDGINDGTLNGLKGQDIATLHGQAHFQSDNQLAVGDRVVSATDYVIATGQRPAILPITGHEYFKTSTDFLDLDQMPKRVTFVGGGYVGFELATIANAAGADVHVIHHNDRPLKAFDADLVKDLMAAMTADGITFDLNTDVQAITKTATGLQLTADNFELTTDLVISSAGRIPNADQLGLANVGVTFDRHGIQVNDHLQTANPHIYAIGDVSDTPVPKLTPVAGFEARYLVGELTHPGAAIKYPVVPTQVFAAPKLAQVGISAAAATEHPDEYRVNTLDMTKWFTYYRFGAQQAQAKVVVAKASGQVVGATLLSDVADEMINYFTLLIEKHVTLPDLQRLVLAYPTPASDLQYLY

SEQ ID NO: 16240 - protein, 187 aa, Leuconostoc mesenteroides subsp. mesenteroides ATCC 8293
MKPLITHPAIKGVLATETDIQAQVQRVANELTTKFEGNKERPIFIAVLKGGVIFATDLLRKMPLDVDFDFVDVKSYSGAASTGQVKVVHDVSMDLTGRDVVIVDEIIDSGRTMQWLHNYFELKGASSVTTVALADKKEARVVDFEVDYFGLEVPDEFLVGYGMDYNNFFRNLPVIAIVDFDKVDLIK

SEQ ID NO: 16241 - protein, 299 aa, Leuconostoc mesenteroides subsp. mesenteroides ATCC 8293
MNNTEYYDRLGVSKDASQDEIKKAYRKLSKKYHPDLNHEPGAEEKYKEVQEAFETLGDEQKRAQYDQFGPNGAQGGFGGQGGFGGQGGFSDFSDLGDIFSQMFGGGFDPNRPRKGQDLQYRMNLTFEEAIFGKETTIKFNRGDGKQHEIKVTVPAGVETGQQMRLSGQGESGVNGGPQGDLFVVFQVSPSRDGFERDGADVYLEQKISFVTAALGDEIQVKTVHGEVKLRIPAGTQTGKRFRLSGKGAPRLRGNGHGDQFVIVTVEVPTRLNKDQKKALEAFKEATDGTTKKKSFFDKL

SEQ ID NO: 16242 - protein, 473 aa, Leuconostoc mesenteroides subsp. mesenteroides ATCC 8293
MKKTKIVSTLGPSSSDVETIVKLIQAGANVFRFNFSHGDHEEHLGRMNAVHEAEKITGKTVGILLDTKGAEIRTTKQADGKIEFHTGDTLRIAMDENLEGTKEKIAVTYAGLFDDVKEGGQVLFDDGLLGTTVIEKDSATRELVVRVDNDGILGSRKGVNAPGVSINLPGITEKDADDIRFGLDHEINYIAASFVRKPEDVLEIRGLLKEKNMEHVQIIPKIESQEGIDNLDAILEVSDALMVPRGDMGVEIPAENVPLVQKDMIRKMNKAGLPVITATQMLDSMEENPRPTRAEASDVANAVFDGTDATMLSGESANGDYPVESVATMAAIDEKAETSLRENGRHEDIFFDETDSTEAVAASVARIARNVNAKAVVVSTNSGYTARMVSKHRPDVNILAVTYSERVQRGLTLNYGVVPVVYDAPKTIDEMVDLAKKAVKDQGLANSGDTIVIAAGVPMSQSGTTNMLTVQTV

SEQ ID NO: 16243 - protein, 509 aa, Leuconostoc mesenteroides subsp. mesenteroides ATCC 8293
MSVLLDRLNKQLELHENEIQLIDVKSEIKLTGKETKEAIHLFREQFINQNIQRGDVVLIGLENSIWITIIEQALWEIGAIAHPVAETTGIKEILSEFTAYRYSGAIVSDRLRMELANQEILSERSFEVLSHLVNLFSFNGTSVRKIADDDEQQLALILNTSGTTGKPKRVGITNKKILLATQAVTKSQNIKESDHALIVMPMFHINAQIVSTVTSRINGCRVIVAPKFSASQFWTIVAKYQVTWLSVVPTIINILLKNQNSNQQYEKVKKAVHLEYVRSASFSLPEQLLTDFERRFNVKVQEGYGMTESTTVVSINPLDKPKVGSVGPVVDTDIAIHSSVYGITYKPNQHGEIVIRGPRVLQAYLDPKDNILVDGYFRTGDIGYFDEEGYLYVIGRIKEIINHGGEKVAPAKVEGIISQFQFVTEVAVIGLPDELYGERVVAALHLNNSSDHNQEIDEIRGKISKELAKYEQPSEYLITGAFPRNQTGKILRAQLIERLKGEMQHATIK

SEQ ID NO: 16244 - protein, 258 aa, Leuconostoc mesenteroides subsp. mesenteroides ATCC 8293
MTRISQALENKNAFIGFAVAGYPDFEKSAKYIVDMAEAGADLIEIGIAFSDPSADGPTIMNADQEVLENGSTTADVFNLVAEVRKHTDVPLVFLTYTNPVFKYGYEKFLSKMQSLDIQGVIMPDMPMEEQDEFLELVHQYGRDFIQLVTLQSGNRLPKIVERASGFIYVVSSLGITGSRSKLSNEADEIVTKIKRLTDLPVAVGFGITTYDQAKQFESADAIIVGSALVKIIEDHPEDATSYLTDFIKNMKGARHATN

SEQ ID NO: 16245 - protein, 356 aa, Leuconostoc mesenteroides subsp. mesenteroides ATCC 8293
MNLLDKIKNIWPFGQSHKMRAIGFERPLLIDQPDAFVEKVIPRPQPDKDELLVKVLASSVNPVDTKMRANYTHDGVFRILGFDAVGVVVEVGQNVQHFSVGDKVYYAGAQLKPGSNADLQVVHEALVGHAPTSLSDEEIAAMPLTSITAYEILHEALCYDLEENSALGHTILIVNGAGGVGSVLIQLAKYIGMTVITTASRTESVTWVKSLGADYILDYHQDLNEQMRKIQHDKVDNIAILQNTDYYWPLATAVIKPFGRIASIVETTEPIDMGPLKNIGAQFSWVFMFAKGNYGVNMQSQGNALNQVARLLDENKIKTTLSKTYHGLSVENIRAATKEVEAGRMIGKVVVKYDEQ

SEQ ID NO: 16246 - protein, 237 aa, Leuconostoc mesenteroides subsp. mesenteroides ATCC 8293
MAKLVLIRHGQSEWNALNLFNGWIDTKLSEKGIAQAKEAGDLLAAEGIQFDQAYTSVLTRAIQTLHLALEEAGQLFIPEAKSWRLNERHYGALQGQNKAEAAEKWGDEQVHIWRRSYDVLPPLLDSYDETMTVQGNTYPAFDRRYADVPEGELPLGENLKITLERVLPFWESDISKDLKAGKNVVIAAHGNSLRALVKHLENISDDDILNVEIANGQPLVYDLADDLSVVSKKTLTK

SEQ ID NO: 16247 - protein, 232 aa, Leuconostoc mesenteroides subsp. mesenteroides ATCC 8293
MNLITYEMMETMTRLVTATEMQQIDNYTIETIGMPQDVLIERAAMAVLDVIGAGRFDLSHVLVLAGLGNNGADGVAIARLLYAQGVNVSLQFVGNVSRAKDSVKRQLAIIEKHGLVRSEKSDFNEATLIIDAIFGVGLNNVLPEGLQKMIKAANHIDKPVIAVDVPTGIDATTGEVRGAALKAHTTVTFGFTKVGLTQQNGCYLSGNVILKDVGMLIPDDFEFSLQETLPVA

SEQ ID NO: 16248 - protein, 245 aa, Leuconostoc mesenteroides subsp. mesenteroides ATCC 8293
MSMIEFKNVEKYYGKFHALKNINLKIDEGETVVLIGPSGSGKSTLIRAINGLEEIQEGKLLVNGFDLHDPKTDINRIRKNVGMVFQHFNLYNNKSTLENVMLAPRLVLKRSEDENKSTAMALLDKVGLADKAANMPSELSGGQKQRAAIARSLAMQPKALLFDEPTSALDPEMVGDVLDVMRDIAKDSSMTMLVVTHEMSFAKAVADRVIFMADGEILEDSTTEEFFNNPREPRAQQFLSQVDHK

SEQ ID NO: 16249 - protein, 405 aa, Leuconostoc mesenteroides subsp. mesenteroides ATCC 8293
MAKLTVSDLELSGKKVLMRVDFNVPIKAGVIGNDNRIVAALPTIKYVLENNGRAILFSHLGRIKSEDDKKELSLAPVAARLGELLGKDVKFVPQTRGEELESAINALQDGEVLMVENTRFEDVVDGEVVKNESKNNPELGKYWASLGDDLFINDAFGTAHRAHASNVGIASNVSQAAAGFLMEKEIKFLGDAVANPVRPFVAIIGGAKVSDKIEIVKSLLNKADKVIVGGGMAYTFDAAKGNKIGNSLFEADKVELAKELMAEAGDKLVLPIDSIAADAFSNDAKTEVVDAEDGIPDGYMGLDIGPKSVKLLQDTLSDAKTVVWNGPMGVFEMSNFAKGTLAIGEELVKVTENGGTTIVGGGDSTAAVQQLGVADKLTHISTGGGASLEYLEGKELPGIASISEK

SEQ ID NO: 16250 - protein, 486 aa, Leuconostoc mesenteroides subsp. mesenteroides ATCC 8293
MYSKESITGFPKDFLWGGATAANQIEGAWQVDGKGLTTAEVVRKAEDRRHGSMGDVNADTLQEAIADHSDVHYPKRRGVDFYHHYKEDIALFAEMGFKVFRLSIAWSRIFPTGLEENPNEAGLAFYDRVFDELDKYHIEPLVTLSHYEMPIELTKRYNGWLDREVIKAFNHYTETVFKRYKDRVKYWLTFNEINTSAWGFHETGAMDGDLSTQEQLQVRYQAVHHQFVASAIATKQLKEIAPNAKIGSMLARMQTYPATANPVDVQAAQVEDQKNLFYTDVQARGEYPEYMNRYFNENGIVINMSADDEKILKQYPVDFISFSYYMTNVTGVDGVEDGIGNMSLGGRNPYLKESEWGWQIDPIGLRVSLNVLWDRYRKPLFIVENGLGAVDELTADYKVHDDYRIDYLRLHIEQMKEAVIDGVDLMGYTMWAPLDIISFSTSEMSKRYGLIYVDQDDAGNGTLKRYKKDSFFWYQKVIESNGKTLE

SEQ ID NO: 16251 - protein, 309 aa, Leuconostoc mesenteroides subsp. mesenteroides ATCC 8293
MKKVLVANMTSQKAVDYLESKGYQVIKNDQASDDDFLGHADVDGILIMMHPFGESLMSKMPNLKVVARHGVGYDNVDLDAASAHDIVVTNTPGANATAVAETAMMHILMAGRLFYQRRQAITDNANKRYLAAHHGQELTGKTVGIIGYGHIGQEINRMLTGFNVKVLAYARHQHEVTNGRMATLDEIYEQADFVVTALPATPETKHMINASVFRKMKKSAVLVNIGRGALVDERALVEALTNEEIAGAGVDVVEKEPITAENPLLHLPNAFVTPHVAMISKEAMDNVALKAAEDIVRVLEGERAVFQVN

SEQ ID NO: 16252 - protein, 250 aa, Leuconostoc mesenteroides subsp. mesenteroides ATCC 8293
MSEAQTKVKVHVDKVNKSYGSNHVLRDISLDINENEVVVMIGPSGSGKSTFLRMLNQLETPDNGTIVVDGYDLSHKGTDINKVRENIGMVFQSFNLFNNYTVLENIMLAPVELGKMDKEKAEKKARELLETVGLAEKADVSVNSLSGGQKQRIAIARALAMEPDIMLFDEPTSALDPEMVGDVLDVMKNLAGSGMTMIIVTHEMGFAKQVADRVVFFESGKIQESGVPEQVFNAPKNERLQEFLSKVMHA

SEQ ID NO: 16253 - protein, 457 aa, Leuconostoc mesenteroides subsp. mesenteroides ATCC 8293
MSDSKGDSNLPKRGLQNRHVQLIAIGGTIGTGLFMGAGNSIHFAGPSILLVYLVIGMFMFVVMRAIGELLYADPSQHTFISFITKFLGNRAGFFARWSYWLTVVFMGMAELTAVAKYIQFWLPDLPSWLIQIVMLILLTSINLIAVALYGETEFWFAMIKIVAILSLIVTGIIMALTGFETPVGKVAFSNVWHHFELFPNGVGNFINAFQMVMFAFVGMEFIGMTTAETENPRSVLPKAINQIPWRILFFYLGALFIIMTIYPWQKIPEDQSPFVMVFQLAGVKWAAALINFVVLTSAASALNSVLFSASRNFFALSFQSKAKFLQPFRKTSKTQLPVNAVLVTSLMVAFSALISVIPSITNAFSFVTSASTDLFLMIYVLILFAYMKYRKSDSYMPDGFLVIAPKTLVPLAILFFSFVFITLFFNPESRLPAIGATIWMVVFGCISMKQPKQALNK

SEQ ID NO: 16254 - protein, 240 aa, Leuconostoc mesenteroides subsp. mesenteroides ATCC 8293
MTKIILAGGFGKLGQAIQDNLNEEYEIVGIVSGHQHESKVPVWTSLSDINVAADIWLDVSTPATVFDNAMYAIEHNMPLVIGATGLSDEQVAILREQSSKGVLIVPNFSLSAVLLMQFSQLAAKYFPDAEIIEAHNPKKVDAPSGTAKQTARLIAKARIAEPTSTKLAPARGEQIDRVPVHAVRLPGYIAQQSVYFGGVDEQLTLTQSTTSRSAFVPGVIRAIEAVKNIDGVVIGLDQII

SEQ ID NO: 16255 - protein, 394 aa, Leuconostoc mesenteroides subsp. mesenteroides ATCC 8293
MHFEESDLLKTLPKQFFATLVAKVNAKIAAGKDVINLGQGNPDQPTPEYIVESLQAAAENPADHKYSLFRGEERFKKAIAEFYADEYGVSIDPETEVAILAGSKIGLVELPWALMNPGETLLLPDPGYPDYLSAAALGRVNYEAVPLKQENNFLVDYEAIPNSVAEAAKFLYLNYPNNPTGAIATSEFYQQTVRFAEENQVGIVSDFAYGAIGYDGHKPLSFLQTENSKSVGIETYTFSKTFNMAGWRVGFAVGNAEMIEALNLIQDHLFVSLFPAVQDAAIEALTNRAAREKAVTDLTNLYQRRRDVFINAVREFGWEPYVPRGAFYVLMPVPKGYTSSEFADLLLEEANVAVADASGFGKGGQGYIRVGLTIVEERLAEAAKRISKLPIFSK

SEQ ID NO: 16256 - protein, 287 aa, Leuconostoc mesenteroides subsp. mesenteroides ATCC 8293
MNIGFIGTGVMGTGIINNLLQAGYEVSVFNRTHSKANTVLNNGAIWRDTPAKVAQYSDITFTMVGYPKDVEEVWTSEDGVFAGAKEGSILVDMTTSTPRLAEQLAQTGADLGFKVLDAPVSGGDIGAKNGTLAIMVGGEQQVLDEIKPVLSVIGQQIVFAGSAGKGQHMKMSNNIGVAATVITMAESLVYAKAAGLDLESAYNVWRKGAAGSWSVDNYIPRIFQGDYAPGFYVKHLLKDLRIALDAAKEMDIDLPNTKLAEQLFERLSQEHGDEGVQAIVKLWASFE

SEQ ID NO: 16257 - protein, 451 aa, Leuconostoc mesenteroides subsp. mesenteroides ATCC 8293
MKIGIIGATHAGVYAAKQIKSEHPEAEVTVFEKNTTVSFLSCGIALWIGDHVSDPEKMFYETPESMRNQGITMLMAHQVNQADLKSKTLTVTNLDTEEVTTQQFDKIVITTGSKPVIPNIPGIDSNRVYFCKSWDDATRIKSVAKDLKRVAVIGAGYIGAELAEQLSVTGKQVTLIDGADRVLAKNFGPAFTERIQKEYEKNNVDVVLNQFVSKFENTPNGIKITTPNGSYEADIAILGIGFLPNTDLFSGQLETLPNGAIIVNDYMQTSEDNVYAAGDASTVFFNPTQAIDYIPLATNAIRQGILVGKNIVEPTTRYLGTQATSAVELYEQAMVATGLNSATAKEKGLDVIETVIESDYRPDFMLSTTSVLSSLTWEKDTGRIVGGSFMSQHDVSQSANLVSIAIQKQMTIDELAMSDFFFQPNFSQPINYIPEVALAAVAEKQALTLAY

SEQ ID NO: 16258 - protein, 457 aa, Leuconostoc mesenteroides subsp. mesenteroides ATCC 8293
MKTKSKKVKLNFLHYCVYVISLGGFLFGYDTGVINGALAFMSRPDQLNLTPTLQGVVSSSLVIGACFGALGCGRVADKIGRRKTLRIIAIVFTIATVLCAVAMNFWLMSLFRFVLGLAVGAASSLSPMYLAEISPENLRSANVNKNAIFIVLGQLCAFIVNAILGNIWGHWGPIWRVMVISGAVPSIILWVNSFRISGSPQWLLLKHRFNRARKIFRRLGFKNTNQLIKSQSDQSSEQNDNEFNWSIALKNKKLFYLLVTGIVIALIQQISGVNTVMYYGTILLEKVGMGESGSLYANVLIGVVSVIASIFGTRMIEHANHHRMLIIGLIGNVVFMALLGTIMKSSVFSQGITNALVLVSLTLFLANHQGIVSPVTWLLLAEMFPGKVKAQFMSVATATTWITNFVISLIYPQLVAILGTALVFFVFAMSNGLSIVLASLFVNSKKMAKAYDTASLS

SEQ ID NO: 16259 - protein, 459 aa, Leuconostoc mesenteroides subsp. mesenteroides ATCC 8293
MENGSTKRIASSFIYFFGAFGGILFGYDIGVMTGALPFLQKDWHLTDAGTIGWITSTLMLGAILGGALAGQLSDRLGRRRMILASSFIFAVGAIMAGVSPNNGVVWLLIARFLLGLAVGAASALVPSYMSEMAPAKNRGRLSGLNQLMIVSGMLLSYIVDYLLQGLPHTIAWRLMLGLAAVPAIILFVGVLRLPESPRFLVKTHKLAEARQVLTYIRTASEVDPELEDIQNTVAIESGAQKNITLSTLFSSKYRYLVTAGIGVAAFQQFMGANAIFYYIPLIVEKASGQAASSALLWPIVQGVILVLGALLYMVIADKFKRRTLLMVGGTVMALSFLMPSALNALVGADKFPPMLIVVFLSIFVAFYSFTWAPLTWVLVGEVFPLAIRGRASGLASSFNWLGSFAVGLLFPIMTAAMPQATVFAIFGVISIIAVLFIKFAVPETHGRTLEEIEAQGTNH

SEQ ID NO: 16260 - protein, 202 aa, Leuconostoc mesenteroides subsp. mesenteroides ATCC 8293
  misc_feature (179)..(195): Xaa can be any naturally occurring amino acid
MENGSTKRIASSFIYFFGAFGGILFGYDIGVMTGALPFLQKDWHLTDAGTIGWITSTLMLGAILGGALAGQLSDRLGRRRMILASSFIFAVGAIMAGVSPNNGVVWLLIARFLLGLAVGAASALVPSYMSEMAPAKNRGRLSGLNQLMIVSGMLLSYIVDYLLQGLPHTIAWRLMLGLXXXXXXXXXXXXXXXXXRHSVSHM

SEQ ID NO: 16261 - protein, 450 aa, Leuconostoc mesenteroides subsp. mesenteroides ATCC 8293
MAHITFDTKNIENFVADHELDEMQPLIKMADEQLRNRSGAGAEYSDWITLPTDYDKDEFARIQTAAQKIQSDSKVLVVIGIGGSYLGAKMAVDFLNPMFNNELADNQRQGVKIYFAGNSTSASYINDLVRVIGDQDFSVNVISKSGTTTEPSIAFRVFKQLLEKKYGAEAAKQRIYATTDANRGALHDEAKISGYETFTIPDGVGGRFSVLTAVGLLPIAASGADIEALMTGARDAQEEYSDSDIKNNEAYKYAAVRRILYDKGYTTELLINWEPTMQYLSEWWKQLMGESEGKNQKGIYPSSANFSTDLHSLGQYIQEGRRDLFETVVKLDNPVSNIDLPHEDGNNDGLQYLEGVTIDEVNTKASQGVTLAHVDGGVPNLAVHLPAQDAYSLGYLIYFFEIAVGASGYTFGINPFNQPGVEAYKTAMFALLGKPGYEEQTKVYRARLGK

SEQ ID NO: 16262 - protein, 245 aa, Leuconostoc mesenteroides subsp. mesenteroides ATCC 8293
MIEVKDVHKSFNDNEVIKGVSLSLNEGEVVTILGPSGSGKTTFLRCLNFLETADSGSITVNDEQVTFGQANANDILQLRRQMGMVFQNYALFLNKTAKQNIMEPMVIVHGFSVKEAEVRAAELLEAVGLPDHGDYYPAQLSGGQKQRIGIARALAVHPAVLLFDEPTAALDPELVGEVLKVMKGVKDAGVAMIVVTHEMQFAYEVSDRVIFMADGVIVEEGTPQQIFETPKEERTKAFLNRFTVQ

SEQ ID NO: 16263 - protein, 323 aa, Leuconostoc mesenteroides subsp. mesenteroides ATCC 8293
MKILFFNVSAVEKNIIDEWADTQLISVKTLPVSIDYDNIDLTRNFDAVIFYPGKSFQTDEKLYARLAENGMKQISVKSTGYDNINFEFAEKYHLTITNVPDYSPESVSHFTVMSVLMLLRNLPRYLDSPETTQRKEFMGRELTEVTVGIYGAGRLGSLVAKTLKFMGARVMMNSRSLKPELIGSGIEFVDFKQLLVESDVLSIHVPLNKQTFHKFDFDNLSLMKQNAILINTARGEIVDTSALITHLQQGKFQGLALDALEDEDTKGFATNPYYQSLHKFENVLLTPHIAYFTKAAVRDIAITALENARDIVIEGKSENTVVQ

SEQ ID NO: 16264 - protein, 257 aa, Leuconostoc mesenteroides subsp. mesenteroides ATCC 8293
MSFIEIKDVHKSFYQKEILKGIDLTLHKGEVIVILGPSGSGKTTFLRCLNTLEKADKGQIKIDDVTKDFTVKDRQNTRDLILKTAMVFQGHALFDNMTVLQNVIEGLIRVKKMDREAATKIGLSTLDRVGLSDRANYYPVQLSGGQQQRAGIARAMAMQPELLLFDEPTSALDPELVGEVLSAMKELAQEGHTMIVVTHEMQFAYEVADRVLYMEGGVVVEQGPPEEIFNAPKDKRTQQFLARLSGKNFGEPELVNS

SEQ ID NO: 16265 - protein, 302 aa, Leuconostoc mesenteroides subsp. mesenteroides ATCC 8293
MKFAMIGLGKMGLNLVKNAVDNGHEVVAFDLNADFVKEATDYSASVEAASDIDDMLSKLPSPKAVWVMVPAGVPTNSTIDTLIEKMDKGDIIIDGGNSNYKDNLEQNKRTSAAGIKFFDAGTSGGMNGARNGGNFMIGGDDAEAWKIIEPLFKSISEEDGYLYTGRLGSGHYLKMVHNGIEYGMMQAIAEGFEVLEASQFDYDYEAVSKLWNHGSVIRSWLMELAEEQFAKDPHLDAIAGRMHSSGEGKWTVQESLDLDVPAPVIYLSLAMRYRSLQDDTFTGKVVSALRNGFGGHAMDAAK

SEQ ID NO: 16266 - protein, 435 aa, Leuconostoc mesenteroides subsp. mesenteroides ATCC 8293
MSTIAHYFKLDELNTSVRTEFIAGLTTFASMAYILFVNPTVLGAAGMDKGAVFTATAIASAVATIFMGVVALYPIAIAPGLGVNAFFAYSVVIGMGVKWETAMAGVFVAALIFLVLTFFKIREKIINIIPQNLKLAIASGIGLFIAFIGLHDAGLIVANKDTMVSLGHLSSPTSLLSIFGIIVTFILMSRKTPAAIFIGMILTSLAGILTGLIKLPSAIISPAPSLAPTFGAGVMHVGDINSLQLVTVVITFLIVTFFDTAGTMIGLATQAGFMKNNEMPRAGRALMADAVGMTVGAVIGTSPTSAYVESSSGIAVGGRSGLTSVFTGIFFLFALLFSPLLSVVTSQVTAPALVVVGVLMAKNLRLIDWEDLAIAAPAFLIVIGMPLTYSISDGIALGFILYPITMIATGRIKKVHPLMYVLAIMFIAFLMIIAH

SEQ ID NO: 16267 - protein, 220 aa, Leuconostoc mesenteroides subsp. mesenteroides ATCC 8293
MAAKLVLVRHGESTANRDNEFTGWTDVPLTLKGVRQANRVGEVLKRHGLQFDVSFTSFLKRAIITDNIILEEIEQLWLPLHKAWQLNERHYGALRGLNKDYARQQYGANKVALWRRSYTATPPLLEHVIPDRRYPEDLEPRGESLKMASDRLVPYWHSEILPQIQQDKNVLIVAHGSSLRALVKYIEHISDEDIDGLEIDNGEPILYEYEEGFSERIYLE

SEQ ID NO: 16268 - protein, 479 aa, Leuconostoc mesenteroides subsp. mesenteroides ATCC 8293
MSEHKGHIQRNLKTRHVSMIALGGSIGTGLFVASGATVAQAGPLGAIVAYLAIGVMVYFLMTSLGEMATYSPTSGSFSDYAGKYVDPALGFAMGWNYWFNWAITLAVDIVAVGLVAEFWFPNTPGWIFSAIALLLIFLINIFSVGTFGEAEFWLSMIKVVTIIAFLIVGLATIFGVIHSDINVMKNLSVGNHGFVGGPQAILSVFVVAGFSFQGTELIGITAGEAEDPDKSVPKAINQVFWRILLFYILAIFVISALVYYKDPRLLSSSTQNIAVSPFTIVFKNAGIAFAASLMNAVILTSIVSSANSGSYASTRMLYAMARKGDAPKIFAKLSTRGVPVAALVLTTAIGLLAFIANTKGGSVAYTWLVNASGLTGFIAWVGIAISHYRFRRAYVAQGKSLSDLKYKAKWFPFGPLFALVISIGVIIGQDPDSFAHLNWEKIFVTYLSVPLFVILYFWYKVSHKTKLIALKDVDLKQYK

SEQ ID NO: 16269 - protein, 466 aa, Leuconostoc mesenteroides subsp. mesenteroides ATCC 8293
MSLLARAFKRESVDNYLSADSHMSRVLTTRDLISLGVGTVIGTGIFILPGHEAADHAGPAVAIAFLIAAIFSGLSGMAFAEFSAAMPVAGSAYSYGGAIYGEIIGWLLGWSLIVEYFLAVSAIATGFSAYLGNLLAIFGIHIPKYLSAGPMEGGIVNLFAVLIILFVAAILSRGLNTSKKVENGAVVIKIAILILFIVGGSFFIKTSNYVPFYPKEFHSGLGGLNGIWAATASIIFAFLGFDTIAAHAAEVKNPQKTMAKGIVGTVIISALLYTLFSIVLTGIVNYKKLGVDDPAAFALQVVHQTQFSIVITIGALIGMFTAVLALIYASSRLTYSFGRDGLLPRSLGKISPGSHLPVNALILAVAVEVIFAGLIPLSTLASLINAGTLTAFAFINFGILILRRRKDLAHDGFKVPGYPIVPFIAGMISLFFITQLSAETLKMFGLWLLLGVIWYFSYGIKHSKLS

SEQ ID NO: 16270 - protein, 329 aa, Leuconostoc mesenteroides subsp. mesenteroides ATCC 8293
MNKILMTSVRSDEEQAIRHYAEKNNVEIVISRDDFHPETLPDLTEIDGLVIQQTAKIGGDQQFYHHIAKQITQIATRTAGYDMIEVDLAKKAGLKITNVPAYSPRSVAEMALMQILRLLRHTPEFDKRIANNDFRWTGLQAREIHSVTIGIVGVGRIGGTLAKLLNSIGVNVLGYDTDRDASLCDVITYVTKDELLAQSDVISLHVDLNETSIHLLSEADFLKMKKGVLLINASRGPVINTSDLITFLGNGQVGAVALDTVENESGVFNHDLHGQGVQDARIQKLLSMSNVIITPHVGFFTNIAVKNMVDISLDDTLMILNGQSSPHEV

SEQ ID NO: 16271 - protein, 187 aa, Leuconostoc mesenteroides subsp. mesenteroides ATCC 8293
MAKNLILLGLPGAGKGTQADFIVKDYSIVHISTGDIFRANLAENTELGQKARQFMDAGDLVPDEITNAMVADRLNQQDVETGFMLDGYPRNEAQAVFLDKYLSDNGKSVSATLYFEVADTLLRERLLGRGRADDTPEVIDNRLAVNKAANLPLVDYYQKAGVLHTIDGGRELADVYHDVKEVLDNLN

SEQ ID NO: 16272 - protein, 320 aa, Leuconostoc mesenteroides subsp. mesenteroides ATCC 8293
MNTIKSLSKFLTKYFTFFVILVALLAIFIPGPGTTLATTKVGNLSAVSILLMIVLFGMGITLTPNDFKRVARNPLQVILGTIAHYIIMPFIAFLLVHLFGLTGAAAVGVILVGSAPSGTSSNVMSFLSGGDVALDVSIGLLSTLLAPVMIPTLLKLLAGKWVNVPFSSMFFSAFQIVVIPIVLGIIVHTIFKEHVQKVIEIMPLISQVAILVIILAVLSANSKTILAVSTLILVPVIILHNLLGYLLGYGFSKLMKMDTPQQKAITFEVGMQDSALASTLAISFFEPASAIAAVMFSVWHNISGSVLASLWKNHTEKAPD

SEQ ID NO: 16273 - protein, 240 aa, Leuconostoc mesenteroides subsp. mesenteroides ATCC 8293
MIKVEHISKQFGTNDVLKDINLEVPENEVVVIIGPSGSGKSTLLRLINHLDVATSGYIHVDGEDITDENNDISSIQAKMGMVFQHFNLFPNLTVLENITLAPKRVKRLSVDEANEEAKKLLALVGLSDKVNAYPKSLSGGQQQRVGIARSLAMHPKYLLFDEQTSALDPEMVDDVLEVMKDLAKQGMTMIVVTHEMGFAREIANKVIFMADGVVVEEGSPNAIFGAPQHVRTKEFLGKVL

SEQ ID NO: 16274 - protein, 312 aa, Leuconostoc mesenteroides subsp. mesenteroides ATCC 8293
MSEKRIHIVGDLHEVAIQKFTSAGYDVSHSPNYDEKKLLSLASDAAVIIMTDMAFDKNWFDALPNLKLIARRGVGYDNIPVESATKHGVWVTNTPGANAIAVAELAVTLILTVLRKVNQATNSVQKGEALTYPASLMGHNLSGKIIGLIGYGQIAQNLEKILHGFGAHVLVYSRTKRETLYGQFVSYDTLLAQSDIISLHIPATPETSGILNHEAFSKMKTNAILINTARAALVDEEALVEAINTGKIAGAGLDTTSYETIKTASPLLNHDQIVITPHIGANTVESEYLTAEKVVASVLDFFNNQKPIYRLN

SEQ ID NO: 16275 - protein, 212 aa, Leuconostoc mesenteroides subsp. mesenteroides ATCC 8293
MLEIKNLTKKYDQNVIFKSLNLTVHDGEVLSIVGPSGIGKTTLIKIMAGLETADDGEIILNGENIDIKGESSDTNIGMIFQDFNLFPNYTVIDNITLAPINVNKQSSSKAVEQGQELLESLGMLDKANLFPYQLSGGQKQRAAIARALAMNPKILAYDEPTSGLDEASTHQVADVVKTLKKRGVTQVIITHDQPFAEMVSDRVFDFATEVKR

SEQ ID NO: 16276 - protein, 341 aa, Leuconostoc mesenteroides subsp. mesenteroides ATCC 8293
MMYHVFIKLLQKKEKKMLQRNLGSQGLKVSSVGLGCMGMSSTYGRADDKESIASIRQAVVNGVSLFDTANVYGNGHNEKLLGKALKGVDKQVTVATKVGIQEMQLNQKRINGRPDYIRSEVEKSLIRLDREYIDLYYLHRVDPDVPIEESIGEMSRLVEEGKVKYIGISEASLSTIKRAHQTHPITAVQSEYSLWSRGVEKEIMPYLQANEIGFVAYSPLGRGFFADDFSLDASKEDVRQYLPRFQGDNLTANQEVFKVIRNLSQKLGMTSSQLALAWLLQKNSNLIAIPGSKSIQHINENIASSHIDLDDKIIHILDKIFDESNTHGSRYPSMLMDELEK

SEQ ID NO: 16277 - protein, 396 aa, Leuconostoc mesenteroides subsp. mesenteroides ATCC 8293
MEKRKFLSRFKFDNGLVIKNHIVMSPMTTMTSFYNGMITTDELNYYAARAGGPGIIITGVANVSDNGKGFEGELSVAHDAMLPGLIKLAKVIHKDGTKAILQIFHAGRKANSAILRGERPVSASAIAASYPADSETPRALNDSEVHQIITEFGEATRRAIEAGFDGVELHGANTYLLQQFYSENSNQRSDEWGGSRGKRLKFPLAVIETVNKTVKKYSKKPFIVGYRISPEEIEEPGIRLEDSLFFVDQIKHKVDYIHLSMGSYKRTSLNNKANKETLISQFSQHTKNIVPLIGIGSVETPDDVNAVMSDGADLVAIGREFIREPQWVQKIERNDLESIRTLISPSDMAELAIPSVMQVYLRESFYSVMHFTDDIETQSDYQNALAPMEGLEKKLS

SEQ ID NO: 16278 - protein, 314 aa, Leuconostoc mesenteroides subsp. mesenteroides ATCC 8293
MTKQVFLPDDIPAVGKKILEEAGLEVVVGSGRDHEKMKAEGVEASAVLIGTQKFDADIMDAMPNLKVIARNGVGYDAVDVDAATQRGIYVVNTPKALSGSVAETAVSELLAISKNLYQDSKAIHDDNWNYRKAHPGRDIEGKTVGILGFGRIGQQVAKKLSGFDVKVIAFDPFAKDVPGVELVDRETIFKTADYVMVHLPALPETQHSIGADEFKLMKNDAFLINMARGSILVESDLVLALKSGEIAGAALDVFEEEPLPVTNPLVALENVLLTPHIASNTVETKARMAVDATNDIVRVLSGKNPESAVNKIGK

SEQ ID NO: 16279 - protein, 392 aa, Leuconostoc mesenteroides subsp. mesenteroides ATCC 8293
MTNIKTYNAISSKGLDYLKDHHYDINGNDAPKGILLRSQNLHDEPIDDNVRAIVRAGAGFNNIPVEELSKRGIAIFNTPGGNANAVKELTIASLVLAARPVVGAIQFANDTRGGDVSLRTESNKGGYRGTELAGKKLGVIGLGNVGSKVANTALALDMDVIGYDPGLNANTAWRVDRHIVHARSVEEVLEQADYVTVHIPLEEKNRYFIDADKLHLMKPTAALLNLSRGGIVDDEAAKEALDNDQLRVYITDFADSVLFDNPKVIITPHIGGSTIEAEDTSALMAARQLDEYLTTGNIVNSVNYPDINEPFTTKYRVGIIHENVPNMLGQISKFFGDHNINIEQLSNRAVGNYAYTMVAINDFTEEQQELVKTALDEIPHVILTRRYVNTRI

SEQ ID NO: 16280 - protein, 463 aa, Leuconostoc mesenteroides subsp. mesenteroides ATCC 8293
LFGYDTGVISGAMLFIGKELEIQTGSFEDGFITASVLLGAILGAAIIGPMSDKLGRKKLLLSAAIIFFVGALGSGIGFNYTLLVTSRVLLGIAVGAASALIPTYLAELSPADKRGGIGTLFQLMIMTGIFLAYVSNEWLSPSGWLGLNQNVGWHWMLGLAAVPAALLFIGGLSLPESPRFLVKQGKMSEAQKVLSTMNPNAKLVEEELYDIKLQANTPSGGFKELFGPMARPVLIMALGLAIFQQVMGCNTVLYYAPKIFISAGFSEHFALQSHIVIGLFNVIVTAIAVKIMDKIDRKKMLTYGAIGMGASLLTMSTAMLVLRAGNGNVGSWICVIALTLYIAFFSATWGPVMWVMIGEAFPLNIRGLGNSFGAVINWTANFAVSQSFPMLLIAFTPDHAINAEGQGIAKLFIIYGVLCFVAIWFIAKFTIETRNRSLESIESDLRSKAHAKGYLESDYVGIK

SEQ ID NO: 16281 - protein, 244 aa, Leuconostoc mesenteroides subsp. mesenteroides ATCC 8293
MTELLNIKNLKKQFGEKIIFDNVNVAVQKGEVISVIGPSGAGKSTFLRAINMLDAPTSGKVNFEDQDLTNLSEKELDQLREKMGMVFQSFNLFPNLSVIENIKLAPVKVKNISDKEATKTAEKLLAQVGLADKGTVYPDSLSGGQKQRVAIARALAMSPDVLLFDEPTSALDPEMVGEVLGVMKQLAEDGMTMIVVTHEMGFAREVADTVWFMADGGIQEIATPQSFFDKPKTKRAQEFLEKVL

SEQ ID NO: 16282 - protein, 387 aa, Leuconostoc mesenteroides subsp. mesenteroides ATCC 8293
MFILEDLMQKFSSTNKFVPMGLTFEDVKLVDDLQSTVTPESVSVTTSLTPTLKLNIPLLSAAMDTVTEARFATALAKLGGLGVIHKNMTISAQADEVRKVKTATFDSADFPNAAVDAKGHLLVAGAVGVTNDTVDRVQAMVEAGADAIVLDSAHGHSEGVLRKVSEVRSTFPNLNIIAGNIATREGAAALYDAGADVVKIGIGPGSICTTRVVAGIGVPQVSAIRDAALEAAARGKKIIADGGVKTSLDIVKAISAGGNAVMLGSMFSGTEETPGEVFEDNGQKYKTYRGMGSIAAMENGSKDRYFQGEVNEAKKMVPEGIEARVTYKGDLTTILNAMLVDIHKKMAQLGETTIDDLVNHEHIARDSEVFDFEAATDKQKPVVAAQF

SEQ ID NO: 16283 - protein, 408 aa, Leuconostoc mesenteroides subsp. mesenteroides ATCC 8293
MSLDGRNAKVEKINEITSEETPRVATKLKELNRVLGGGVVPGSMVLIGGDPGIGKSTLLLQVSGQLAQEGRVLYVTGEESATQVKLRADRLGVGHDEFYLYPETDMTAVKKQIEELQPNFVVIDSVQTMQEPDVSSAVGSVSQIREVTADLLQIAKTNNISIFIVGHVTKDGAIAGPKILEHMVDTVLYFEGDSNYKYRILRAVKNRFGATNELGIFEMRNGGLIEVANPSEIFLEERLSGATGSAIVVALEGSRPILVELQALVTPTVFGNAQRTAAGLDRNRVSLIMAVLEKRANLLLQNQDAYLKAAGGVKLDEPAIDLAIAVALASSYHDKESRPSDVFVGEIGLTGEVRSVADIEGRLKEAKKLGFKRAIVPKNNLNGIELPQGIKVIGVTTLSEALKIALGE

SEQ ID NO: 16284 - protein, 456 aa, Leuconostoc mesenteroides subsp. mesenteroides ATCC 8293
MSKTKIIIVGASHGGHQAILELTRKYKNLDIKLFEAGDFISFMSCGMELYLENSVTDVNDVRNFRPEDMEQLGAEIYSNHEVLAIDADDRTVSVKDVTTGSTEKYSYDKLILSSGVTPNSLPVPGTDLENVYLMRGKDWATSIKAKLENPDVKNITIVGAGYIGVEAAEASVKAGKNVTLIDMIDRPLGNYLDAELTAVLEKELADKGVKVVTDVRIESYEGTSQVTAVKTDEGKYPSDLVIQAAGVKPNTNWLKGVIDLDDRGWIKTDEYLRTNLPDVYAVGDAVLSYSIPAQTKLPIALATVVRREVRYIIAHLFENQPSVPFKGVVGSSALSVFDYHFATAGLNTTTAQKSGVTLKCSFYQDTLRPDYVPRENGNTEVYVELGYDPQTHRILGGAVLSTYDITAQGNVIALAIEHGLRLEDLAEADFFFQPGFDRQWSLLNLAAQHALGEPKF

SEQ ID NO: 16285 - protein, 250 aa, Leuconostoc mesenteroides subsp. mesenteroides ATCC 8293
MRKYIAEFLGTFMLVFFGTGSVVYSAATTQSAITVGLAFGLSLAVAIYAFGHISGGHFNPAVSLAMAIQKRLPWVTFIGYVIAQLLGAIVASAAVYGGVTAYLKSSTVTTALSGQSMTVKQFVSLAGLGQTNFSDGSGWYAFAFELVLTFLFVLVIAIVTKLNNVPAPFIIGIWLAVLIVVVLPITGGAFNPARALAPAIFVQGKALTHVWVYLVADLLGGALAAFAANFLDKKEEVASTPKEVKETKKA

SEQ ID NO: 16286 - protein, 482 aa, Leuconostoc mesenteroides subsp. mesenteroides ATCC 8293
MEKLFQLKENKTTVRREIIAGITTFVSMAYIFFLNPQILGQAGVPTQAVFLAAILVAVFGTLFMGLFANVPFALAPGIGMQAYFTYTIVFGFGFTWQQALAIVFLVGVVDIVITLTHGRRAIVKGIPTELKAAIGGGIGLFVTYIGLKNAGFINFIVDPSNIMTLNGKPFTGEVHGAVNSILANGGVTPELTKFNNASTLLALIGFVILVVLVMRKVPGAFLISLIVTTLIGIPMGVTNTHIGAGTSVSHAFGELGQVFGQSLGAQGLGSLFNNWHHASLALVTIFAMGLTGLFDAIGTLIGIGNQTGIFSKEDQKSFESSNGFNSKMDRALVVDTFTTAFAGIVGTSNTTTFIESASGVAAGARTGLANVVTAAGFALMILFAPLVGVVPTAATSPLLILVGIMMMGEFKKISWESLEVALPAFFTSVFMAFSYSISYGIAAGFIFFIIVKFALGKFKEVSPVLLIVSAFFLLNFAVLAFM

SEQ ID NO: 16287 - protein, 246 aa, Leuconostoc mesenteroides subsp. mesenteroides ATCC 8293
MSESLIQTSSLDKFYGKKQVLHQINVTIPKNKVTVLLGPSGSGKSTLIRTFNGLENFSSGEINIFGQTIEPRNNKQWKSIQTRIGMVFQSYDLFPNMTVMKNILLGPLKVQKRSREEVVEKAKKLLSEVGLSEYENAYPRQLSGGQKQRVAIVRALILNPELMLFDEVTASLDPEMVRGILDILKNLANKNLTMVIVTHEMNFARQVGNKVIFLENGRVVEQGDGATFFTHPTTKRAEAFLESMSF

SEQ ID NO: 16288 - protein, 443 aa, Leuconostoc mesenteroides subsp. mesenteroides ATCC 8293
MAENKITLSRSLSTKDLVVYGIIFMIPVAPIAFYGSFLSPAHGMVALAYLIGMIAMLFTGFSYASMASEFPYSGSVYTYVQKGTNPVLGFLSGWGITLDYILIPVITYLISASFGQSLLPAVPFWVWILGIAIFNTVINLLGIKVVSKFSWLLFGLQGVVLIAFIVGTIVALANGTVSFNVSSFYNASHFDLSGVVQATGIVIVSYLGFDAISTLSEEANDPTKSIGKAIVLSIILIGSLFVIVTFFAGFVAPNYSELNPDTAFLTILGKVGGSWLVHLAEFTLVLSFGLAGGQEGQTAVSRILYSMGRDGILPKRLSYLHPRYNTPWVAIILVGIVSVALSLSLSLTTVSNLISFGALFGFLSLNIAVIWHFYIKRPDKNIESFVKYLVSPFIGFSVSLWIFLSLALEAKLTGLFWLIIGLVILVYKTSIFKKPVPQFDFSE

SEQ ID NO: 16289 - protein, 443 aa, Leuconostoc mesenteroides subsp. mesenteroides ATCC 8293
MTQQYDYDVLYLGSGHGTFDGAVPLAQSGVKVGIIEKDLIGGTCPNYGCNAKITLDAPVTLLRESERFSGVVAGNLKINWKESVAHKQEVIDELPGMIGGLIKSSGIDIIQGSGVFQDNHTILVDGQPKTADKIVISTGLRPHRLDIPGSELAHDSREFMDLTELPDKIVIIGSGYISMEFVTIANAAGSDVTVLMHGDKALKEFYQPYVNKVIDDLKERGVKFVKNAKVSSFEKSGDQVIVNYGDDQSLSVGWVLDATGRIPNTDNLGLSEIGVNYNEKGVIVNEYLQTNVDNIYASGDVIDKTQPKLTPTAIFESTYLFKRFSGQSREPITYPVIPSVVFTSPRIAKVGVAVEEAKENNYQIEENNLVGDWYRKVNKETISENTLIFDDEHRLLGATEVSEQAENVINTLLPAVEFKFNKEEIARLIHLFPSISASTWDLL

SEQ ID NO: 16290 - protein, 448 aa, Leuconostoc mesenteroides subsp. mesenteroides ATCC 8293
MARKTFTKEEIKQIVADENVEFIRVTFTDVLGAIKNVEVPTSQLDKVLDNDLMFDGSSIEGFVRINESDMYLYPDLSTFMIFPWATDGHGGKVARLIADIYTADREPFAGDPRHALRTVLTEAREAGFTSFNVGTEPEFFLFKLDEKGNPTTELNDKGGYFDLAPLDMGENVRREIVLTLEKMGFEIEAAHHEVAEGQHEVDFKYASALEAADNIQTFKLVVKTIARKNGYFATFMPKPVAGINGSGMHTNMSLFTKEGNAFEDVSDEMGLSKAAYNFLGGVLEHATAFTALANPTVNSYKRLTPGFEAPVYVAWSASNRSPMVRVPASRGQSTRLELRSVDPTANPYTSLAAILASGLDGIKRELEPLASVDKNIYLMDEIERERAGITDLPDTLLAAVRELAADDVVRAAIGEHIADKFIEAKKIEYTSYRQYVSQWETDSYLEKY

SEQ ID NO: 16291 - protein, 445 aa, Leuconostoc mesenteroides subsp. mesenteroides ATCC 8293
MIEAFEKSQEPWADVEKYVGRYAGMDFSPDIVDHAKGTYLFTESGEKILDFTSGQMSSTLGHSNPEIVTTLQQTVQRLDHLYSGMLSRPNINLSKNIASKTGENLKKVIPLSTGSEVNEAALRMAKLVTGKFEVVSFNKSWHGVTQASAGATYASARKSGAPTSPGQLSIPTPYTYRPNFFNSEGEYDWHKELDYGFEMVDAQSVGSLAACIVEPIVSGGGILVPPKGYLAALKEKCRERGMLLIFDEAQTSLGRTGEWFAYQYDDVEPDILTLSKTLGSGLPLAALVTTDKIEKKAHEKGFLFYTSHVNDPLVAAVGCTVMNIIERDNLCQVTKEKGNYLHDGLQKLVDEYDIVGDARGRGLLQGLEIIKSKSNKERSEFIGDEITKRCYKLGLHMNIVNLPGMGGVFRIAPPLTVSYEELDSGLAILEQSIKSVQNDINLGNL

SEQ ID NO: 16292 - protein, 302 aa, Leuconostoc mesenteroides subsp. mesenteroides ATCC 8293
MSHNQKESSKALKLGIGTNKVGGHNLFEGLQDEDGFDIVREALDSKVQMIDTAYMYGLGRSEEIIGEVLKHYPRSSFEIATKAAQDPDNDLKINNTPTFLKKAVDDALARLQTDYIDIFYIHFPDENTPKDEAVAALNDLKKSGKIRAVGVSNFSLEQIKEANKNGQVDYVEDAYSLVHREAENKLWPYLQENHIGFVPYFPLASGLLTGKYSLADADKFDQFTKEQFETIISALKLVEKISENHNASISQTILAWYIANPSISAVIPGARNASQVTNNVATLNIDLTETEYQQIDTAFENF

SEQ ID NO: 16293 - protein, 469 aa, Leuconostoc mesenteroides subsp. mesenteroides ATCC 8293
  misc_feature (452)..(468): Xaa can be any naturally occurring amino acid
MSQQKNATMNADGTIRGLKKKHVQMIAIGGTIGTGLFLGAGNSIAKTGPSILIVYAVLGAFFFMMMRGIGEMLYADPSQHTFVSFISKYVGAGAGYFAGWSYWIGLLFVAMAELTAVSTYVKFWFPSWKTWIIQILFLFVLTMINLIAVRVFGETEYWFAMIKIIAIVAMIVTGLILIFTGFKAPASGGHTVASFSNVFSNFSLFPNGASMFFAAFPMVFFAFQGMEFVGITTAETENPREVLPKAINTIIIRILIFYLGAMIIIMSIINWHVIAKTPESSPFVMVFQLAGFKAAATIINFVVLTSAASALNSAIYSAGRHFYQLAEESDSKFMINFREISSNGVPAKAIIFTAILVLISPVINSIPQITSAFGLITSISSNMYIIVYAMTMYAHRKFRESTNFMPDGFLMPGYKWTSPLTLLFFVSIYASLFFQADSRVAAIGAILFTIVXXXXXXXXXXXXXXXXXQ

SEQ ID NO: 16294 - protein, 444 aa, Leuconostoc mesenteroides subsp. mesenteroides ATCC 8293
MSKNKEILEEEKIHLANATRVKYFDIVIDHGKGAIITDADGHEYIDLLASASATNTGHSHPKVVEAITSQAQKLIQYTPAYFANTVTAKLADRLVNVAPGNFQKQVAFGNSGSDANDAIIKFARGYTGRQYVVSFTGAYHGSTYGSLSISGVSLNMTRKIGPLLPNTVKVPFPDQTQRIAGESDNDFSERLFKQFKLPFETYLPADEVALVIIEPIQGDGGIIKAPQHYVELVYEFTREHGIVFAVDEVNQGLGRTGKMWSIDHFGIAPDLMSVGKSIASGLPLSAVIGRKEIMDSLQAPANVYTTAGNPVTAAAALATLDVIEEENLVARSRQLGELAKAFFESAAKRYAFIGDVRLYGLNGGIDIINDHGEPDNEATNKLIYRIFELGAIMISLRGNTLRFQPPLVIQEEELQRAFEILEKAFSDLASGKIALPKTDNHIGW

SEQ ID NO: 16295 - protein, 488 aa, Leuconostoc mesenteroides subsp. mesenteroides ATCC 8293
  misc_feature (202)..(219): Xaa can be any naturally occurring amino acid
MADPFGFLKYERVDNPYRKITERIKDFNYMAEPLAFDQRVEQAARCMNCGVPYCHIGALYGNKSKQMSGCPNDNLIPEWNDLLYRKELHQAWLRLAKTNPIPEFTGKVCPAPCEVSCNEFLNGAGVTIKDNEDFIVEYAFAHGWVVPEGLPEQRTGKKIAVIGSGPAGITAAWRLNQLGHEVTIFEKDERLGGLLMYAFQTXXXXXXXXXXXXXXXXXXMSEVGIKFKVNTTIGEDITKEQLDADFDKVIVATGASVARDVDVPGRDLKGIDFALPFLSQTTKNVLKNGTTTFEKTLSNQQVIVIGSGDTATDCIATAIRLGAENVTQFDYHTEKPTDRTTPWPEYPWQKQISYGQAEAMDTVNQELIPYQTQTVEFLGNSFGEVTGVRTVLIDANKQVISNSEKDYSADLVLVAVGFTGLNTKILNDLDITRLNVMGTTNQENYMVAGDANTGANLVITAIHDARLVAELVDAKLQSFADRFSVKVN

SEQ ID NO: 16296 - protein, 436 aa, Leuconostoc mesenteroides subsp. mesenteroides ATCC 8293
GSSATIKWTGVSVLLAYAIAGLVLYLVMRALGEMLYVDPSVGSFANYATKYIHPVAGYLTVWANVFQWLTVGVSETIAVGMYLDYWFPHIPGWVTGVVVLAMLTAANLVTVKAYGEMETWFSLIKVVTIIFMIILGLLVIVLGFGNHWQPIGFSNLWTHGPFFAGGVKGFFFALSIVITSYQAIEIIGITAGEADNPQVAIVKSIKSIVARILIFYIGAIFVIITIYPWNELDQVGSPFVETFSRVGITAAAGIINFVMMTAAMSALNSGIFSSSRMLYTLAIGKELSPKFLKLSKHRVPTLPVLAISGGILLGIILNAVLPLFWHGSSSIFVLVYSASTLPGMVPWFVILWSQIKFRKENASQMVNHPFKMPFAPYTNYFAILMLLVTLVFMVFNPDTRVPLFIGLGFLVIMSIVFFATRKSHRRNSEVSSSKTL

SEQ ID NO: 16297 - protein, 479 aa, Leuconostoc mesenteroides subsp. mesenteroides ATCC 8293
MENWLTKRARLTPNRIAVQYKNKQLTFQEVADQAHNMAKKIAKVTQDNSRVALIMNNTLTGYLVIMALQQLGKTIVFINWRLSVAEINYQLADAGVTTVLTDDDYMSELSIDKQIKFSDLSTQQKITPIETFPEDFVTSIMYTSGTTSKAKGVMQTYQNHFYSAMGSALNLGLTSDDSWLAVVPIFHISGFSIIMRGLIYGMRVVLQSKFDAHQINELLIEQSITAISVVPVMLKQLVADLPKGAHYNNHFRSMLLGGGPTDLVTLKQAQLHQIPVIQSYGMTETASQIVALDAKDAVQKVGSVGKPLFPVRLKIADHAGKVSQQGNIWIQSPTLTTGYLNQPDKLAEHMIDGWFNTEDYGYLDAEGYLFVQGREGDMINSGGENIFPNEVEDIYAEYPGLNKIVVVGVSDQKWGSVPIAIVLGEELKKDALIQFGRERIAHYKIPKRFYLAQSWHTTASGKTQRKPFLAELERLKELI

SEQ ID NO: 16298 - protein, 250 aa, Leuconostoc mesenteroides subsp. mesenteroides ATCC 8293
MKLYVVRHGQTIFNTLNKVQGWADTPLTKKGEKDGQEAGKRLKNVAFDVAFSSDTSRAMHTAEYILAENIHEHTKLQITPEWREYFFGSFEGGSNDVMWGAVAKEFGVNKGTPDAIAAEVQDMTAIMNKIYEVDPEHLGENATRFWQRIDAALEKLLMTQKANANVLLVTHGQLIGNLAQHYGHFLGAERPKNGAVAVFNLDDDGLQVELFNDVTPYFDKIWLIFYIFLRIKFSQTNRLMIMFSLLFQKT

SEQ ID NO: 16299 - protein, 304 aa, Leuconostoc mesenteroides subsp. mesenteroides ATCC 8293
MLIKNIHQLIGQTPLIELQIPVPNQSRIFAKLEMFNPGGSIKDRLGQFLISDAWQRNLINQNSTIIEPTAGNTGIGLALAAQQYKLPTILVVPEKFSAEKQQLMKALGATIINTPSNEGIKGAISKAKSIAAEIENSYLPMQFANPANPETYYKTLAPEIVTDLKNEKIDAFVAGAGSGGTFAGIAKYLSEYDATIKNIVVEPEGSILNGGPAHAHRTEGIGVEFVPPFFESIHIDKTLTISDDNAFQQVRYAAENLGLFIGSSSGAALAASLQMAETLPPQSNIVTIFPDSSERYMSTNIYGN

SEQ ID NO: 16300 - protein, 247 aa, Saccharomyces cerevisiae
ARTFFVGGNFKLNGSKQSIKEIVERLNTASIPENVEVVICPPATYLDYSVSLVKKPQVTVGAQNAYLKASGAFTGENSVDQIKDVGAKWVILGHSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 16301 - protein, 348 aa, Pichia stipitis
MSIPTTQKAVIFETNGGPLLYKDIPVPKPKPNELLINVKYSGVCHTDLHAWKGDWPLDTKLPLVGGHEGAGVVVALGENVTGWEIGDYAGIKWINGSCLQCEYCVTAHESNCPDADLSGYTHDGSFQQYATADAIQAARIPKGTDLALIAPILCAGITVYKALKTAQLQAGQWVAVSGAAGGLGSLAIQYAKAMGYRVVGIDGGADKGEFAKSLGAEVFVDFLSSKDVVADVLKATNGGAHGVINVSVSERAMQQSVDYVRPTGTVVLVGLPAGAKVSASVFSSVVRTIQIKGSYVGNRADSAEAIDFFTRGLIKCPIKIVGLSELASVYELMEQGKILGRYVVDTSK

SEQ ID NO: 16302 - protein, 324 aa, Stellaria longipes
MENFPIINMENIERKNTRDMIKDACENWGFFECVNHGIPHSLLDKMEKMEKLTKDHVRECLEERFKEMVASKGLEGVESEVTDLDWESIFFLKHLPVSSISELPDLDEEYREVMIDFSKRKEKKAETKKDKKCENKGKEKSYLKNTFYGSKRPNFGTSVSNYPPLPKPDLIKGLSAHTDAGGIKLLSEDDKVSGLELLKDSDWIDVPPMRHSIVVNLGDELEVITNGKYWSVMHRVQIDTNITRMSTASFYVPGNDRVIAPAEALPKEFKDDEVYPKFVFKSYMKAYAKLIRQSGLKFEAKEPRFEAMKAHRIGSSCNSHLEHD

SEQ ID NO: 16303 - protein, 478 aa, Aspergillus oryzae
ATPADWRSQSIYFLLTDRFARTDGSTTATCNTADQKYCGGTWQGIIDKLDYIQGMGFTAIWITPVTAQLPQDCAYGDAYTGYWQTDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGLPIIYAGQEQHYAGGNDPANREATWLSGYPTDSELYKLIASANAIRNYAISKDTGFVTYKNPYIKDDTTIAMRKGTDGSQIVTILSNKGASGDSYTLSLSGASYTAGQQLTEVIGCTTVTVGSDGNVPVPMAGGLPRVLYPTEKLAGSKICSDSS

SEQ ID NO: 16304 - protein, 416 aa, Saccharomyces cerevisiae
  misc_feature (1)..(1): Xaa can be any naturally occurring amino acid
XSLSSKLSVQDLDLKDKRVFIRVDFNVPLDGKKITSNQRIVAALPTIKYVLEHHPRYVVLASHLGRPNGERNEKYSLAPVAKELQSLLGKDVTFLNDCVGPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAVGPEIAKLMEKAKAKGVEVVLPVDFIIADAFSASANTKTVTDKEGIPAGWQGLDNGPESRKLFAATVAKATVILWNGPPGVFEFEKFAAGTKALLDEVVKSSAAGNTVIIGGGDTATVAKKYGVTDKISHVSTGGGASLELLEGKELPGVAFLSEKK

SEQ ID NO: 16305 - protein, 241 aa, Saccharomyces cerevisiae
PKLVLVRHGQSEWNEKNLFTGWVDVKLSAKGQQEAARAGELLKEKGVNVLVDYTSKLSRAIQTANIALEKADRLWIPVNRSWRLNERHYGDLQGKDKAQTLKKFGEEKFNTYRRSFDVPPPPIDASSPFSQKGDERYKYVDPNVLPETESLALVIDRLLPYWQDVIAKLVGKTSMIAAHGNSLRGLVKHLEGISDADIAKLNIPPGTILVFELDENLKPSKPSYYLDPEAAGAAVANQKKG

SEQ ID NO: 16306 - protein, 436 aa, Photorhabdus temperata
MHLQNTWREEYIKCQTLYARHPLFTKIKVRLSMLAVKKSSKLDNVCYDIRGPVLKEAKRLEEEGNKVLKLNIGNPAPFGFEAPDEILVDVIRNLPTAQGYSDSKGLYSARKAIMQHYQARNMLDVSVEDIYIGNGVSELIVQAMQALLNTGDEMLVPAPDYPLWTAAVSLSSGKAVHYMCDEGSDWFPDLDDIRNKITPRTRGIVIINPNNPTGAVYSKALLLEIVEIARQHNLIIFADEIYDKILYDDAEHHSIAALAPDLLTVTFNGLSKTYRVAGFRQGWMVLNGPKKHAKSYIEGLEMLASMRLCANVPMQHAIQTALGGYQSISEFILPGGRLYEQRNRAWELINQIPGVSCVKPKGALYMFPKIDAKRFNVHDDQKMVLDLLLQEKVLLVQGTAFNWPEPDHFRIVTLPRLDELEMAIQKFARFIGKYHQ

SEQ ID NO: 16307 - protein, 443 aa, Arabidopsis thaliana
  misc_feature (312)..(312): Xaa can be any naturally occurring amino acid
MDRISSLPDEILEHILSFLSTKEAALTSSLSTRWKNVFVFVPSLHLDYARQHENPREFIDFVDFVNTLFNRKGNSPIKKLALKIHLKDNQSLQNQTHVQSWIHRVLSRGGVTDLDLFITFKGKFQLVPLLIFKSNTLVKLKLGRGFTIKLCHENVYLPMLKTLCLDTVDFDGDHNVFETLLPRCPLLEELVLEDQRWKQWCGPVSSPSLKRLRIRFFHIPIISLDVPGLVYLELSCIFGSKYANVNLDSLVEARLNHWVEEQELRKLRDGSSHLVPADMMDLITGIRKVKVLHLTSDALELFYFSGQELPMXDNLVYLSIASDKKQGWQILPLLIKNSPNLETLVFKGLEHYTTKQCGDACVCSGILGKSSSCLSSSRVKVLEIWSYQGTSKELKQMGHFLMKLQFLELVKIRAVSNLQVPIDIQYLLKLPRASSNCKIQAIF

SEQ ID NO: 16308 - protein, 489 aa, Oceanobacillus iheyensis HTE831
MREDKFAKEGLTFDDVLLLPAKSEVLPNQVDLSVELTSTLKLKSPFISAGMDTVTEAEMAIAMARQGGFGVIHKNMSIEDQAEQVDKVKRSESGVITNPFFLTPEHQVYDAEHLMGKFRISGVPIVNNIEEQKLVGILTNRDLRFIQDYSISISEVMTSENLVTAPVGTTLQEAEKLLQQYKIEKLPLVDDRNILKGLITIKDIEKVIEFPNSAKDAQGRLIVGAAVGVTGDAMKRIEKLVSVGVDAIVIDTAHGHSQGVLEQLKKVRQAYPDLQIIAGNVATPEGTKALIEAGVSVVKVGIGPGSICTTRVVAGVGVPQITAVHDCALAAAEYGVPVIADGGIKYSGDIVKALAAGAHAVMIGSMFAGVSESPGETEIFQGRQYKVYRGMGSVGAMAAGSKDRYFQSESQNKKLVPEGIEGRVAYKGPLSDTFHQLVGGLRSGMGYCGTKSIEALRNDGKFIRITNAGLRESHPHDVQITKEAPNYTL

SEQ ID NO: 16309 - protein, 343 aa, Oceanobacillus iheyensis HTE831
MTQLDKQYKIKGLSLKNKIVMAPMCQYSVDAKDGIPNDWHFVHYVSRAVGGAGLIIVEMTDVDPDGRITDYDLGLWSDEHVPAYRRIVDEVHRYDAKIGIQIAHAGRKAEDAEPPVAPSAIPVTAESKVPRALTTEEVKQTVKQFQDAAKRAVEAGFDTIEIHGAHGYLIHQFHSPLINKREDRYGEDLSLFGVEVIQAIKEVIPEDMPLLMRISAMEYMDEGYDLNHSVDIAKKYQEAGVDVFHISSGGEGPPGKRKPANHPGYQIRFARTFRQELNVPIIAVGVLEHPKVAEAALGNEDADLIAIGRGMLKDPYWAIHAIEEITGIAVPPKQYERAFPRKK

SEQ ID NO: 16310 - protein, 184 aa, Oceanobacillus iheyensis HTE831
MLQDNIHGDIQDILITEEQIQEKCKELGSIISKEYDGKFPLAIGVLKGAMPFMSDILRYSEIHLEMDFMDVSSYDGGTTSTGEVKILKDLNTKVEGRDLIIVEDIIDSGLTLSYLVDLFKYRKANSIKIVTLLDKPSGRNAAIKADVVGFEVPDEFVVGYGLDYAEKYRNLPYIGILKPEVYGG

SEQ ID NO: 16311 - protein, 308 aa, Oceanobacillus iheyensis HTE831
MRVSDNITGLIGGTPIVKLHNVTDEGSADVYAKVEFMNPGSSVKDRIAIAMIEAAEQGGKLKEGDTIIEPTSGNTGIGLAMVAAAKGYRAVLVMPDTMSQERRNLLRAYGAELVLTPGAEGMKGAIAKAVELQEENDYFMPQQFSNPANPDIHEKTTGKEIVEQMKDGLDGFVSGIGTGGTITGAGKVLKNHFQDIKLYAVEPADSPILSGGSPGPHKIQGIGAGFKPDVLDTAIYDEVLTISNEEAYEAARKVATTNGILGGISSGAAVAAAVKVAKQLGAGKKVLAILPDNGERYLSTPLYQFDKE

SEQ ID NO: 16312 - protein, 457 aa, Oceanobacillus iheyensis HTE831
MAKRKTKFVCQECGYESAKWMGKCPACHQWNTMVEEIDPASVKGRTGYATSTTSAGKPEKITAIESKKEPRITTKMREFNRVLGGGIVLGSLVLIGGDPGIGKSTLLLQISAQLAEKDMSVLYVSGEESTRQTKLRADRLDITTDQLYVLSETNLYDISKQVEEVKPSFVVIDSIQTIFKEEVTSAPGSVSQVRECTMELMKIAKSNGIPIFIVGHVTKEGSIAGPRLLEHMVDAVLYFEGERHHTYRILRGVKNRFGSTHEMGIFEMKEEGLREVMNPSEIFLEERSEGAAGSTVVASMEGTRTVLVEIQALISPTSFGNPRRTATGIDHNRVPLLMAVLEKRVGLMLQNQDAYIKVAGGVKLDEPAIDLALAVSIASSFRDQPTNPNDIFVGEVGLTGEIRRVSRIEQRVQEAAKLGFKRVICPKNNLDGWNYPSGIEVIGVSSVQEALDIGLRH

SEQ ID NO: 16313 - protein, 215 aa, Oceanobacillus iheyensis HTE831
MNLILMGLPGAGKGTQAAKINEKYNIPHISTGDMFRLAIKEGTELGKKAKEFMDQGDLVPDEVTVGIVKERLAMDDCANGFLLDGFPRTTRQAEELQNLLSDLGKSIDYVIHVDVPEEKLVERLTGRRICPTCGTAYHVVYNPPKEEGICDKDGSQLIQRDDDQPETVKNRLAVNIEQTQPLLDFYQDKGYLVKVNGDRDINVVFQDIESILEKK

SEQ ID NO: 16314 - protein, 468 aa, Oceanobacillus iheyensis HTE831
MKQQIGVIGLAVMGKNIALNMESKGFSVAVFNRSYEKTENFLANEASGKKFIGAKTIEEFVDSLEKPRKIMLMVKAGPATDATIESLKPHLDKGDILIDGGNTLYEDTIRRNKELDESGIHFIGTGVSGGEEGALNGPSIMPGGQAEAYKLVAPIFEAISAKVDKDPCVTYIGPNGAGHFVKMVHNGIEYGDMQLIAEAYDLMKNVLGLDAKELHNVFKEWNDGELDSYLIEITADIFTKVDEETGKPLVEVILDKAGQKGTGKWTSKNALDLGVPLPLITESVFARFISSLKDERVRASKELSGPTNAMLGESKEELIEAIRQALYMSKIVSYAQGFAQMRAASDEYDWNLSYGDIAMIWRGGCIIRAKFLQKIKDAYDRDSQLPNLMLDPYFKEIVEGYQSSLRKVVSLAVAHGIAVPTFSSAIAYYDSYRSEDLPANLIQAQRDYFGAHTYERKDKDGIFHSQWF

SEQ ID NO: 16315 - protein, 157 aa, Oceanobacillus iheyensis HTE831
MSIYEYQVEKSNGEEISLSQYQDNVLLIVNTATKCGFANQFEGLEELHQKYQDEGLRVLGFPSNQFNEQEPVDDENMEEACKVNFGVTFPLFKKIDVKGPNAAPLFKYLTEEQKGLLGSNVKWNFTKFLVDRNGNVVKRFAPKDKPAKIEDDIKALL

SEQ ID NO: 16316 - protein, 487 aa, Oceanobacillus iheyensis HTE831
MNYIDDSLALHTDLYQINMAETYWNDDVHNRKAVFDLYFRSLPFGNGYGVYAGLERIIEYMNNFRFTDADLTYLKEIGYQDDFIEYLKSIRFTGTIKSMKEGEIVFANEPILRVEASLAEAQLLETALLNIVNYQTLIATKASRIRQLVGDQLVMEFGTRRAQEMDAAVWGTRAAFIGGFSATSNVRAGKLFGIPVSGTHAHSMIQAYRDEYKAFMKYAERHKDCVFLVDTYDTLRSGVPNAIKAAKELGDSINFQGIRLDSGDLAYLSKEARRMLDEAGFPDAKIYASNDLDEYTIASLLAQGAKIDVWGIGTKLITAYDQPALGAVYKLVSIEDENGDMKDTIKLSGNPEKMTTPAMKKVYRIINKENQHSEGDYLTLENEYPNEQEEVMLFHPVHTYYKKFVSNFEAVNLHHDIFIDGQLVYECPDLAEIQLFTENQLNLFWDEYKRTNYPAEYPVDLSEALWNNKMNHIERVKQAVKDKINKR

SEQ ID NO: 16317 - protein, 387 aa, Oceanobacillus iheyensis HTE831
MKQSNRLKQLPPQFFASLVQKVNQAISEGRDVINLGQGNPDQPTPAHIIKALQSAVEDPITHKYSPFRGTDDFRKAAATFYKREYQVDLDPDTEIAVLFGSKIGLVELPLALMNPNEWMMLPNPGYPDYLSSIPLADIQYDTMPLLEENNFLPNYEQLTLSQKERTKLLYLNYPNNPTGATANNAFFNETVALGKNHDIGIVHDFAYGAIGFNEEKPISFLQTKGAKEVGIELYTLSKTYNMAGWRIGFAAGNKEMIEAINILQDHLFVSVFPAIQRAASEALLSDQSSVQDLVTLYQKRRDALITECKRIGWDINAPQGSFFAWLPVPNGFTSETFADYLLNEVDVAVAAGNGFGTFGEGYIRVGLLVDEQRIVEAIKRIEGLKLF

SEQ ID NO: 16318 - protein, 311 aa, Oceanobacillus iheyensis HTE831
MAQNVTLGKSNVVINPIGLGANAVGGHNIYPNLDEEVGKSLIQTGIENGLNFIDTAYGYGNGRSEELIGQALKRTGNRSDVVLATKAAQTVIDGEAGFNNSPSFLKQAVDDSLKRLQTDYIDLFYIHFPDESTPKDEAVGALKELKDAGKIRSIGISNFSPEQVKEANKDGYVDVLQGHYNLLKRDAETNYFPYTLDNNITFIPYFPFASGILAGKYSVNSTFEDFRSNMPHYQGDQFKQILAKVDQLKQLASDKNTEVAHIVLAWYLKHDAIDAVIPGAKRPEQVINNLKALNVTLTDNEFRMISELFAK

SEQ ID NO: 16319 - protein, 490 aa, Oceanobacillus iheyensis HTE831
MKLYENLNKNFISGEWRDGQGETTYEVKNPYNDEVLQEIKMASKEDIDEAYKSAEQAKKKWAKFNPFERSSIMEKAVQIIDARREEFVNHLIREGGSSHLKANVEIDFVIAITREAASFPLRMSGEIVPSLIPGKENRIYRSPLGVVGVIGPFNFPMYLAMRSVAPALAVGNGVVLKPDDQTAVTGGILLAKVFEEAGLPKGVFNVVVPNIEDIGDAFVEHPIPRLISFTGSTPVGRHIGEICGRNIKKVALELGGNNPLVVLEDAKVENAVNSALFGKFMHNGQICMAINRIIVHKDIYEEFVEKFVEKAKKIKVGNPSEKDNLIGPLINRQAIDRILEQIESAKEQGAEVVLEGKVEGNVMHPYILTGSNDVATAQNEMFGPVATIISAESDEEAIRIANDTPFGLSGAVHAGSPERGVEVAKQITSGMVHVNDQSVNDEPLIAFGGEKASGLGRFGGKWSLEEFTTVQWISVQTEERENPFHTDYLE

SEQ ID NO: 16320 - protein, 449 aa, Oceanobacillus iheyensis HTE831
MEDLFELDKKHFIHPTSSIIQQQTDGAKSIMAKGDGIYVTDTNNKEYIDAVSSLWNVNIGHGRTELAEVASEQMKKLAFSSAFSTFSHEPAIRLAKKISELTPQGLNAVFFTSGGSESNDSAVKLSRHYWKIQNKASKRKIISLKRGYHGVAAASTSITGIPEFWDMAGHLMNDFLHAETPYRSTTEKAIESLQSMIEQETADTIAAIFVEPVQGAGGVLIPPADYLEAVREICDFYNILFIADEVITGFGRTGTMFGMENWNVVPDAMTFAKGVTSGYIPMGGVVVSDHIHTVLKEKSKGTLFHGFTYSGHPTAAAVALKNIEIIEKESLVTNAKERGLELQNGFQKIKKESSIVGEVRAIGLIGAIELMQDSATGQPFTPDVGVTPAVINALHERGVISRGVTYDGSNILCFAPPLIITKQEVNELISRISDAILFVQHQLGVSQNY

SEQ ID NO: 16321 - protein, 484 aa, Oceanobacillus iheyensis HTE831
MAELKAITTYQMYINGEFVNASNNETLEVTNPATEEIVSTVPKASLEDTRRAIDGSAKAQKDWANLPSSKRASYLFAISKEIRSNIDEYAKIISEEMGKPLDQAVVEVSVTADYFEYIAGWARKYEGEIVPSDREKENILVFKQPIGVVAGILPWNFPFFLIARKAAPAILTGNTIVLKPSSVSPNNALAFAKILDKVGLPKGVINIVTGAGSIVGEELSKNEKIGMISLTGSTEAGSRVMEKASKNITKVSLELGGKAPSIVMEDADIDLAVKSVLDSRIINTGQVCNCTERVYVHEDVADEFIEKITKAMSNVSYGNPLGNEQIDMGPLSNEAGLKNVEDMVKRAVENGATVLTGGNRVNTEAGYYYEPTVLSNVDNSFEIMKEEVFGPVLPIATFTSLDEAIELANDCQYGLTSAIFTNNVNYMMRASNELEFGETYVNRESFEAIQGFHAGWKKSGIGGADGKHGLGEFLQTHVVYIQYK

SEQ ID NO: 16322 - protein, 426 aa, Oceanobacillus iheyensis HTE831
MTTIVDKARNDMAVFEEMESAVRSYSRGWPVVFEKAKGYKLWDKNGNEYIDFFAGAGALNYGHNPSEMQKVMIDYIQNDGVIHSLDMATAPRKKFLESFNEIILKPRNMDYKVMFPGPTGTNTVESALKIARKVTGRDTVIGFTNAFHGMTIGSLSVTGNSFKRNGAGIPLNHAISMPFDQYVDEQDSIAYIERFLEDSGSGVALPAAFILETVQGEGGINAARLEWVKKIEEICRKWDILLIIDDVQAGCGRTGTFFSFEEAGINPDIVCLSKSIGGVGLPMAITLIKPEFDQWGPGEHNGTFRGNNLAFLAATEALNNWKTDAFSQNIKKMSSLFQERMKRIVEKFPELNADLRGRGLMLGIGVHVDGLAGEICAEAFSRGLILETSGAKDEVVKFLPPLIIDEDGIEKGMDILEESIQAALEK

SEQ ID NO: 16323 - protein, 262 aa, Oceanobacillus iheyensis HTE831
MGKSKLDAVLKEKTQAKKPIFVPYIMAGDGGIDNLNKRIQFLEEAGASAVELGIPFSDPVADGPVIQDAGQRALANKTTIGSVLEALESEKSQRNIPVVLMTYINPVWKYGFEQFARDCSQAGVDGIIIPDIPMEEEDDVASSLTQHDIAFIRLAAMTSTEDRLERIAKRSEGFLYAVSVTGTTGERAQHENDAFHFLEKLKQISHVPVLAGFGISTAERARELSAACDGVVVGSKIVQLFEQGDEDGIHSLIRESIGEKVI

SEQ ID NO: 16324 - protein, 215 aa, Oceanobacillus iheyensis HTE831
MTKSISIEHLQFDEKGLIPAIVQDHQSGQVLTLAYMNSDSITKTIETNETWFYSRKRQELWNKGATSGNKQTVKQISFDCDADAVLVLVDAQGPACHTGEESCFYEDLYKNDVALLQIIPQVSAKIKERHEHPVEGAYTSYLFEKGVDKILKKIGEEATEVVIAAKNEDKQELTSELSDLLYHSLVLMEQQGVTLEDIKKELYKRHVEKEGQQRE

SEQ ID NO: 16325 - protein, 256 aa, Oceanobacillus iheyensis HTE831
MTEPIVKFQDIHKSFGDVKVLKGINLDIHPAEKVAVIGPSGSGKTTIIRMLMTLEEPTDGDIIVGGRNLWKMEKKGQLVPANENHLREIRGDIGMVFQHFNLFPHMTILENCMTAPINVKKEPKEEVKKRSIEMLKRVGLGDKVDNYPSQLSGGQKQRVAMARALVMRPKIMLFDEVTSALDPELVGEVLNVIRDIAKNDDMAMVLVTHEMDFALDIADKVLFLDEGVIAEQGTASEVIEHSENDRLQEFLHRFRG

SEQ ID NO: 16326 - protein, 158 aa, Oceanobacillus iheyensis HTE831
MSVHDFTVTTIEGEEKRLSDYKGKVILIVNTASQCGFTPQLEDLQKLYKQYQDNDFEILGFPCNQFGNQDPGASEEISAFCQKNYGVTFQMFKKVDVKGKEAHPLYKHLTEEKKGILGGQIKWNFTKFLIDQNGNVIERFSPQKNPNTLNKDIEVLLR

SEQ ID NO: 16327 - protein, 298 aa, Oceanobacillus iheyensis HTE831
MLSANTTTIGFIGTGVMGKSMAKNLLNAGYSIRIFTRTKSKADDLLNIGAKWDKDIPTLAKQCDVIITMVGYPSDVEEVYLGEQGLIKNCNKGSYLIDMTTSKPSLAEEIFSVSEKHGLHVLDAPVSGGDIGAESGTLAIMTGGERSVYDYVLPIFQVLGENISYQGPAGTGQHTKMSNQIAIASNMIGVCESLLYAKKAGLDPKKVLATISTGAAASFSLSKLGARMLENDFNPGFYVKHFIKDMRIALESSQAFGLDTPGLKLAIDLYEQLSDMGEQDSGTQALIKALAYRSEMTL

SEQ ID NO: 16328 - protein, 509 aa, Oceanobacillus iheyensis HTE831
MYIVTAEEMYGIDRETMDSIGVDGKILMENAGREVSREIKKRITKKDVILVLVGGGNNGGDGFVVARTLHVEGYNVKVVQVVGDEKIKGDADYHKRLFLRCNGLIIYLDSLGDEVKYMIKDSAVVVDAMVGIGVKGKLKEPILSIAQNINESNKQVIAIDIPSGLTAEEHHSEFYAVQADTTIVIGALKQSLFLQNTASFYGDWVMASIGFPSEVIRRYTDKQWWDQEAFQSFFPKRKENSHKGMHGRGLVIGGNHLMPGSVMMTTKAAVRSGAGLTTMGTSKAVISMMASSCNESMYIPIQEQDGYLSDASEIDYSAYDAVAIGMGIGREKVTHQLIQNAITAVKGILLIDADGLYHTKEQLHVLPSRQTPTILTPHPGEFASLLDVSISEILQKPFSYSKEFAVKYGVYLVLKGKFTIITAPTGRQVVESGGNPGLAKGGGGDVLSGIILAMVMQDQPIFEAICNACYLHSASADNLVKEKHSVYDLTATDIIEGIPNALRTLTSSE

SEQ ID NO: 16329 - protein, 434 aa, Oceanobacillus iheyensis HTE831
MNKYFQLDKLGTNIRREFVAGLTTFLAMAYILFVNPSMLSETGMDADAVFAATAIAAAIGTLVMGLVAKYPVALAPGMGLNAFFTYTVVIGFGIPWETALAGVLASGLIFIILTLSGIREKVINAIPSSLKLAVGSGIGLFIAFIGLQNANLVQADPSTLLALGDLTSPTVMLAIFGLVVSVILLAYGVKAGIFYGMIITAIAGMLFGLIQPPTGINDIVSGVPSLAPTFGQAILHFGEIFTLEMLVVILTFLFVDFFDTAGTLVAVASKAGIMKDNKLPRAGKALFSDASATVVGAVVGTSTTTAYVESTTGVSVGGRSGLTSVFTALFFLLALFFSPLLGVVTSEVTAPALIIVGVLMVSALKDIPWDEFEIAVPAFFTVLMMPLTYSIATGIAIGFIFYPITMLVKGRGKEIHPIMYGLFVIFILYFIFLN

SEQ ID NO: 16330 - protein, 510 aa, Oceanobacillus iheyensis HTE831
MSKRALISVSDKTNIIEFAKGLKESGFEILSTGGTLRSIAEAGIDVTPVDEVTGFPEMLDGRVKTLHPMIHGGLLGKRSNHEHLSQMEEHGIRSIDLVAVNLYPFKETVQKPDVSHQDIIENIDIGGPSMLRSAAKNFEDVLVVTGPTDYNRVLAAITSETDTYEFRQQLAAKVFRHTASYDAMIANYFLSQTEEQYPESYTVTYEKVQDLRYGENPHQQAAFYKEPIQSRPTLATAKQLHGKELSYNNIQDTNAAIEIVKEFAEPAAVAVKHMNPCGIGIGESISTAFERAYQADPTSIFGGIVACNRPVDAATAEQLSQIFLEIVVAPSFESQALEILTQKKNIRLLELDVTSDNKQSNRLTTVDGGALIQAYDAKEVSEADLEVVTNKQPTEQEINDMLFAWKAVKHVKSNAIVLAKDSQTIGVGAGQMNRIGAAEIAIKQAGDKSEGAVLASDAFFPMPDTVEAAAKAGIKAIIQPGGSKRDQDSVDVCNQFGIAMVYTKVRHFKH

SEQ ID NO: 16331 - protein, 479 aa, Oceanobacillus iheyensis HTE831
MENVTIKVPNNFMLGAAVSAWQTEGWIGKRDSQDSYLDIWYKNNKHVWHNGYGPAGATNFYQRYEEDIDYMKEIGLTHFRTSINWSRFLIDYENAIVDEEYAAYVDDVIEKLIQNGVEPMICLEHYEVPAVLFEKYGGWESKHVVELFVQYANKVFERYGDKVKHWFTFNEPIVVQTRVYLDAIRWPFEQSTKKWMQWNYNKVLATAKVVNLFKDLQLKDKNGAKIGVILNPEVTYARSTATHDQQAAKMYDLFFNRIFLDPSIKGEYPKELFDVMKKHGITFDFTEEELNLIKDNTVDYVGLNLYFPHRVKARTAGWNEQTPFHPAYYYEIFELPGKKMNPYRGWEIYPQIMYDMGIRMKEEYDNIEWFIAENGMGVENEKRFKDASNMIQDDYRIEFIREHLKWLLKAVEEGVNCKGYMLWAFTDNVSPMNAFKNRYGLVEIDLEDNRNRHLKKSAYWYKQLIESRKFEAENDENYK

SEQ ID NO: 16332 - protein, 346 aa, Oceanobacillus iheyensis HTE831
MYTAKARAVDGPHQPFHATEIKRRNLDSHDVLIEIKYSGICHSDIHTAHGEWGEVNYPLVPGHEIAGVVSDVGPEVTKYKVGDRVGVGCMVDSCGECENCRRGEEQYCHQGNVQTYGGVDKYGEPTQGGYSTHIVVTEDFVLRIPDNIELDVAAPLLCAGITTYSPLNHWNAGPGKKVAVVGMGGLGHMAVKIAHAMGAEVTVLSRTLNKKEDGLEFGAENYYATSEKETFETLAGSFDLIINTVSAKLDMDAYFSLLNLDGSLVNVGAPAEPLSVNVFSLIGHRRSFAGSLIGGIRETQEMLDFCAEHNIVPKIEVISADQIDEAYTRVLDSDVKYRFVIDVSTI

SEQ ID NO: 16333 - protein, 299 aa, Oceanobacillus iheyensis HTE831
MSKIGFIGLGNMGLPMSIGLMNSGYEVIGFDVNEERSLLFKKSGGNIALSSADLVAESDVILTSLPSNKAVEAVYLNKGGLLDHCNSSQVVIDTSTVAPELNQQLEASLSERSIPFLAAPVSGGVVGAENQTLTVMVGGKEETFQKVKDILNVIGGNVFHVGEQIDKGTTVKLINNLLIGFYTAGVSEALQIANQKDIDLNDLFSMMNVSYGQSRIYERNYKTFIEPNDFNPGFALKLLRKDLEFAMEVADNNQLDLPISKSLLDLYRNLEHQGYGDQDMAVLYKYLKDTIDQNKEATT

SEQ ID NO: 16334 - protein, 447 aa, Oceanobacillus iheyensis HTE831
MSKKIIIVGGVGGGATVAAQIRRTNKTAEILVLERNGYVSFANCGMPYYLGGTITDRQKLIYPEEKFAQKYDLTVQTHANVTKINREQKSVVYEKYKTEHKADYDILILSPGASPVLPDIAGLQQSNTFPLRTIEDMDNIEQFIQSNNPQSAAIIGGGFIGLEMAESLCHRGFSCSLVDRSEHVLKRIDKEMAIHIDEHLQEKGIALYVNDGLKSFSDNGTTLHLSSDKTIQADMTIMAIGIKPNTELAIDAGLEIGETGGIKVNQYMQTTDPTIFALGDAVEVTDFITREPAHIALAWPAHRQAFIISSFLSGNPISDDGIIGSSILRVFDLTVAATGQNKQTLIDNEIAFEETIMKGYSHAAYYPGSKELWMQIVYDKNTGQLFGGSVIGFDGADKRMAVLATAIKGKLTVADLASLELGYSPIYSGAKDPLNILGYKAMEQLED

SEQ ID NO: 16335 - protein, 497 aa, Oceanobacillus iheyensis HTE831
MTALTLETDVLKNFIDGKWVDVNNTTAVTNPANGERIVQVPLSDQSHVEEAVQAAIKAQKEWALVPAPQRAEVLYRVGMIMKDKKERLSRLLTMENGKVLEEARGEVQEGIDMAFYMAGEGRRLFGQTTPAELKDKFAMSQRVPVGVVGIITPWNFPIAIATWKSFPAIVAGNAVVWKPATETPIMAYELAKIFEEAGLPSGVINVVFGKGSEVGDSMVQHKDIRVISFTGSNDTGRNIASDCGKQLKKVSLEMGGKNAVIVMDDADLDLAVEGILWSAFGTSGQRCTACSRVIVHHKVKKTLEERLLAAMDHLTIGNGLEDGIKVGPIINEAGLNKIKKYIEVGKQEGATLLAGGTEWETNNPGYYFTPTLFTDAKPDMRIAQEEIFGPVVSLIEVSSFEEAIEVNNQVTFGLSSSIFTKDVNRVFKAQRDLDTGIVYVNAGTTGAEIHLPFGGTKGTGNGHRDSGVQALDVFTEWKAIYVDYSGKLQRAQIDTEE

SEQ ID NO: 16336 - protein, 331 aa, Oceanobacillus iheyensis HTE831
MVQGSVNLNTERGKEWLQDYVDNWVNFYQKQTDEGKVASYIPRLEHADPNALGISIIGKNGTVIRSGDTDLEFSIQSISKVLSFIVACMERGLSYVLQRVDVEPTGESFNSIMHLEINQPKKPFNPLVNSGAITVSSLLNGRTSDQKLEPLYQLLEKILGHRPEIDVEVYVSERDTSMRNRAIGYYLLEEGYLESDLSITLETYFKHCSLNVTVDDLAMIGLVLSNDGVHPNTDEPLIPKQIARVAKSLMLTCGMYDASGKFASYVGIPAKSGVSGGILAVVPPRVRDQNLPFLEGCGIGVFGPALDKQGNSIAGIKLLRHIANQWDLSLF

SEQ ID NO: 16337 - protein, 432 aa, Oceanobacillus iheyensis HTE831
MKFTNSEKLHQEALQHIVGGVNSPSRAYKAVGGGSPVYMERGQGAYFWDVDDNKYIDYLAAYGPIITGHAHPHIAKAIAHAATTGVLYGTPTCLENEFAQMLKEAIPSLEKVRFNNSGTEAVMTTIRVARAYTGRTKIIKFAGCYHGHFDAVLVEAGSGPSTLGTPDSAGVPASTASDVITVPFNDIEAYKAALNKWGDQVAAVLVEPIVGNFGIVEPFKGFLQEVNELTHRAGALVIYDEVITAFRFTYGSAQQIYGVEPDMTAMGKIIGGGLPIGAYGGRKDIMEQVAPLGPAYQAGTMSGNPASMAAGIACLEVLKEEGVYEELDRLGKRLEEGILEQAREHGIHITVNRLCGALTVYFGVDQITNYAEADASDGEAFAKFFQLMLREGINLAPSKYEAWFLTTEHKDSDIENTIDAVGRSFAEMAKTL

SEQ ID NO: 16338 - protein, 132 aa, Oceanobacillus iheyensis HTE831
MSLYNIGIKPFNIGKITLKNRVGVAPMTRISATEEGFVTNKMVNYYGSFAEGGFVLIITEDTYINDKYSQTYYDQPGIAFDEQAHEWKKVVDAVHSAGSKIFMQLQHTGPLSQGNRFANETVAPSSIQPNQQ

SEQ ID NO: 16339 - protein, 512 aa, Oceanobacillus iheyensis HTE831
MLNDKAIRQSKIIYWSSGIVSICGIIFEVLFGALGSYILGDGVKQYTLTISLFLTGMGIGASLSEKFMRNLIIKFVWIEFCVALIGGFSSFIMFGITAFAPAGTDAFYLYSITLIIGALTGVELPILIRKANEIGVTLNKSTARVLFSDYAGGLIGGVLFVFLFRPYFGMVKTAFLVGLINLTVALIVLWLFRKEIRHFIVHAVIGGVIGVLLIAGLFFGEEMAFNFEQKLYQDPIIHMEESSYQKITVTQDEKDIRLYLDGSLQFSSVDEHRYHEVLVHPAMANVETPENVLILGGGDGIAAKEVLKYQDVKQVTLVDLDPAVVELANENRHLLEINEGALMDEKVEVKNMDAFQFLEDTSEWYDVILVDLPDPNNESLNKLYTKEFYSLVRNHLKPEGTLMVQATSPVFAREVYWTISETISSTNLNTENLHVDVPSFGNWGFVMASREEIDLDIMEIPVSTRFLTDDMMPALTAFGKDEDQQIPNFELKANTLIDPHLIQIYEKAWENY

SEQ ID NO: 16340 - protein, 324 aa, Oceanobacillus iheyensis HTE831
MKSLEKVSIFAGNTFAIWVLLFGVISFIFPSGFSWIAPHISLLLGIIMFGMGLTLTPNDFKGVIKTPKSVLIAVILQYTIMPIIAYCLAVVFQLPPAIAVGVILVGCCPGGTASNVMTYLAKGNTALSVSVTTISTLIAPIMTPTLTLLLASEWMAVSFMSMFISIIQVVLLPIVLGVGVRMLFRNQVEKSVSVLPLVSVIGIVAVASAVVAVNTEAIATSGLLIFGVVMLHNLLGLFLGFLIAKLAKLDFSDRKAISIEVGMQNSGLASTLALTAFATTPVAAVPSAIFSVWHNISGPLLATYWSKKGDKDISIIQEKVENLG

SEQ ID NO: 16341 - protein, 240 aa, Oceanobacillus iheyensis HTE831
MITVNDLHKRFGKNEVLKGINCEVEETEVVCVIGPSGSGKSTFLRCLNLLEDVSAGKVVIDGHDLTDKKTNINTVRTEVGMVFQQFNLFPHKTVIQNVMLAPQKVRKITSEEARKRGEILLEKVGLSDKANQYPAQLSGGQQQRVAIARALAMEPKLMLFDEPTSALDPELVGEVLEVMKQLAKEGMTMVVVTHEMGFAKEVADRVLFMDEGIIMEENTPDKIFTNPDSERTKEFLNKVL

SEQ ID NO: 16342 - protein, 399 aa, Oceanobacillus iheyensis HTE831
MSSTTKVSSAVMQTYNRFPITATKGKGSFLWDDNGEKYLDYTSGIATCNLGHVPDNVQHAISNQLKDLWHCSNLYHIPSQEKLAALLTEYSCLDQVFFCNSGAEANEAAIKIAKKYAKDKGYDDRTEIITFEQSFHGRTGSTMAATAQEKIHQGFTPLTEGFRYLPFNNKESLSEIDNGKTSAVLLEVIQGEGGIHTAEKDWLKQLAAICKQADILLMIDEIQTGIGRTGSLFAYQPYGIEPDVITVAKGLGSGFPIGAMLAKQHIAASFSPGTHGSTFGGNPVAAAAGIATLKEILSDGFLENCKEGQEELFNQLKSIKEISPLIKDIRGKGYLMGIEVMNQASAWIEKLREKQILVLPAGEKVVRILPPLTTTKEELQICIQALKEVALELGGNTNG

SEQ ID NO: 16343 - protein, 309 aa, Oceanobacillus iheyensis HTE831
MAIYESIQQLIGNTPLLRINEMDIPNNVHLYAKLEFLNPGGSVKDRLGQYLIDKAWEQGFLREGSTIIEPTAGNTGIGLALAARTKKLSVIFCVPEQFSVEKQQIMRALGATIIHTPKEKGMMGAIEKAEQLVEEIPNSYSPQQFSNKFNPMTYYETMAPEIWSDLQGDIDIFVAGAGSGGTFTGCASYFKERKNSIHNVIVEPVGSILGGGEAGPHLTEGIGMEFIPEYMNQSFMDEVQTISDKEAFSMVEELARKEGLLVGSSSGSAMVAALNKAREARSGTTIVTILPDGSDRYLSKQIYNVSKQL

SEQ ID NO: 16344 - protein, 498 aa, Oceanobacillus iheyensis HTE831
MLNRNKLLLLLTVIFVLLPVTNVNAEEPINIHNEIIYDILVDRFNNGDSEETEEIAVDDPNAYHGGDIKGIIDQLDRLKEMGITTISLSPLMTNQQNGYHGYWVLDYFEIDEQLGTMEDLNQLIEQAHQRDMKVVMDMVINYAAASHEVTEDETKADWWTEPSYTAASWSANALQWNLNQPEVAENMINVADYWMEETEIDGFTLHAVDQAPIDFLQEYTQHIKETDEEFYLIGDILDPESANIQELEETPLDIVANPMLHERLKQVFSDVDNPVSEVYHQWENLETDSPLITIDNFTEERFTNAYSKNQRNSLTAWTLALTYMYTTPGTPLIVQGTELPMYGGDEEESQRLVPFNSGDPELKEFHTRIASLRNEFPALRQGDIELVDTVDSMIVYKRSYEGQTMYVAINNGSESAYVDVTDVDANKELRGHLQDNLVRENQEGNHRIGIPRESVEVYEVQDDHGLNWWFIGFIVMVILAFIAGVIYLTIKQRKREKK

SEQ ID NO: 16345 - protein, 456 aa, Oceanobacillus iheyensis HTE831
MLKKSFLIFTALLLLATPVYAATPTPESLELSVNLIWVMLGAFLVFFMHAGFAMVESGFTRSKNTLNILMKNFLTISVASILFFLVGYGIMFGSSAGSIIGSDGFLLSEISEIDFFVFQAMFVATCATIISGAVAERIKLGSYILIVAAMTTIIYPVVGHWVWQGDGWLTSLGFSDFAGSTVVHLTGAVGAFVVVLILGPRIGKYKGKKVNVIQGHNLPLGALGVFILWLGWFGFNGGSTLAADPSLVPYVIGTTLLSTSAALVSSSLYTKLRFKKVDASLSMNGVLGGLVGITAGAAEISLGGSIIVGLISGVVLVEGIRFLDTKLRIDDPVGAIAVHGICGIWGTLAIGLFSVNTGLFYGNGISQLGIQAIGVLAVVAWVAITAGGFTYVINKISQIRVSEEEEISGLDFAEHGSSAYNFKESLLEGTDNNSSSGLAERLNNNIPIGKTSNQSS

SEQ ID NO: 16346 - protein, 434 aa, Oceanobacillus iheyensis HTE831
MNKSDQHWQELVNSIGNFLAPSMAKDHPNLPVVKAEGCYYYGTDGKEYLDFTSGIAVENVGHRHPKVVQAIKDSADHLVHGPSGVIIYESILKLAQELQEIMPPKLDNFFFANSGTEAIEGGLKLAKHVTKRPYVISFTGNFHGRSIGSLSVSTSKSKYRKYQQPSWLTYQLPYALPEYLPEGQDPEVFFAEKLEKDAESLFKHQVDPEEVACMILEPIMGEGGYIIPPKSWLQKVREICDRHGILLIFDEVQTGFGRTGDWFAAQTFGVTPDIMAIAKGIAAGMPLSATVASKELMDQWPLGSHGTTFGGNPIACAAARASLSIMKEEKLLNNAKTMGDYALTKLSGLKDKYEIVHEVRGIGLMLGIELRDPETGEPDGEAVMKALNGCLDEGVLFYLCGNAGEVIRMIPPLTINKEQIDQGIDVLDKVLAQM

SEQ ID NO: 16347 - protein, 327 aa, Oceanobacillus iheyensis HTE831
MENVFDYEDIQLIPAKCVVNSRSECDTSVTLGNRTFKLPVVPANMQTIIDEKIAKYLAEKNYFYIMHRFEPEKRIDFIQDMQEYNLFTSISVGVKEEEYTFIEDLAAKQLIPDYITIDIAHGHSDAVIKMIKHIKNNLPSSFVIAGNVGTPEAVRELENAGADATKVGIGPGKVCITKIKTGFGTGGWQLAALRWCAKAASKPIIADGGIRTHGDIAKSIRFGASMVMIGSLFAGHEESPGETIEQDGKKIKEYFGSASEFQKGEKKNVEGKKMYVEHKGPLQDTLTEMEQDLQSSISYAGGKQLDAIRNVDYVVVKNSIFNGDKVF

SEQ ID NO: 16348 - protein, 468 aa, Oceanobacillus iheyensis HTE831
MVVGDFPVEVDTLVVGAGPGGYVAAIRAAQLGQKVTIVDKGALGGVCLNVGCIPSKALIEAGHKYENAHGSEDLGIKTDKVEVDFSKVQDWKGSVVNKLTSGVESLLKGNKVDIVKGEAYFVDANTAKIAGESSSQTYKFKDCIIATGSSPIEIPSFKFSDRVLDSTGALSLKEIPKKMVVIGSGYVGTELGTAYANFGTEITFLEGAKDILGGFEKQMTQLVKKGLKKKGATIITEAMAKGVEETKDGVKVSYEVNGKEETIEADYVLVTVGRRPNTDELGLEQMGVKMTDRGHIEIDKQCKTSVDNIYAIGDIVEGPALAHKASYEGKIAAEAISGEKSEIDYVGIPAVAFTEPELATVGLSEQDAKDAGYDVKVGKFPFGANGRALSLNNTEGFLKLITRKDDGLVIGGQIAGPNASDMISEIGLAIEAGMTAEDISLTIHAHPTLGEITMEAAEVALGTPIHTM

SEQ ID NO: 16349 - protein, 218 aa, Oceanobacillus iheyensis HTE831
MTKIAPSILSADFAKLGQEIKEVEEAGADYIHVDVMDGHFVPNITIGPLVVEAIRPITDLPLDVHLMIENPDAYIPAFAEAGASIITVHQEACVHLHRTLQLIRSHGVKPGVVINPATPVEMIKPILAEVDLILIMTVNPGFGGQSFIQETTSKIKQLADWREKYKLSYEIEVDGGVNEKTAGICTTSGADVLVAGSAIFNHENRKQAIELLREKAKV

SEQ ID NO: 16350 - protein, 423 aa, Oceanobacillus iheyensis HTE831
MQRFIMEQHDSLRKEIIAGVIGFFTTVYIVIVNGSILSEAGVSLETGMIATIMASFVGTMIMGIFGKLPLILIPGMGINALFAYSIIGNNNFSFQEGLAIVWIAGLIFVITAFTRLGTILKEAIPDSLKHAITVGLGFFLILIGLEKSGIVISGDSTVIAIGDFTSPAVITGLVTLFIAIFLFVKNIPANFLITMVIGTVIAVVTGVETRQASSIQFQLNELMFIPSFQAIGDISFWLAIFTLSLILIFENMGILNGQLDMLDKQKGYKKAFRITATSSLTSALFGTSPTVSSAENAAVIASGGKTGKAAITAGILFLATIIFIPWISLVPNTAISPILIIVGFLMAQNIKHLPLQQLADCIPALLIVVMIPFTYSIGDGMAFGFIAYPIVKWALGKKEEISIPLLIISGLFFLEFAFKVIGI

SEQ ID NO: 16351 - protein, 445 aa, Oceanobacillus iheyensis HTE831
MGKSFTKDEVIKQIKEENVKFIRLQFTDMLGTIKNVEIPYSQLDKALDNKMTFDGSSIEGFVRIEESDMLLYPDLDTFVVFPWTSEKGKVARFICDIYNPDGTPFEGCPRYNLKRNLKKMEELGFDAFNIGTEPEFFLFKLDEKGEPTLELNDHGGYFDLAPTDLGENCRRDIVLELEEMGFEIEASHHEVAPGQHEIDFKYSDAVKHADDIQTFKLVVKTIARKHNLHATFMPKPLFGVNGSGMHVNMSLFNGKENAFYDTSGELELSNTAYQFIAGIIKHATNFTAVTNPTVNSYKRLVPGYEAPCYVAWSGSNRSPLIRIPSSRGLSTRIEVRSVDPAANPYMALSVLLASGLDGIEQGLEAPESVDRNIYVMDKAEREANGVQDLPATLKDAMENLKKDKILVDSLGEHLFEHFIEAKEIEWDMFRTTVHPWEREQYLSNY

SEQ ID NO: 16352 - protein, 355 aa, Oceanobacillus iheyensis HTE831
MITFKDIKKTYPDGTTAVRNFNLEIKQGELVTLIGPSGCGKTTTMKMINRLIDPTEGYIYINDKPVSDYSIHELRWNIGYVLQQIALFPHMTVRENVAIVPELRKWKSKDIDERIDELLAMVGMEPSTFRDRYPSELSGGQQQRIGVIRALAADPEIILMDEPFSALDPISREQLQEDILKLQKEIKKTIVFVTHDIDEAIKLADRICLMKDGEIVQVGTPQQLMNSHEDSFVQEFMGDYQSPWKINVKELVSQDSKYRMISAPTNDYSEVLGFKALINEDSIFQGIIQNGMVLEETITIPENATIEEASALMQSQDQTRFPVLDENEKLIGTIGTQEIVHYFYEQDKGRGGIPS

SEQ ID NO: 16353 - protein, 509 aa, Oceanobacillus iheyensis HTE831
MDYIQELQQRIEKIEKGGKQKYHDSNTDKGKLFARKRIELLFDQDINVEDALFANHSAEDLPADGVITAIGKINGQTVCVMANDSTVKAGSWGKRTVEKILRIQETAEKMEVPILYLVDSAGARITDQVEMFPGRRGAGRIFYNQIKLSGRVPQICLLFGPSAAGGAYIPAFCDIVVMVDGNASMYLGSPRMAEKVIGEKVTLEEMGGANMHCSVSGVGDVLVESEEEAIAFARTYLDYFPANFRQKPLPKEARLPKQQDKTIEEIIPTNQNAAFDMYELINRTIDEDSFCEIKKKFAPELITGLARLNGKSVGIIANQPRVKGGVLFTDSADKAAKFIQLCDAFEIPLLFLTDVPGFMIGTGVEKQGIIRHGAKMLFAMSEVTVPKISVIVRKAYGAGLYAMSGPAFEPDCCLAFPNAQIAVMGPEAAVNAVEANKIAKLPEEERAAFIKQKQDEYKENIDVYRLASEMVIDDIINPNELRQELIQRFSIYENKKMTFTERKHGVYPV

SEQ ID NO: 16354 - protein, 307 aa, Oceanobacillus iheyensis HTE831
MRVVNDVTELIGQTPMVKLNRLQPENAADIYVKLEMFNPSGSVKDRAASHMIRVAEEQGLIKQGATIIEPTSGNTGIGLAMAASAKGYKAIMIMPDNSTMERRNILKAYGAEVVLTPSEEKMPGSIRKALELQKSIPNSFIPQQFENVANPDVHRISTALEILEQMDNQLDAFVCTAGTGGTVTGTGETLKEKLPHVHVAVVEPEGSPVLSGGKPGPHKLVGTSPGFVPDILNTDVYDEIIQIKDEQAVTLLKDLAQKEGIFLGPSGAAAVYAAMEVAKKLGPNKKLVCIAPDTGERYLSMDMFDEK

SEQ ID NO: 16355 - protein, 440 aa, Oceanobacillus iheyensis HTE831
MKHFQNFKWHNWSSTSNCSPERMYYPRSIEDVIEIVKAATENQQKIRVVGAGHSFTNLVMTEDWLVSLDYLSGVKEVDHKNHTVTVYGGTRLYDLSKALEKLGYAQENLGDINVQSIAGAISTGTHGTGIQFGSISTQVKEITFVTAGGNLLRLNEENNVEEFKASLISLGMFGIIIEAKIRVVPSPVYRYISNHVYYPTLLNNLETYIQDNQHFEFFMFPYADQVQTKTMNPTNTSPKSIKRHQWNNLIVENYMYQAVSHLCLLYPSLTRSVSRLSAKLVSKSTIDAKSYQLFATPRKVRFLEMEYGIPIEYFHDAIQEIRETIVKNQYKVHFPIECRTVKQDDIWLSPSYKRDSAFIAFHVYKGMEYQTYFRDMEAIMKKYNGRPHWGKLHQQKAKDLCEMYPKWDQFIQLRQQLDPERMFVNRYLDELFYTEEKVKV

SEQ ID NO: 16356 - protein, 290 aa, Oceanobacillus iheyensis HTE831
MQNKTIIVTGANTGMGLATTIELAKKGIHVIMACRDTKRGNEAKEKAMEESNSTNISLYQCDLGSMESISKFADQIKEDFDKIDGLINNAGVVSLKHTKTEDGFESMTGVNHLGHFLLTHLLLDVLKKSEQARIINVASGAYKAGTLDYNDMHFNNRSFNVIKGYGQSKLCNILFTLELNKHLEGTNVSTFALHPGAVSTSLGVDRQTGFGEKVHLLLRPFFLTSEEGAETAIYLATEPKIDHLSGRYFYKKKLQPTKYNKVNEDEAKKLWDWSIKELGMEHKAIEEVAP

SEQ ID NO: 16357 - protein, 265 aa, Oceanobacillus iheyensis HTE831
MAINIIVAGPRGRMGYEAVQMITKEDSFRLVACLDHKHDGLNLGELEQFSDDLQVPIYTDIDSCLKQHQADVFVDLTTPEVGYKHTKTALEYKVRPVVGTTGFTDEQLSELKELSKQQQRGCIIAPNFAIGAVLMMKFSKMAAKYFPNVEIIEKHHDQKLDAPSGTAKKTAELIQDVRESQKQGHPKEEETLPGARGADMDGMRIHSMRLPGLVAHQEVIFGGAGQTLTISHDSMNRASFMDGIRECVNQVMDLEELVYGLENLL

SEQ ID NO: 16358 - protein, 459 aa, Oceanobacillus iheyensis HTE831
MELLERYQSIVENQRAYFNHGNTVDYSFRKQQLEKMKVMLKEYESHIFQALKHDLNKSKHEVITSELAILYSEIDSMLKNLRQWMQPDKVTNPITHKGSKSYIMKEPLGVILVIAPWNYPLQLSLAPVIGAIAAGNTVIIKPSEHAPHTSELVAEMIQNTFDSSFVTVVQGAKVETEALLKQRFDHIFFTGGAAIGKIVMRAASEFLTPVTLELGGKSPAIVDEDANIQVAAKRIVWGKYTNAGQTCVAPDYILVHEKAKFKLLKAMKKYIKSMYGKDPLQNDAYTRIIHEGHFDRLTNFLSNGTIVHGGEYNRDTLSIEPTILDKITWDEAIMQEEIFGPILPVLTYTNIEDALYQIKLREKPLALYYFGENEKMQQQVMEYVSFGGGAINDTIYHLANPHLPFGGVGTSGMGNYHGKASFDTFSHQKSIMKQTTKFDIPFRYPGGKITSNIVKKFLT

SEQ ID NO: 16359 - protein, 425 aa, Oceanobacillus iheyensis HTE831
MVGYATISKKPIYVFAHDFTVRGGSLGELQGKKIASMMDLAAKTKVPIVGLNESAGARIQEGVTALDGYGQIFYRNVKYSGVIPQISIILGPNAGGAVYSPALTDFIIMVKDISQMYITGPKVIEAITKETVSAEDLGGTYMHAVVNGNCHFLATNEQEAFQITAKLLTFINTTTMSNELTARDYCNSLHELVPSESGKTYDVIPIIETIVDDGSFLEVHKYFAKNIVVGFASLLGKTIGIVSNQPKHMAGGIDSNASDKAARFIRFCDCFNIPIITLEDVTGFYPGIRYEKEGIIRHGAKLVYAFAEATVPKITVILRKAYGGAFVAMNSKALGADLLYAWPSAEIAVMGPEGASSVFKTDKKDNETRTNLPNNSTSPYYAAAKGMVDDIIDPRETRIKLIQSFIMLEQKNETAPIRKHGNIPL

SEQ ID NO: 16360 - protein, 473 aa, Oceanobacillus iheyensis HTE831
MATEYDLVILGGGTGGYVAAIRASQLKMKVAIVEKAELGGTCLHRGCIPSKALLRSAEVYQQTTRADEFGIQVAKPVLDFSKVQQRKQKIIDQLHQGVQGLMKKGKIDVYQGFGRILGPSIFSPMPGTISVEYSDGKENDMLLPKNVLIATGSRPNQLPGFEFDHNYILSSDDALALETLPDSIVIIGGGVIGIEWASMLNDFEVDVTILENQDRILSTEDAEISKEMSKLLSQKGINIITNANVKADSVKKDQGVSLQVDVDGEIQTHQAEKVLMSVGRKGNIENIGLENTDIVTDRNLIMTNEFYQTKESHIYAIGDVIGGLQLAHVASHEGIKAVEHMAGHTVEKIKANAIPSCIYSSPEAASIGLTEAQAKEKDYEVKVGKFPFKAVGKALVYGESEGFVKIVSDKNTNDLLGVHMIGPHVTDMIAEASLAKFLDATPWEISESIHPHPTLSEVIGEAALAVEGNQIHG

SEQ ID NO: 16361 - protein, 375 aa, Oceanobacillus iheyensis HTE831
MGKRDYYEILGIDKSASQDEIKKNYRKLARKYHPDVNKEADAAEKFKEVKEAYEVLSDDQKRAQYDQFGHSGPQSQGFGGFGGGAQDFGGFGDIFDMFFGGGGRSRDPNAPQQGNDLQYTMILDFEEAVFGKETDIEIPKEESCDTCNGSGAKPGTKPETCSHCHGSGQLNQEQNTPFGRVVNRRVCNYCQGTGKIIPDKCNTCGGSGTVQKNKKIHISIPAGIDEGQQIRVAGKGESGKNGGPAGDLFVVIKVRPHDFFVREGDHIFCELPLTYAQAALGDELEVPTVHGKVKVKVPAGTQTGKTFRIKGKGAPNVRGRGHGDQHIKIKVMTPTNLSEKQKDLLREFNELGGNESTDEQDDNIFQRFRRAFKGE

SEQ ID NO: 16362 - protein, 284 aa, Oceanobacillus iheyensis HTE831
MTSIGYLGPKGTFTKMAVDSVFNGEMKNGYRTIPECIDAVDKGEVDIGVVPIENAIEGTVQLTIDYLIHQVRLPVVGEIVVPIQQHLLVRKEVTNNLSDIQEVYSHSHAIAQCHQYLHRHLHAATTKHTSSTGKAAEIVSNSNEPIAAIGNRLAAEEYGLHIFQENIHDYPNNHTRFLVLSNHPEKVHIKHKKDSEKTTMLITLPNDQSGALHQILSAFSWRKLNLSKIESRPTKTGLGNYFFIIDVDQPYDDVLFPGVKSELEALGCQVTILGTYPVYHMLQN

SEQ ID NO: 16363 - protein, 428 aa, Oceanobacillus iheyensis HTE831
MTLNQSIDAYKEAVDLMPGGVNSPVRAFKSVGMNPIFMKEGKGSKIVDIDNNEYIDYVLSWGPLILGHSDERVVKKLQDITAKGTSFGAPTLLENDLAKLVIDRVPSIEMVRMVNSGTEATMSAIRLARGYTDRDLILKFEGSYHGHGDSLLIKAGSGVATLGLPDSPGVPENIAKNTITVPYNDTDSLKLAFENYGDRIAAIIMEPVCGNMGVVPPKDGFLQYVRHITEENGSLLIFDEVMTGFRVGYHCAQGHYDVTPDLTCLGKVIGGGLPVGAYGGKREIMEQIAPTGPIYQAGTLSGNPLAMTAGYETLSSLSEESYEDINNKVDTLVNGFRDAADKFDIPIHINRAGSMVGVFFTDEEVINFETAQTSNLDYFAQYYRSMVNEGIFLPPSQFEGLFLSTAHTDDDIEKTVKAIHKAFEQIEK

SEQ ID NO: 16364 - protein, 243 aa, Oceanobacillus iheyensis HTE831
MKEMIRVEDLNKSFGKLHVLKDIKLTVYESDVVVLIGASGSGKSTLLRCLNYLELKNSGNIIIEGEKVEPKTHNLNHIRQRIGMVFQHFNLFPHMTVLENVIEAPTQVKKVAKQEAVLDGKQLLDKVGLGDKYNEYPSKLSGGQKQRVAIARALAMKPDVMLFDEPTSALDPELVNEVLTTIKELAVEGMTMVIVTHEMGFAKEVGDRIVYMHEGRIVETGSPTEIFTNPHEQRTKDFLGSVL

SEQ ID NO: 16365 - protein, 495 aa, Oceanobacillus iheyensis HTE831
MFCNITEFGAKGDSNTDNTESISSAIKRCADSGGGTLYIPAGTYLTGPISLISNLTIYIESGAKLVFIDDFSAYPPVKTRWSGYECYGFSPLLYGNGLTNVSIIGSGCIDGQGEAWWEVNHLLRKGEEYDHPQTKEIAELNKSITEPKNTNLVEWPSQFLRPPLLQMYDCDSVTLDGITLENSPFWNTHFVYCDNVTIHNVKFKNPWDTPNGDGLDLDSCSNVRVSNCHFDVGDDCLAFKSGINEDGRRVARPTENVAVTNCTMKNGHGGIVMGSENSGGIRNIAVSNCVFIGTDRGIRLKTNRARGSYIRDILIDNIYMDGVLCPLAINSFYRHGLDKSDSLINELSPIEISEKTPEIEYIHISNVTARNCRSAAGFIYGLPEKYVKDIILRHVLIEMTINPDEQGGEPDMVKEPIFMAGEGIYCKYVDGIEFHRVRVETRQGPALHLENVINAELDHLIRKRKHPNTPIVTVNDVTNIRTNQSSREVNEFENI

SEQ ID NO: 16366 - protein, 320 aa, Oceanobacillus iheyensis HTE831
MKRMDVIGIGETMVSLTPDKYGLIRQTSSFEPRVAGTETNTLIGLSRLGHNTGFISRLGEDELGAMVLKELRGENVDTKLIDLDPYHQTGLFLKEIINESDVHVYYYRQHSAASQMTRELLDESYISSASYLFITGITPAISESCKQTIFTAINMAKNNGVKIVFDPNIRKKLWSESEARQTLIEILKLSDIILPGISEGQFLLDSNDPEEIGKKCVDLGAELVVVKLGENGAYYCTSDHGDYVPSFPVKQVRDPVGAGDAFAAGLLSGLIDELSIEKAVERACITGGYATTYVGDYEGFPDKSRLERLTNLSTSEDVSR

SEQ ID NO: 16367 - protein, 462 aa, Oceanobacillus iheyensis HTE831
MVKMQEWIEVTNPATGEVIDRVERGGKVEAREAVDKASEAFNDWSKRTAYERSELLMNWNALITKHQDELAEIMTMEQGKPIKEALGEVQYANNFVSWYAEEGKRLYGETIPASKADKRILVQRQPVGVIAAITPWNFPAAMITRKVAPALAVGCTAVVKPASATPRTAIRLAELAEEAGIPKGVLQVVTGSSGDISDAWMQDSRVRKISFTGSTEVGKILMKKSAETVKKVSLELGGHAPLIVMKDADIEKAAEGATASKFRNAGQTCVCTNRIYVHESIKDEFIKAFERKVRELRVGNGLEEGIDIGPLIDHDALEKVETHIRDAAHKGASIVYGGDKVGDDSLFYKPTILSNVTDNMLCMTEETFGPVAPVTTFSTEEEAVKRANHSPYGLAAYLFTENLATAIRISEQLEYGIVGINDGVPSTAQAPFGGFKESGIGREGGHHGMEEYVEVKYISIQL

SEQ ID NO: 16368 - protein, 392 aa, Oceanobacillus iheyensis HTE831
MQSLYKSNIVRNMPPYLFAHIQKKKQKLMEQGSDVIDLGIGAPDLPPPSYIIEELSKHIKNRHLHRYSPYQGIPELRQAVATFYQEKYNVTLDPEEEILILIGSKEGLVHLIQSVINPGDKVILPDPGYPVYKMGVHMTQGRAVYLPLDKNKEYKPNWKMLSEQDKEEAKLLFLNYPNNPTGATAQKETFVKAVQIANKYNICIAHDAAYDHVTFSDYKSPSLLQVDGAKKVGVELGSLSKNFNMTGWRIGYIVGNSSVIQALATLKSNIDTSQFIPVQIAAIKALEQSEDEIRTIHHTMEKRMLKTWKLLKNAGFEVKKTKGTIFLWVKVPKGYTSSSFTEQVLDQAHVIVTPGSAFGEQGEGFFRIALTVPEERLIEAVQRIDSWLNGGK

SEQ ID NO: 16369 - protein, 398 aa, Oceanobacillus iheyensis HTE831
MTITSTNIIEETNYYGAHNYHPLPIVVSEANGVWVKDPEGNSYMDMLSAYSAVNQGHRHPKIIEALKNQADKVTLTSRAFHNELLGPWTKRMAKLTKKDKVLPMNTGVEAVETAIKAARRWAYQVKGVTENQAEIIAADGNFHGRTLNAISLSNDPDATKNYGPFVPGINKVSYGDINAIEKAITENTAAIILEPIQGEAGIIIPPEGYLKKVRELCSEKNILFIADEVQTGFARTGKMFACEWENVEPDIYVMGKALGGGVFPVSAIAANNEIMDVFTPGSHGSTFGGNPLACAVSMAAIDVIEEENLVNKSLESGKYFADKLRAVNFEGIKEVRARGLFIGMEFHQPVREICEKLKDKGILCKETHVNTIRFAPPLVITKDEMDWAIQRIEEVLTN

SEQ ID NO: 16370 - protein, 480 aa, Oceanobacillus iheyensis HTE831
MSETTPHWLTKRADLSPDKKAIEFEDGSSITYLELFHRSQSYARKLGKLGFRQGDHIAILSTNCAEMIQIIYACSYLGAVAVLLNTKLTINELNQQLLDSDAKVIITSESFKASEFVLQRMDYNELESVTEDTSIITLKSEIYFDDIFTMMYTSGTTGFPKAVQQTFGNHWWSATSSALNLGLHDNDKWLIPLPLFHVSGLSTMLKSVIYGMPIYVLEKFEVEKVHNAIMDRKVTIVSVVTVMVQRLIKRLGNHHYPNDFRCMLLGGGPAPKSLLEQAKLKNIPVFQSYGMTETSSQIVTLTPEDALKKIGSAGKPLFPAQLKIAHNENNPNQIGEILVKGPMVTKGYYKRAETNKEVFENNWLHTGDMGYLDEQGYLYVVDRRNDLIISGGENIYPSEIENVLVQIEGIEEAGVKGSPNEEWGMVPIAFIVCSRPISENEIAAHLEKYLAKYKRPKEIHVVNELPRNAANKLVRHNLGK

SEQ ID NO: 16371 - protein, 448 aa, Oceanobacillus iheyensis HTE831
MTHVSFNYEKALSFFEKQEITNLEPFVHTAHQMIHERIGAGKDFLGWLDLPRNYNREEYTRIKAAADKIKKDSDILLVIGIGGSYLGAKAALEMLNHSFQNLLSKDQRQVPQIIFVGHHLSSTYMTELFDILKDKDFSINVISKSGTTTEPAIAFRVFKKYLEEKYGQDEAKKRIYATTDRSKGALKTTADSNDYETFVIPDDVGGRYSVLTAVGLLPIAASGINIDDMMEGAKAGMEDLANPVISENPAYQYAAVRNILYQKGKVTELLINYEPNLQYFSEWWKQLFGESEGKNQKGIYPSSANFTTDLHSLGQYIQEGRRNIFETILHVNEPKKDFTLEKEESDLDGLNYLAGKSIHEINDKAFQGTLLAHTDGDVPNLIVEVPRLDAYTFGYLVYFFEKACAISGYILGVNPFDQPGVEAYKKNMFALLGKPGFEDQKEALEKRL

SEQ ID NO: 16372 - protein, 429 aa, Oceanobacillus iheyensis HTE831
MPYITDVYAREVLDSRGNPTIEVEIFTESGAFGSAIVPSGASTGEYEAVELRDGDKDRYLGKGVQKAVENVNDLIAPELIGIDVTRQNIIDALMIDLDGTENKGKLGANAILGVSMAAAHAAANYLEVPLYNYLGGFNAKTLPTPMMNILNGGEHADNNVDIQEFMIMPVGAPTFKEALRTGAEIFHALKKVLTSKGYNTAVGDEGGFAPNLGSNEEALQTIVEAIEAAGYKPGEEVKLAMDVAASEIYSDGKYNLKGEGVVRSSEEMVDWYEEMISKYPIISIEDGLDENDWDGFKILTDRLGDKVQLVGDDLFVTNTNKLSKGIDQGIGNSILIKVNQIGTLTETFEAIEMAKRAGYTAVISHRSGETEDVTIADIAVATNAGQIKTGAPSRTDRVAKYNQLLRIEDELAGMGEYGGLASFYNLANK

SEQ ID NO: 16373 - protein, 512 aa, Oceanobacillus iheyensis HTE831
MSQNKLAALIILDGFAIRDEVKGNAVKQANTPNFDRFWNQYAHNQLEASGKAVGLPDGQMGNSEVGHLNIGAGRIVYQSLTRVNVSIDEGDFYEVDAFIKSVEHAKKHDKALHLFGLLSDGGVHSHINHLFALLRLAKKHELENVFVHAFLDGRDVGPKTASKYIKETQDVMDELGVGQFATISGRYYSMDRDKRWDRVKKCYDAMVYGEGPSYKSAQEVVDDNYANEIYDEFVIPSVITDDNDEPVATIKDEDSIIFYNFRPDRAIQISRTFANEDFRDFERGDKAPKKLDFVMLTNFSETVDGYVAYQPVNLDNTVGEVLAQNNLNQLRIAETEKYPHVTFFMSGGREKEFPGEKRILIDSPKVATYDLKPEMSVYEVTDALLKELDKGEQNAIILNFANPDMVGHSGKLQPTIDAIEAVDECLGKVIDKITELGGHAIITADHGNSDEVMTLEDKPMTAHTTNPVPVIVTKDDIELRDGGILADLSPTLLDLLNVEKPKEMTGNSLIKK

SEQ ID NO: 16374 - protein, 252 aa, Oceanobacillus iheyensis HTE831
MRKKVIAGNWKMNKVLSEAGEFMNSVVPKAPKGNDVEAIVCAPFPFLSKLVEQAKGSEVKVAAQNMHFEDSGAFTGEVSPVMLKDLGVTHVVLGHSERRELFAETNELVNKKTKAAFAHDLTPIVCVGETLDQREANETMNIVGEQVKQAVAGLTNEQVAETIIAYEPVWAIGTGKTATSEQANEVCTEIRKVVAEVTSADVAEKVIIQYGGSVKPANVDELLAQSDIDGALVGGASLDPESFLQLVEAGTK

SEQ ID NO: 16375 - protein, 393 aa, Oceanobacillus iheyensis HTE831
MNKKTINDLQVEGKRVFTRVDFNVPLKDGEITDDTRIRAALPTIEQLTAQGAKVILASHLGRPKGTVVEELRLDPVADRLSDLLGKEVLKTDQVYGEEVDQAISELENGGVLLIENVRFEAGEEKNDPELVEAFANMADLYVNDAFGAAHRAHASTTGVAEKLPAAAGKLMEKEIEALGNALENPERPFTAIVGGAKVKDKISVIDNLLDKVDNLIIGGGLAYTFIKAQGHEIGKSLLEEDKIDLAKEFMNKAKEKGVNFVLPVDAIVADDFSEEANTKIVDIDKIPSDWEALDIGTKTREKYSSIVKDSKLVIWNGPMGVFELNAFAGGTKAVAEALASTEGYSIIGGGDSAAAVEKFGLAEEMDHVSTGGGASLEFMEGKVLPGLAALNDK

SEQ ID NO: 16376 - protein, 276 aa, Oceanobacillus iheyensis HTE831
MSEFIAELVGTMILIIFGGGVVAGVVLKKSKAEGTGWVLITLGWGLAVALGVYAVGNFTGAHINPAVTIGFAAVGDFPWSKVPLYILAQVIGAIIGAIIVFLNYLPHWKVTESKEDKLGVFATGPAIRSPFSNLISEMIGTFALLLGLMFIGSNDFTEGLNPLIVGALIAAIGMSLGGTTGYAINPARDLGPRIAHAILPIPGKGSSDWGYAWIPVVGPIIGGVYGALFYDSVFLANYTFPFWVMTIFVIVLFIGAAVSELKTGSNPAEKMNQKLR

SEQ ID NO: 16377 - protein, 506 aa, Oceanobacillus iheyensis HTE831
MRYANPNKQDAIVNFEKRYDNFIGGKYQPPINGNYFENVSPVTGEVFCEIARSTKEDVDAAIDAAHAAKDAWGKTSVAERAVILNKIADRIEENLEKLAVAETWDNGKAVRETLAADIPLAVDHFRYFAGVIRAQEGTLSQIDEDTVAYHFHEPLGVVGQIIPWNFPILMATWKLAPALAAGNCVVLKPAEQTPASIHVLLDLIKDLLPDGVLNVVNGFGVEAGKPLASNSRIAKIAFTGETTTGRLIMQYASENIIPVTLELGGKSPNIFFEDVMDKDDAFVDKAIEGMVMFALNQGEVCTCPSRALVHESIYDRFMEKVIQRVNQIKIGHPLDTDTMMGAQASQEQMEKIKSYLDIGKQEGAEVLTGGNVNALEGELAAGYYVEPTIFKGNNKMRIFQEEIFGPVLSVTTFKDKDEAMEVANDTLYGLGAGIWTRDINTAYRFGRGIEAGRVWTNCYHQYPAHAAFGGYKKSGIGRENHLMMLGHYQQTKNLLISYGEGTAGLF

SEQ ID NO: 16378 - protein, 320 aa, Oceanobacillus iheyensis HTE831
MAKNYIYGNTPCFLDGEKVSLQDNSYKNKDVLIYGVPWEGAVTWGDYTGCELGPKAIRLNSERYSGYLPELNDIDVLQHYSFGDLGDVDVVPADSPETMRRIEQFAKEVWKTGKFPIAFGGDHGITYPIVQALSNEVEGKVGIIHLDAHYDNHPDYHGDLYARSTPFHRIYESESVRNQSIVHMGIHGPRNKPETGKYANEVGATTISVREIKQANNQLHDLAKKAYEIASEGTEAVYLSICSDVLDFAFNPGGPVDGNGLTSYELLELILEFSQMGINGMDYVEVYPQQDANDNSSHFVTYAVLYALAGKLIHDKKENL

SEQ ID NO: 16379 - protein, 215 aa, Oceanobacillus iheyensis HTE831
MVNKLITFNESKSLFQDKMTIMSGGFMGVGTPEKIVEAILESEANELTLITNDTSFENNGVGPLIANNRIAKVVTSHIGTNRATGRKMISKELEVELVPQGTLAERIRAGGAGLGGFLTPTGVGTVVEKDKQVMQIEGKKYILETPLKADIAIIKAYKADKSGNLVYRQSARNFNPLIALAAKLVIVQAEHIVEIGELDPECIVTPNVLVDKILI

SEQ ID NO: 16380 - protein, 316 aa, Oceanobacillus iheyensis HTE831
MKDIITLGEAMVVFNPASTGPMKFVNGFHKTIGGAELNLAIGCARLGLDTGYITRLGNDEFGKSIRNFVRGEGIDASEIDFIDHYPTSINFKEIMEDGSVRTFYYRDKSPTLSMTPDVLNESYFKNAKILHLTGIFPAIGEGALKVWKQAIHLAKKHGVKISFDPNIRLKMWSKEQARKVLLEILPDVDILLAGDEEMDIIIGKRDPVDIIETCKELGIPYVAIKQGENGSVGYSQGETMKAAPVKASKVVDTVGAGDGFNAGILYGYLHDWSLERTLTFGNTIGSMVVGITGDNEGLPYYEDVQERLGEIERIER

SEQ ID NO: 16381 - protein, 486 aa, Oceanobacillus iheyensis HTE831
MSMYSQLDSQYINGVWKDGNGKATIQNTNPYSGEVIATYRAASLQDLDDAYETAQEVQKAWAKENPITVQRIMDKAVTYMEENHEEIVDIIIQEIGGTRLKAEFEIGLVTNMIKEASSFPMRMSGSILPSPIDGKENRVYRVPVGVVGVISPFNFPFFLSMKSVAPALATGNAVVLKPHEHTAITGGTMIAKIFEEAGLPKGVLQVVTTEISEIGDRFVDHPVPAAISFTGSTKVGKHIGEVASRNLKEVHLELGGNSALIVLEDADVDYAVSAGVFSRFTHQGQICMSANRIIVHEDVYDEFVQKYADKVKTLTCGDPADSSTIIGPLINERQVQNTVNLIEKGVEEGAHPLVRGQVNGNVVEPVIFTEVTPDMQIANEEFFAPVVAIMKVSSEEQAIAYANASSYGLSGAVHTSDVNRGAEVAKQLESGMIHINDGTINDEPNVAFGGVKNSGVGRLNGEWSLEAFTTTKWISIQHTKRQFPYS

SEQ ID NO: 16382 - protein, 465 aa, Oceanobacillus iheyensis HTE831
MTEQNYQFPAGFWWGSATSATQIEGAANQYGKGQNIWDHWYNIQPERFYNQVGPEHTSDFYHRYKEDIALMKEFGHNSFRLSISWSRLIPDGVGEVNEEAVSFYHNVIDELIANDIEPFVNLFHFDMPLPLQEIGGWENREVIEMYRQYAKKAFELFGDKVKKWFTFNEPIVPVEGGYLYNFHYPNVVDAKRAIQVAYHTIIAHATAVQTFKELNIENGKIGIILNLTPSYPRSENTADQKAAHIADLFFNRSFLDPAVLGEYPEDLINLLKEHNHLPQTEDGDAGLIKENTIDILGVNYYQPRRVKAKDNLPNPYSPFMPDWFFDSYEMPGRRMNEYRGWEIYEKGVYDIMINLKENYHNIESFISENGMGVQGEEHFIENGQIQDDYRITFIKDHLKWLHRAIDEGCNAKGYHLWTTMDNWSWSNAYKNRYGFFSVNIDTMERTPKKSAYWFKQISEQNGFHA

SEQ ID NO: 16383 - protein, 463 aa, Oceanobacillus iheyensis HTE831
MIQDKKISSKFIYFFGAFGGILFGYDIGVMTGALPFLQSDWNLQNDPTAIGWITSSLMLGAIFGGALSGQLSDRIGRRKMILIASIIFALGSIMAGISPHNGILFMIVSRIILGLAVGAASALVPAYMSEMAPARLRGRLSGINQTMIVSGMLLSYIVAFVLKDLPETMAWRLMLSLAAVPALILFFGVLRLPESPRFLIKNNKINEARKVLSYIRPKEKIESEISQIQASTKYEEKASQKTSWGTLLSGKYRYLVIAGLGVAAFQQFQGANAIFYYIPLIVENATGNAASSALMWPIIQGIILVLGSLLFLLIADKFNRRTLLTLGGTVMGLSFILPAILNIVIPNASPMMIVVFLSIYVAFYSFTWAPLTWVIVGEIFPLVIRGRSSGLASSFNWIGSFLVGLLFPVMVASMAQEAVFAIFGAICLLGVLFVRLCVPETRGRSLEEIEKIGESKQLHKKTV

SEQ ID NO: 16384 - protein, 374 aa, Oceanobacillus iheyensis HTE831
MQVKTAVLRTQGADSPYKESKPIKIETLELDAPQLGEVLIQIKAASLCHSDLSVINGSRPRPLPMALGHEASGVVVEVGEGVTYLEPGDHIVCVFVPSCGHCVPCKEGRPALCEPGADSNTAGTLISGGIRLHADGEAINHHLGVSAFSEFAVVSRNSLVKVKKDIPFEKLALFGCAVITGVGAVVNTANVKLGSTVAIVGLGGIGLSALLGAVAAGASRIIAVDINENKLKQAKELGATDVFNSTEETVIQQIKEATDGGVNYAFETAGAVPAMEVAYGITKRGGTTVTTGLPHPEHQFSFPYVTLTAEEKTLKGSYVGSCVPDRDIPRYMNLFKQDRLPVDKLMTDFISLDEINEGFDKLAKGDSSRIIIKM

SEQ ID NO: 16385 - protein, 472 aa, Oceanobacillus iheyensis HTE831
MQSYKMFVGGKWFGNNLEQIDVINPATNEQIGTIPNGGKEEAKQAVDAAHNALKEWSARTAEDRSNYLVKWHELIKEERETIAKIMTEEQGKPLKEAIGEVDYANGFISWYAEEGKRIYGDIIPASHTNKRIFVQKKPVGVVAAITPWNFPAAMITRKVGPALAVGCTVVIKPATQTPLTAFKLVELAEKAGIPRGVINIVTGSSSQIGKVWNDDGRVRKLTFTGSTEVGKILMKDAANTMKKISLELGGHAPFVVMEDADLDKAVAGVIASKFRNAGQTCVCTNRVYVHESIKDIFQDKLTEAVSKLKVGNGLEEGINIGPLIDQSAVDKVDEQVKDAISKGGRVTFGGKSLRGLYVEPTIVVDATDDMLCMYEETFGPLVPVTTFRDEEEVIARANNSPYGLAAYVFTENIGRAIRISEALEYGIVGLNDGAPSTPQAPFGGFKESGLGREGGYYGIEEFLEIKYISLAF

SEQ ID NO: 16386 - protein, 507 aa, Oceanobacillus iheyensis HTE831
MSGNQEVDVLSGKHEELANKLDDIKLYINGEFMDAEDRGTFDNISPFSNEKINSVASGQAADIDKAVQSAKKAFKGEWGNLKQVERLEYVYKIGDLIEQHTDEIAILESLDTGLPISQTRKQVSRSANNFRFYADTVKSQMYGEVYQVDDEFINYTVRSAVGVAGLITPWNAPFMLETWKIAPALATGNTVILKPAEWSPLTANRMAEIIDQAGLPDGVFNIVHGFGETAGDALVKHPDVQLISFTGETTTGSTIMRNGADALKRFSMELGGKSPIIVFEDADLERALDAATWGIFSFNGERCTANSRLYLHESIADEFIEKLKQRVWNIRVGDPLENNTQIGPLIKTEHYNNVKKYLKIAEEEGCEIISGVIPKELNRGNYVAPTILLNASNEMRVVQEEIFGPVIAVMTFNDETEVIEKANDVRYGLAGYVWTNDMKRGHRVAHAIDSGMLWVNSQNVRDLRTPFGGSKDSGIGREGGHYAFEFYTEQKIIHVAIGDHHIPQFGK

SEQ ID NO: 16387 - protein, 484 aa, Oceanobacillus iheyensis HTE831
MEKRTTLKKTLKPHWVWAIALGSSIGWGAFVQPAAWMGTAGPLGAMIGFGIGGLLMMLIAVSYGFLIKSFPVSGGEFAYAFISLGRTHAFISGWFLTLGYICIVALNASALALMFKFVFPSVLENFYMYQIADWDVYGMEIIIASIALIIFGYLNIRGGGFTGSAQFIFCIIMVGGVLLLTTLVGINPSADISNVAPLFPSDKTAIAAILSIVAIAPWAFVGFDNIPQAAEEFNFSSKKAFRLIILAILFATILYCLMIFATAMAQPWEGLVAAGHNWGTAEALQDILGTVGVAILAIALLMGIFTGLNGFIISTSRLLFAMSRAKFIPRSFSKLGKNETPYISIIFTVIVAMVAPWFGRQALTWVVDMSSVGVTIAYFYTCYTAFSLFKWNDNHGFNTNKHVVAPGKKIFALLGMVASISFLGLLLIPGSPAFLGLESRIALVVWIVLGIIFYIMKYKDYKNLDKEEMNYLILGSKEIKVKKD

SEQ ID NO: 16388 - protein, 401 aa, Oceanobacillus iheyensis HTE831
MTDKKKVNVGTEAVWAGEKEYLVHGATQVPVVLSVAYNYDDMDEWYDVAIGKKKGHIYGRNTNPTVQAFEDKVKQLEGAEAATSFSTGMAAISNTLSTFLLPGDRIVSIKDTYGGTNKIFTEFLPRQQVEVTLCETGDHEQIEKEVNKGCKILYLESPTNPTVKITDLKKMAEVGKRAGAIVIVDNTFGTPINQNPLALGADLVIHSATKFLGGHADALGGVVCGPEDYVEQIYHFREINGATMDPMAAYLTLRGMKTLHLRVREQSFNAMQLAKFLQQQDIVEEVFYPGLTTHPNHDIAKEQMKDFGGMLSFSVKGGVDTVRELLPKLQYAHRAANLGAVETTVGPARTTSHVECTPEERAAMGIPEGLIRVSCGIEYIDDILEDFAQAFAHIENSLEIS

SEQ ID NO: 16389 - protein, 392 aa, Oceanobacillus iheyensis HTE831
MKYKHMETSVIHEGYDSTQMLGSLTPPIFQTSTYTFDSAEQGEARFAAEEEGYIYSRLGNPTVRILEEKIAALEGGERGLAFSSGMAAVSAILFALTKANDHIICSSGLYGCTYGLLSMMKEKYNIKTDYSNMSSEQELENQITKETVLIYVETPINPTMQVIDLELVVKVAKKHQLLVVVDNTFSSPYLQRPLEIGCDFVIHSATKYISGHGDVIAGLAVGKKDIMDTIALTTQKDIGGVLSPFDAWLLIRGLKTLPLRMDRHSSNAEKIVQQLKLHKAVKNVYYPGDPDFSNVAITNKQMKLAGGVLAFEINGGKKEAQKVLNQLHFIKIAVSLGDAESLMEHPASMTHAVIPVEEREKMGITESLLRLSVGIEAWEDIWEDIQQALDNI

SEQ ID NO: 16390 - protein, 446 aa, Oceanobacillus iheyensis HTE831
MSNKQYDFTQGSIAKQLFYFSGPILLANLLQTSYQFIDSLWVGNLLGASALGAVAISGTILFVVLSFIIGMNNAALTILSQQKGKQNENGLRKYLNAFVVLLTLISIFLGVIGYIFAGQFLGLLGTPESMMDDATTYLRINFIGIWFLFGYNFISTVLRSLGDSKTPLYFITIAVGLNIVLDPLFISVFDWGIEGAAYATLLSQGFSFLCGISYVLWKKLAPFSLPTLPTKKEIKLILHLGIPSGLQMAVISAGSAAIMSVVTTHGESVVAGFGAAQRLDSLLMLPAHALSTSVASMAGQNIGIKNWKRIRQIAIYGVIYNFAIMLVIGIAVAVFAKYGIRLFIRESDAVDFGTVYLQIVALCYPFLGINFILNGIVRAAGAMYQVLILNVISFWVLRYPLTAMFSSWFGEVGIGIGMGGSFVISSLFAILYYRYGKWRQKELFVD

SEQ ID NO: 16391 - protein, 494 aa, Oceanobacillus iheyensis HTE831
MGKQTGFMEYERQTRPGRNPQERVKDWNDYTAPMSDEEVQKQGARCMDCGVPTCHQGIEIAGVTSGCPVYHLIPEWNNLVYEGKWREALDKEHQMNNFPEFTGIACPAPCEGACVLGINEPAVAIRTVERSIIEKGFEEGWVVPNPPKIRTGKRVAIVGSGPAGLAAADQLNKAGHSVTVYERDKRVGGLLTYGIPEMKLSYDIVIRRVSILEQEGIEFITNTEVGKDITNEELQETYDSVVLCGGASLHRDMPVEGSQLKGVHPAMDFLHANVESLLDSNLEDGSYISAKDKNVIVIGGGDTGTDCLATSVRHNCKSLTQFDIYEKRNLLRDEEANPWPQYPKIHRVEYGQKEAEAQFGEDPRAYAVQTTKFVGDENGHVKEVHTINVKTRYEGGKKIREEIPGTEKVWPADLVLVAIGFQGPDQDLIESLDVETTTRSTVKAKYGEFQTNIDGVFAAGDMRRGQSLIVWAINEGRGAARECDRFLMGDTILP

SEQ ID NO: 16392 - protein, 465 aa, Oceanobacillus iheyensis HTE831
MNSIGVFGLGVMGANLAMNMANKGEKVAVYNYTSDLTEKFKSNFTSDNAEAHYDLERFVNSLEKPRKVFLMVTAGPVIDSVIDSLVPLLDKDDIMMDGGNSNFNDSNRRYHRLKEAGIHFVSVGVSGGEEGALHGPALMPSGDEKVYQEVAPILEKIAAQVDGKACCGYLGKEGSGHYVKMVHNGIEYADMQLITEAYQFLRERLGLSVEEIATTFREWNEGELESYLMEITSDILTHVDEETNKPMVDVILDKSGQKGTGKWTSQNALDVGVPLSIITESVFARFLSGLKEERVRADQMLSGPTKLDQDLDKQAWLELVRKALFMGKICAYAQGFHQYKQASEAYGWDLKLEEIALIFRGGCIIRAGILNEISDAFKADKQLPNLLLSPFFQEKMNDYQASLRKVVIKGMESGLSLPSLGASLTYYDGYRSSQSGANMIQAQRDYFGAHTYERVDKKGTFHTAW

SEQ ID NO: 16393 - protein, 433 aa, Oceanobacillus iheyensis HTE831
MVRKQGNMKWWQLSLVGIGCTIGTGYFLGSSIAIEQSGAAVLWLFLFAAIGTYFVYESLAKLSIEYPDKGSFRTYAKKAFGDWAGFSNGWVYCLSELLIMGSQLIALGIFTRFWFPNLPLWLCMVIFAVLGLAIILTGLAGFEKMENIFGIMKASAIIMFILVAVLLLVKGTESLINPIPHIFSGDLPSIWWGGFIYAFYAFGGIEIMGLVATDLKNKQEALKAGRWMLLGLGSIYIIALGLALAFIDETKIIADESPFITALQPFDIPLIADVFNGVFIIAGFSTMVASLYAIITILVSLSEDHHAPAFLSKKGRLKIPFPAFVCLIVGLFVSIFIALLLPDRIFEYITTAAGLMLLYNWLFILASFMKLQRPTRWNFMKPIIAGVLIIIAVATTLFAEISRIGFFVSIGFIIMIAIAVLMMKEKWHITSSS

SEQ ID NO: 16394 - protein, 455 aa, Oceanobacillus iheyensis HTE831
MKVAVIGCTHAGTTAIKNIVNLYPDAEIDVLERNDNVSFLSCGIALSVGGVVENPEDLFYASVPQFERLGVRMHMNHDVISCDVTAKQLQAKDLKTDTIKNYSYDKLIIASGSWPITPPIPGADLENVLLCKNYDHAKEIINRSASVRNVVVVGAGYIGVELVEAFEENGKNVTLIDSEERILNRYLDDIFTEPVEASFEQRGVQLALGQTVSQFEGEETVEKVITDKGEYAADLVVMCIGFRPNTGLFNNQLDMLGNGAIVVDAYMQTSVKDVFAAGDCCAIYNNATKQSAYIPLATNAVRMGTLVAHNLVRPVMAHPGTQGTSGLKLYHHNIASTGLTESAASLSGVSVDSVVYKDNYRPDFMPENAEIQLKLVYETETHRIVGAQVISDADFTQAINTISVGIANNMTVEQLALTDFFFQPHYNKPVNFLNEVALKAMAKKAGKTQKQAVLS

SEQ ID NO: 16395 - protein, 373 aa, Oceanobacillus iheyensis HTE831
MNANNHDMFSPLTFKNGLELKNRLVMAPMTHYSSNPDGTVSDEEISYYARRSKGVGMVITATTYVTPNGKGFPNQFSAVEDGMIPSLSKLAKGIQNEGAKAILQIFHGGKMCPPSLIPDGDVVSASNIPANSEAAEPRPLKESEIEEIIEAFGETTRRAIEAGYDGVEIHGANGYLLQQFFSPFSNRRDDRFGGSLEKRMAFPLAVIEKVKSVVAEHADASFIVGYRFSPEEPETPGITMDETLQFVDVLADKQLDYLHVSLMDFFSKARRGVEDLNKTRISYLLETIDNRVPLIGVGSIYTAEDARKAFNTGIPLLAIGREIIIDPDWVEKVAEGRDDEIITEINKDKQEELVVPDPLWNVITHAPGWFPGV

SEQ ID NO: 16396 - protein, 345 aa, Oceanobacillus iheyensis HTE831
MIELTNITKTFAGKQGDIQALKDVSLSVGKGEIYGVIGYSGAGKSTLIRCVNLLEQPDQGSVKVNDVELTTLKSGKLRETRSHIGMIFQGFNLLKTATVYDNIAIPLKLTGLNKKAVKDRVQKYLDIVGLADKHDAYPSELSGGQKQRVAIARALSHEPEVLLSDEATSALDPDTTEAILDLLLRINKELGITILLITHEMNVIQRVCDRVAVMENGEVIEEGYTKDIFISPQLRTTKRFVNSLFSHDIPDDLIDGLSENGQVAKLSFFGESSGDPALALVTKKYDIYPNILSGSITRIKDEAFGQLLVHFKGEQAEINDSFQFLQDQQVHVKGVTYDGENQRVS

SEQ ID NO: 16397 - protein, 429 aa, Azotobacter vinelandii
MSRSETLFANAQKHIPGGVNSPVRAFRGVGGTPLFFKHAEGAYVIDEDDKRYVDYVGSWGPMILGHAHPDVLEAVRRQLEHGLSYGAPTALETEMAELVCSLVPSMDMVRMVSSGTEATMSAIRLARGYTGRDSIIKFEGCYHGHSDSLLVKAGSGALTLGVPSSPGVPAAFAKHTLTLPYNDLGAVEKTLAEVGREIACIIVEPVAGNMNCVPPAPGFLEGLRAQCDQHGVVLIFDEVMTGFRVALGGAQAHYGVTPDLSTFGKIVGGGMPVGCFGGKRAIMECIAPLGPVYQAGTLSGNPLAMAAGLTTLKLIGRPGFHRELAEYTGRLLQGLQERADAAGIPFVTTQAGGMFGLYFSGADEIVTFADVMASDAERFKRFFHLMLDGGVYLAPSAFEAGFTSIVHGETELSITLEAAERAFATLAKA

SEQ ID NO: 16398 - protein, 342 aa, Azotobacter vinelandii
MAQTMKAAVVVEFGKPLEIREVPVPTPGPGQLLVKIAACGVCHTDLHAAEGDWPVKPEPPFIPGHEGVGQVVAVGAGVGHVKEGDRVGIPWLHSSCGHCEHCLGGWETLCLAQSNTGYSVNGGFAEYALADAEYVGHLPDNADFIEIAPILCAGVTVYKGLKMTDTRPGQWVAISGIGGLGHMAVQYARAMGLNVAAVDVDDAKLELARRLGASLTVNARDQDPTAFLHKEIGGMHGVLVTAVSPKAFEQALGMARRGGTVALNGLPPGEFSLSIFDMVLNGTTVRGSIVGTRLDLQEALDFAGQGKVRATVASEPLENINDIFARMHKGQIEGRIVLDLAA

SEQ ID NO: 16399 - protein, 499 aa, Azotobacter vinelandii
MQASNDTRSNYAPDSSYGLFIDNQWVAGENGETITILNPANGKTLTGIPNATAVDVDRAVQAAQRAFEAWRSTTPIERANALLKIADLLEADAERFAALESLDVGKPIRESSSVDIPLAIDHFRYFAGVIRSHSDEAVMLDEQTLSIVLSEPLGVVGQVIPWNFPLLMAAWKIAPAIAIGNTVVIKPSELTPVSILELAKIFAQVLPAGVVNIVTGTGASAGQALLDHPDVRKLAFTGSTSVGHRVADAAAKKLIPATLELGGKSANIVFPDANWDKAVEGAALAILWNQGQVCESGARLFVHESIYERFLDEVKQKFEAVRVGDPLHPDTMMGAQVSKTQMERILGYVDIAKQEGAKVLLGGGRLTGADYDAGFFIQPTILVDVRNDMRVAYEEIFGPVLCVIPFKDEADVIAMANDSEYGLAGAVWTQDINRALRVARAVETGRMWVNTYHEIPAHAPFGGYKKSGLGRETHKSILEAYSQKKNIYVSLNEAPLGLF

SEQ ID NO: 16400 - protein, 323 aa, Azotobacter vinelandii
MSIEIRNVSKHFGAFQALNDINLDIHSGELVALLGPSGCGKTTLLRIIAGLETPDSGNIAFHGEDVSGHDVRDRNVGFVFQHYALFRHMTVFDNVAFGLRMKPRRERPSEQIIADKVHELLAMVQLDWLADRYPEQLSGGQRQRIALARALAVEPKILLLDEPFGALDAKVRKELRRWLARLHEEINLTSVFVTHDQEEAMEVADRIVVMNKGVIEQIGAPGEVYEHPASDFVYHFLGDSNRLHLEGGHILFRPHEVLLSREAVAEYHGAEVRDIRPLGAITRVTLKVDGQNELIEAEVVKDHDTLVGLERGERLFIKPKASA

SEQ ID NO: 16401 - protein, 326 aa, Azotobacter vinelandii
MKKNVFVFSRLAPEHQARLRQHFNVSLLDPDGDIAAQYAAALPEAHGLLGVGRPFGRAQLEPARRLEAIASISVGYDNYDLTYLDERDILLTNTPDVLTETTADLGFALLMSAARRVAELDAWVKAGHWQAAVGPALFGGDVHGKTLGILGLGKIGAAIARRGRFGFGMPVIYHGNGRKPELEAELGAGYRSLDELLGEADFVCVVVPLSERTRHLIGRRELALMKPSAILINIARGPVLDEAALIEALRDRRIQAAGLDVYEKEPLKDSPLFALPNAVTLPHIGSATHETRRAMAERAIDNLERALLGGTPRDIVNPQVWARRQA

SEQ ID NO: 16402 - protein, 458 aa, Azotobacter vinelandii
MSTPLALPGEAAASGRAPVPKTLDVQAFIDSRPLGLYQWRIVLLCFLIVFLDGLDTAAMGFIAPALVQDWGIDRASLGPVMSAALIGMVFGALCSGPLADRFGRKGVLVGSALLFGLFSLASAYSDNVGELVVLRFLTGLGLGAAMPNATTLLSEYTPVRHKSLLVTSMFCGFNLGMAAGGFVSAWMIPAYGWHSLLLVGGVLPLLLALVLLFWLPESARYLVARGHDVGRVRRVLRPIGEEAAQARGFSIPEQRTEKAGGVFAVIFGGTFRVGTLLLWLTYFMGLVIVYLLTSWLPTLLRDSGASMERAAFVGALFQFGGVLSAVAVGWAMDRMNPHKVIGLFYLMAGLFTFAVGQSLGQTALLATLVLLAGMSVNGAQSAMPSLAARFYPTHGRATGVSWMLGIGRFGAILGAWIGATLLGLGWTFEDVLGALLLPAGIATAAILIKGLVSHADAT

SEQ ID NO: 16403 - protein, 269 aa, Azotobacter vinelandii
MPSNDSCAPLIALRDLHLSFADTRVLRGIDLDVQRGQAVSIIGPSGSGKSTLLRCITGLLRPQRGQIRVGDTAVHELRSDAEFIALRKRVGFVFQQYNLFPHLSVLENLTIAPCKVLGRERREAQDEARRLLGKVRLEHKEHAYPGELSGGQQQRVAIARALAMRPELILFDEVTSALDPETVGEVLRTIRELIEEGMTCVLVTHEMRFAEEISDAVYFTEHGVIVEHGSPRQLFNEPRSPRTRAFLQHALGRGERERRPLVPAGAAAR

SEQ ID NO: 16404 - protein, 283 aa, Azotobacter vinelandii
MSDLNALLHSRSFVELGARQRVAALLDRGSLRELLDPFARIKSPWLEAQGIVAQADDGVVVAKGTLGGRPAVVAAIEGNFQGGSLGEVGGAKIAGALELAAEDNRNGIPTCAVLLLETGGVRLQEANLGLAAIAEVQAAIVELRQYRPVIGVVAGPVGCFGGMSIAAALCSHLLATREARLGLNGPQVIEQEAGIEEYDSRDRPFIWSLTGGEQRFACGLVDAYVADDAQAIRERLLGILEGPGDAPPRSRQYRRFLDLLGRVDTRPQADAAAVRALYQGDQP

SEQ ID NO: 16405 - protein, 459 aa, Azotobacter vinelandii
MPPEPRLRRLRRELRALADLALPIVVAQLAQIAMGFVDTLMAGRVGPEALAAVALGNSFWVPAYLLSTGILLATTPRVAHLRGAGRQPEIGPLVRQALWLALAAGSAAALLLWNVEPALHLMRVEASLIEPTMGYLRAVACGIPAVALYYVLRCFSDGLGHTRPSMLIGIAGLLLNIPANYVFIHGKLGLPAMGGVGCGWATALVMVFMLLAMLFWVRHAPHYRPSRLFERFDRPCWPELRRLLAVGLPIGVAVFAEASIFSVIALLIGGLGAQVVAGHQIALNFSGLVFMVPYSLGMAVTVRVGHALGRGSPRDARFSAGTGIIAALGFATLAAGLMLLLRERIPHIYSSDPAVIAIASSLLLYSALFQFSDAIQVTAAGALRGYQDTRAIMSITLLAYWGVGLPIGYGLGLGGWLDESSGPRGLWQGMVIGLSCAALLLGARLIRSARRHIHGPAAA

SEQ ID NO: 16406 - protein, 269 aa, Azotobacter vinelandii
MSRLQTRFAELKQADRAALVTFVTAGDPDYETSLAILKGLPEAGADVIELGMPFTDPMADGPAIQLANIRALGAGQNLVKTLRMVRAFREGDRTTPLVLMGYFNPIHYYGVERFIAEAREAGVDGLIVVDLPPEHNEDLCDPAQAAGLDFIRLTTPTTDDKRLPRVLAGSSGFVYYVSVAGVTGAHAASLEHVEQAVARLRRHTDLPLCIGFGIRSPEHAGSVARLAEGVVVGSALVDRIAKAGSKEQAVGDVLGLCRELAEGVRRARR

SEQ ID NO: 16407 - protein, 349 aa, Azotobacter vinelandii
MVVKAYGAYAGDKPLEPLEITRRPPGPHDVQIDITYCGICHSDLHQVRAEWAGTRFPCVPGHEIVGRVSAVGAHVSDFRAGDLVGIGCIVDSCRHCEECDAGLENYCDGMVGTYNFPTPDEPGWTLGGYSQRIVVHEGYVLRIRHPEDQLAAVAPLLCAGITTYSPLRHWQAGPGKKVGIVGIGGLGHMGIKLAHAMGAHVVAFTTSASKREDAKALGADEVVVSRNPGEMAAHAKSFDLILNTVAAPHDLDAFLSLLKRDGTLTLVGAPASPHPSPDVFNLIFKRRSIAGSMIGGIPETQEMLDFCAEHGIVADIELIRAEQINEAYERMLRGDIKYRFVIDSATLAG

SEQ ID NO: 16408 - protein, 266 aa, Azotobacter vinelandii
MSAGAPSREALIRVRGLVNSFGQQTVHDGLDLDIRRGEILGVVGGSGTGKSVLLRSIVGLHRPSAGRIEVFGEDLLALPPLRRSRLERRFGVLFQQGALFTSLNLEENVALPLIEHAGLTRPEAEHLARLKLALAGLPANAAGKYPDELSGGMIKRAALARALALDPEVLFLDEPTAGLDPIGAAAFDRLILTLRDALGLSVFLVTHDLDTLYTSCDRIAVLAQKRVLVEGRLETVAATDDPWIREYFHGPRGRAARQAAELQETP

SEQ ID NO: 16409 - protein, 511 aa, Azotobacter vinelandii
MTATPKPLVLIILDGFGHSDSPAYNAIHAARTPVYDRLLATCPHGLISGSGMDVGLPDGQMGNSEVGHMNLGAGRVLYQDFTRVTKAIQDGEFFDNPAICAAVDHAVAAGKAVHILGLLSEGGVHSHQDHIAAMAELAARRGAEKIYLHAFLDGRDTPPRSAQGPIEALEATFERLGKGRIATLIGRYFAMDRDNRWDRVEQAYRLIVDGKAEYAAETAAAGLQAAYARDESDEFVKATAIGAPVRVEDGDAVVFMNFRADRARELSRTFVEADFKEFERPHVPRLAGFVTLTQYSASIPAPCAFPPTELTNVLGEYLANNGKTQLRIAETEKYAHVTFFFSGGREEPFAGEERILIPSPQVATYDLKPEMSAPEVTERMVEAIENRRYDVIIANYANGDMVGHTGVFEAAVKAVECLDASLGRIVAALEKVGGEALITADHGNVEQMRDESTGQAHTAHTCEPVPFIYVGKRALRIRAGGVLADVAPTMLKLLDLPQPREMTGRPLVEPA

SEQ ID NO: 16410 - protein, 410 aa, Azotobacter vinelandii
MKIVIIGNGPAAISAAETLRARDRGCEIVMLSRERVPFYSPCPLAEYVEGSVSRERLFLRDADFYARNAIDIRYGSPVRRIEPSARRVWSGDEAVAYDRLLIASGSRAFVPPIPGLAGARGVFELKTLDDAEGILRRLAVARRAVVVGSGFIGLEATQALVRHGLEVTLLEAREHVLPAMLDSEMAALVERRLVEHGVRVRTGCAVERVLEGADGVRAVIADGDEIPCELLVCAAGVRADLSILEGSGIASERGILVDARMRTNVEHIFAAGDIIERPDAPEKNRVAPNWPNAVSSGRIAACNMLGIDRRHPGLEAVNVVRVFDMPIASFGVQTGETCLRWQDGAGAVRKVLLESGRVAGGQLIGEINGAGVLHEMMKKGTAVERFGTHLVHPGFGYIHTMEPLRAVKWA

SEQ ID NO: 16411 - protein, 158 aa, Azotobacter vinelandii
MRDPLFGIPLDDQPRTLADFPGRAWLVVNTASRCGFTPQYEGLQMLWQRYRERGLVVLGFPCDQFGHQEPGNELEIAEFCQLRYGVDFPLFQKVEVNGPRAHPLFVELKKRAPGLLGSQRVKWNFTKFLIGREGRVVRRFAPATGPRELCGEIEALLE

SEQ ID NO: 16412 - protein, 379 aa, Azotobacter vinelandii
MLFTAYRLGNLDLPNRILMPPMTRSRAGAGNVPTALMAEYYAQRASAGLIVSEGTQISQQGQGYAWTPGIHSRQQVAGWRGVTDAVHAAGGRIFAQLWHVGRISHVSLQPNGAAPVSSSPLLADGVKVFIDPEGRGPRAGVGEMVQHSAPRALSEAEIAQVVRDFAAAARHALEAGFDGVELHGANGYLINQFIDSRANTRSDGYGGSLSNRLRFLREVTEAVVAVAGRGRVGVRLAPLTTLQGAVDDTPQATYLGAAKLLDDLDVAYIHIAEADWEDAPDMPVAFKEALRLIYGGTLIYAGKYTLERAEAALRDGWADLIGFGRPFIANPDLPRRLRHGWPLNEPDASRFFGGAVAGYTDYPFATQDGQAAAMEEDVR

SEQ ID NO: 16413 - protein, 209 aa, Azotobacter vinelandii
MAHQTTASTCCYCGVGCGVLIEHDGEQITGVAGDPAHPANHGRLCSKGSTLHLTGDLAARALHPELRSGKALPRDRTDWDNALDHAAAVFAETIREHGPDSVAFYISGQLLTEDYYAFNKLARALVGTNNIDSNSRLCMSSAVVGYKRSLGADAPPCAYEDVEQSHCLLIAGSNMAYAHPVLFRRLEAAQGPPSRDEDHRGRSATHRYL

SEQ ID NO: 16414 - protein, 403 aa, Azotobacter vinelandii
MNTSFWKAGHTPTLFAAFLYFDLSFMVWYVLGPLGVQIATDLGLSTQQRALMVATPILSGAVLRFVMGMLADRTSPKSAGILGQAIVIAALGLAWSMGIHNYEQALLLGLFLGFAGASFAVALPLASQWYPPQHQGKAMGIAGAGNSGTVLAALFAPGLAGAFGWNNVFGLALIPLVLTLVIFAGVARNAPERPQPKAVADYLKALADRDSWWFMLFYSVTFGGFLGLASTLPGYFHDQYGFDPVKAGYYTAACVFAGSLLRPLGGALADRIGGIRTLLVMYTLAALCIAVVGFNLSSSSAALALFVVAMLSLGAGNGAVFQLVPQRFRKEIGVMTGLIGMAGGIGGFALTAGLGAIKQSTGDYQIGLWLFAALGVIAWIGLHGVKKRWRTTWGSAAVTAARV

SEQ ID NO: 16415 - protein, 446 aa, Azotobacter vinelandii
MHTDSPVEVKHWIDGQPLCRRQWLILALCFFIVLFDGMDVAVMGFIAPALMQDWQLSKAAFGPVMSATMVGLALGALVAGPYADRFGRRKVLLGAVTVFGILSLASAFARNPYELAILRFLTGVGLGAAMPNTTTLLSEYLPERYRSLLITVMFTGFNLGSGGAGFVAAWVIPQYGWHGVLLVGGLLPLALLPLLWLFLPESARFLVANNAPAERIAKLLNKLGGQFGPATRFVTAEQPVRHKAPVRRLFSEQYRLGTFALWVTYFMGLLVIYLTMGWLPTLIRESGISIERAATVTGLFQIGGTVGAIAVGWIMDRHSPNRVIATAYALGGAFILLLGVLGLESELLTVGVLAAGFCISGAQTGLNAFAPGYYPTESRATGVSWMLGIGRFGAIFGAMIGGLILSLGLGFGLIFGALAIPAFIAALAILLNGYASRRLPRTALAL

SEQ ID NO: 16416 - protein, 403 aa, Azotobacter vinelandii
MTIEWDAGRLDSDLEGAGFDTLAVRAGQRRTPEGEHGEALFMTSSYVFRSAADAAARFAGEQPGNVYSRYTNPTVRTFEERIAALEGAEQAVAAASGMGAILAMVMSLCSAGDHVLVSRSVFGSTISLFDKYFKRFGIEVDYPPLADLEAWAAACKPNTRLFVVESPSNPLAELVDIAALADIAHARGALLAVDNCFCTPALQKPLALGADIVIHSATKYIDGQGRCLGGVVAGSAKLMQEVVGFLRTAGPTLSPFNAWLFLKGLETLRVRMQAHCASAQALAEWLEQQPQVVRVHYAGLSSHPQHELARRQQSGFGAVVSFEVRGDKAAAWRVIDNTRMISITTNLGDTKTTIAHPATTSHGRLTPEARAAAGISDSLIRVAVGLEDIEDIKADLARGLSAL

SEQ ID NO: 16417 - protein, 481 aa, Azotobacter vinelandii
MQRRTKIVATLGPATETPEAIEGLVKAGVDVVRLNFSHGKAEEHQARAARVREMAAKHGRFVAILADLQGPKIRISRFADGKVLLEKGQTFVLDAALDKNAGDATRVGIDYEALITDSRPGDILLLDDGRVVLETREVKASELVCAVLVGGPLSNNKGINRQGGGLSASALTDKDCADIKTAAAMQVDYLAVSFPRDAADMQHARRLMQEAGGNAGLVAKIERAEAVADDQVLDGIILASEAVMVARGDLGVEIGDAELVGVQKRIIERARVLNRAVITATQMMETMITQSLPTRAEVFDVANAVLDGTDAVMLSAETAAGAYPVETVEAMGRIILGAEQHPLAHRSKHRMDQVFHRIDETIALSAMYAANHLEGVKAIVCLTESGDTPRLMSRIRSHLPIYAFSRHPRTQSRVALFRGVHPIPFEADRIAEAELNARAVKELLQRRLVAEGDLVLITKGAGHAQGGTDTLRIVRVGDVIH

SEQ ID NO: 16418 - protein, 296 aa, Azotobacter vinelandii
MAKIGFIGTGIMGKPMALNLRKADHDLVLSRHHGEPPAELLENGAVVLANPREVAREAEFIIVMVPDTPHVEDVLFGKDGVAEGVGSGKVVIDMSSISPTATKVFAEKIRATGAAYLDAPVSGGEVGAKAATLSIMVGGCLDAFERALPLFQAMGKNITRVGSNGDGQTAKVANQIIVALNIQAVAEALLFAARNGADPARVREALMGGFAGSKILEVHGERMIKGTFDPGFRINLHQKDLNLALSGARELGLNLPNTASAQQVFSTCVALGGGDWDHSALIKGLEHMGNFSIREE

SEQ ID NO: 16419 - protein, 396 aa, Azotobacter vinelandii
MFKIPQGFSTRAVHAGNEIDRQMVTHAKTLPIYQTSVFVYDSLAQVDDFLAGNPDNYMYTRIGNPNPAALEALILALEGGEAALFGASGMAAIGAALLGNLEAGDHLIASRELYGTTQSLIEKELGRLGIASSLVDIGDLAAVEAAIGPRTRLIYTETASNPLVRVSDVPALATLAKKHGLKLLVDNTFLSPALFRPLDHGADLVLHSTTKYLNGHSDATGGILAGDAEWVERARRFQINAGGSASPFEAWLTLRGAKTLALRMQAHSRNAQALAEALEAHPKVLRVHYPGLPSHPDHALARRLFPDGCSGMLSFTLDGGLAEVDRLIRALRLAVFAPSLAGVATSISHPGKTSHRALAPEVLAALDIHDGTVRVSVGIEEAGDIVDDFVQALERL

SEQ ID NO: 16420 - protein, 327 aa, Azotobacter vinelandii
MRAMLLERVGHPLVLRELPTPQPGPGEVRVRVGACGVCRTDLHVVDGELPAVNPPVIPGHEIVGRVDAVGPGVEGFALGQRVGIPWLGHTCGHCWYCRHEAENLCDAPQFTGYTRPGGYAEQVVADARFTFALGEDGDDVALAPLLCAGLIGWRSLVKAGPARRLGLYGFGAAAHIVMQVARWQGREVYAFSRPGDLAAQDFARSLGAAWAGGSDQLPPEPLDAAILYAPAGELVPTALRALRKGGRVVCAGIHMSDIPSFPYDILWEEREVVSVANLTRQDGLDFFAVAEQAGIRTETHRYALEDANRALDDLRHGRFQGAAVLVP

SEQ ID NO: 16421 - protein, 237 aa, Azotobacter vinelandii
MNRYGAEFLGTFWLVLGGCGSAVLAAAFPEVGIGLHGVSLAFGLTVLTMAFAIGHISGCHLNPAVSIGLWAGGRFPAKDLLPYIVAQVLGGIAAGAVLYVIASGTAGFDVTKGFASNGYGAHSPGGYSLLSALVTEVVMTLFFLLIILGATDKRAPAGFAPIAIGLALTLIHLISIPVTNTSVNPARSTGVAVFAGGWAIAQLWLFWIAPIVGALLGAAAYRLIAEQPGLASQPARG

SEQ ID NO: 16422 - protein, 244 aa, Azotobacter vinelandii
MISIRNVSKWYGDFQVLTDCTTEVRKGEVVVVCGPSGSGKSTLIKCVNALEPFQQGDIEVDGTSLAAPKTDLPKLRARVGMVFQHFELFPHLTVTENLTLAQIKVLGRGKAEATEKGLALLDRVGLAAHAHKHPGQLSGGQQQRVAIARALAMDPVVMLFDEPTSALDPEMVNEVLDVMVQLAQEGMTMMCVTHEMGFARKVADRVIFMDRGNIVEDCATEAFFGDIAARCERARQFLAKILPH

SEQ ID NO: 16423 - protein, 165 aa, Azotobacter vinelandii
MQRRTKIVATLGSATETPEAIEGLVKAGVDVVRLNFSHGKAEEHQARATLVREMAAKEGVKAIVCLTESGDTPRLMSRIRSHLPIYAFSRHPRTQSRVALFRGVHPIPFEADRIAEAELNARAVKELLQRRLVAEGDRVLITKGAGHAQGGTDTLRIVRVGDVIH

SEQ ID NO: 16424 - protein, 279 aa, Azotobacter vinelandii
MHDMRSPSLLGQCLAEFIGTALLIFFGTGCVAALVVGGASLGLWEISLIWGLAVSLAIYVSAGVSGAHLNPAVSIALCLFAGFDRRKLPAYILAQVAGAFCAAALVYGLYSNLFFDYEQSHQIVRGSPDSLALASVFSTYPNPLLSVGQAFAVETVITAILMAVIMALADDGNGLPRGPLAPLLIGLLVAVIGGSMGPLTGFAMNPARDLGPRLMAFLAGWGDIALTGGREVPYFLVPLSAPLLGACLGAAGYRGLIARHLPGRAGPEDTASPACKARV

SEQ ID NO: 16425 - protein, 349 aa, Azotobacter vinelandii
MSTLFDPIEIGDLQLPNRIVMAPLTRCRAEPGRVPGALMAEYYVQRASAGLIISEATSVCPTGVGYPDTPGIWSDEQVAGWKNVTQAVHAAGGRIVLQLWHVGRISDPLYLNGELPVAPSAIQPKGHVSLVRPQKAFETPRALETDEIPGLVEAYRQGAENARKAGFDGVEIHAANGYLLDQFLQDSTNRRTDRYGGSLENRARLLLEVTDAAISVWGAGRVGVHLAPRADLHDMGDSNRAETFSHVARELGKRGIAFICTREKEDADSLTPQIKQAFGGAVIANERFTKEQADRWLAESKADAVAFGVPFIANPDLPARLAADAPLNEAHPETFYSSGPQGYLDYPTL

SEQ ID NO: 16426 - protein, 483 aa, Azotobacter vinelandii
MTFRRTKIVATLGPASSSPERLEQLVLAGIDVARLNFSHGSADEHRARAHLVRELAAKHGRFVALLGDLQGPKIRIAKFVDKRIELAVGDHFRFSVTHPREAGTQEVVGIDYPDLVKDCNVGDELLLDDGRVVMQVLEKTADELHCKVLIGGPLSDHKGINRRGGGLTAPALTAKDKQDIKLAAELELDYLAVSFPRDAADMELARRLRDEAGGRAWLVAKIERAEAVADDAALDGLIRASDAVMVARGDLGVEIGDAELVGIQKKIILHARRYNKAVITATQMMESMIHSPMPTRAEVSDVANAVLDNTDAVMLSAESAAGEYPVEAVQAMARICLGAERQPTSTRSSHRLGQTFKRCDESIALAAMYTANHFPGVKAIISLTESGYTPLIMSRIRSSVPIFAFSPHRETQARAALFRGVYTVPFDPAAVAPEKLSQAAVDELLKRGVVEPGDWVILTKGDSYNTTGGTNGMKILHVGEPLI

SEQ ID NO: 16427 - protein, 371 aa, Azotobacter vinelandii
MTIKSRAAVAFGPNQPLQVVEVDVAPPKKGEVLVRIVATGVCHTDAYTLSGQDSEGVFPCILGHEGGGIVEAVGEGVTSLQVGDHVIPLYTAECRECKFCKSGKTNLCQAVRATQGKGLMPDGTTRFSYQGQPLYHYMGCSTFSEYTVLPEISLAKIPEDAPLEKVCLLGCGVTTGIGAVLNTAKVTEGSSVAIFGLGGIGLAAIIGAKMAKASRIIAIDINPAKFEVAGQLGATDFVNPKDHDKPIQEVIVEMTDGGVDYSFECVGNVQLMRAALECCHKGWGESTIIGVAGAGQEISTRPFQLVTGRVWRGSAFGGVRGRTELPSYVEKAQKGEIPLDTFITHNLPLERINEAFDLMHEGKSIRTVIHF

SEQ ID NO: 16428 - protein, 429 aa, Azotobacter vinelandii
MAKIVDIKGREVLDSRGNPTVEADVILDNGIIGSACAPSGASTGSREALELRDGDKARYLGKGVLKAVANVNGPIRDLLLGKDPADQKALDRAMIELDGTENKASLGANAILAVSLAAAKAAAKDKGVPLYAHIADLNGTPGVYSMPVPMMNIINGGEHADNNVDIQEFMVQPVGAKSFAEALRMGAEIFHNLKAVLKARGLNTAVGDEGGFAPNLSSNEDALAAIAEAVGKAGYKLGSDVTLALDCASSEFYKDGKYDLAGEGKTFDAAGFADYLAGLTQRYPIISVEDGMDESDWAGWKGLTDKIGAKVQLVGDDLFVTNTKILREGIEKGIANSILIKFNQIGSLSETLEAIQMAKAAGYTAVISHRSGETEDSTIADLAVGTAAGQIKTGSLCRSDRVSKYNQLLRIEEQLGAKAPYRGRAEFRG

SEQ ID NO: 16429 - protein, 398 aa, Azotobacter vinelandii
MNDALNLLQPYPFEKLRALLAGVQPPAGKKPIALSIGEPKHRSPSFVVEALAANLEQLAVYPTTLGLPALREAIARWCERRFRVPADRLDPARHVLPVNGTREALFAFAQTVVKRTGNGLVVSPNPFYQIYEGAALLAGATPHYLPCLPENGFNPDFDAVPADVWRRCQLLFLCSPGNPTGALVPLATLKKLIALADEHDFVIAADECYSELYFDEQNPPPGLLTACAELGRDDFRRCVVFHSLSKRSNLPGLRSGFVAGDAEILKSFLLYRTYHGCAMPVPTQLASIAAWSDEVHVRANRVLYREKFDAVLGILQPVLDVERPDGSFYLWPRTPVDDQVFTRDLFAREHVTVVPGAYLSRSVDGLNPGADRVRMALVAPLNECVEAAGRIRDFVRAG

SEQ ID NO: 16430 - protein, 368 aa, Azotobacter vinelandii
MSLLFEPLTLRQLTLPNRIVVSPMCQYSARDGLANDWHLVHLGSRAVGGAGLVIVEATAVVAEGRISAQDLGLWNDEQIEPLRRITSFIESQGSLAGIQLAHAGRKASVWQPWLGRPGSVPPEEGGWVPVGPSAIPFDPRHRVPEVLDEAGIREVVRAFVQAAERALAAGFKVVEVHAAHGYLLHQFLSPLSNQRRDQYGGSFDNRIRLLLEVTEAVRAVWPETLPLFVRLSATDWVEEGWNPEETVALTRRLKALGVDLIDVSSGGTAAAAEIPVGPGYQTRFAEQIRREAGIATGAVGMITEAAQAEHILRTAQADLILLARELLRDPYWPLHAADFLGDKAVPWPAQYVRAAHRDTPFRESGELD

SEQ ID NO: 16431 - protein, 489 aa, Azotobacter vinelandii
MLRISQEALTFDDVLLIPGYSDVLPKDVSLKTRLTRGIEINIPLVSAAMDTVTEARLAIAMAQEGGIGIIHKNMTIEQQAAEVRKVKRFEAGVLRDPITIDADATVRDLFELTRQHDISGVPVLSRGDLVGIVTSRDVRFETRLDARVREVMTPKERLVTVREGADKEEARQLLHKHRIERVLIVDDAFRLKGMMTVTDIEKAKAYPLASKDDQGRLRVGAAVGTGAETPDRVAALVAAGVDVVVVDTAHGHSRGVIERVRWAKLNFPDVQVIGGNIATGEAALALAEAGVDGVKVGIGPGSICTTRIVAGVGVPQISAIANVAAALQGTGVPLIADGGIRFSGDLSKAIAAGAYCVMMGSMFAGTEEAPGEVELFQGRSYKAYRGMGSLGAMAQSQGSSDRYFQDSSAGAEKLVPEGIEGRVPYKGALAAIIHQLMGGLRASMGYTGSADIEAMRTKPQFVRITGAGMAESHVHDVQITKEAPNYRVG

SEQ ID NO: 16432 - protein, 173 aa, Azotobacter vinelandii
MGNASHFALFDLEPDFRLDQDRLAVRYRELVRRVHPDRFAGAPEREQRLALEEAARLNEAYQTLKSPSQRARYLLSLQGEELSQETTVQDPAFLMQQMELREELQELQDSADLAGVARFKRRLVQDQEQLNEGFAACWADPRRRDEAERLARRMQFLDKLFAEVRQLEERLDD

SEQ ID NO: 16433 - protein, 1108 aa, Azotobacter vinelandii
MDQSLKSVAFLEDPFWYKDAVIYQVHVKSFFDSNNDGIGDFPGLIAKLDYIADLGVNTIWLLPFYPSPRRDDGYDIAEYRGVHPDYGSLADVRRLIAEAHRRGLRLITELVINHTSDQHPWFQRARQARKGSAARNFYVWSDSDDKYRDTRIIFLDTEKSNWTWDPVAGQYFWHRFYSHQPDLNFDNPQVMKAVLGIMRYWLDLGVDGLRLDAIPYLIERDGTNNENLPETHQVLKRIRAELDARYPDRMLLAEANQWPEDTQLYFGGAPEGKGDECHMAFHFPLMPRMYMAIAQEDRFPMTDILRQTPDIPSDCQWAIFLRNHDELTLEMVTDRERDYLWNFYAADRRARINLGIRRRLAPLLERDRRRIELLNSLLLSMPGTPVIYYGDEIGMGDNIYLGDRDGVRTPMQWSTDRNGGFSRADPAGLVLPPIMDPLYGFQSVNVEAQQRDSYSLLNWTRRMLAVRKQQKAFGRGSLRLLAPANRRIFAYLREYHGADGSSETILCVANVSRSAQAVELELPQFADMVPVEMTGGSAFPPIGQLPYLLTLPPYGFCWFLLAPASQMPSWHIKPTEGMPEFQTLVLRRLDDLLVDPNRRILEKEVLPAYLPKRRWFAGKGAPSGNVHIAYTVTFGNLPRPVLLSEIEVGGEGGPQRYQLPLGFLPEEEFGSALPQQLAMTRVRRGRRVGLLTDAFTLEGFVRATVQALRERRVLAFEQGELRFLPTAQLDKVELPADAEVRYISAEQSNSSAVLGNALVLKLIRRVSVGVHPELEMGLHLTGYGFANIASVLGEVCRVDAQGGCTVLMILQRYLENQGDAWEWTQNTLDRAIRDELAGGESTLESQYSALHELESFSRQLGQRLGEMHMALAAPTEDPDFARETAGPEQAAQWTESIGAQLGRALEILAQRQATLAEEERAAVEQLLLQRDALLEKVGELAGACVGSLRIRVHGDLHLGQVLVVQGDAYLIDFEGEPSRPLAARRAKHSPYKDVSGVLRSIGYAADMAMRNAQSVDSSEAADQARRRIASLYQANARQAFLAAYRQAAAEIGHAWAVPDGEEAALALFSLEKTAYEIAYEAENRPAWLAVPLRGLANLAQQLLDGEAQ

SEQ ID NO: 16434 - protein, 160 aa, Azotobacter vinelandii
MSAFHDLTLRGLDGQDLPLAQFRDKVVLVVNVASKCGLTPQYAGLEKLHLQYRERGFSVLGLPCNQFAGQEPDNEAQIREFCSLNYGVTFPLAAKLEVNGSGRHSLYRLLAGEGAEFPGDITWNFEKFLVGRDGRVLARFSPRTAPDDPALLQAIEKALG

SEQ ID NO: 16435 - protein, 453 aa, Azotobacter vinelandii
MAKAKRMYGCTECGATFPKWAGQCGECGAWNTLAETLLEGTATPSGRGGWAGQQASVRTLAEVSVEELPRFSTASKELDRVLGGGLVDGSVVLIGGDPGIGKSTILLQTLCNVAERFPALYVTGEESQQQVAMRARRLDLPLDRLKVMTETCIEAIVATARLEKPKVMVIDSIQTIFTEQLQSAPGGVAQVRESAALLVRFAKQSGIAVFLVGHVTKEGSLAGPRVLEHMVDTVLYFEGESDGRLRLLRAVKNRFGAVNELGVFGMTDKGLKEVSNPSAIFLTRAQEAVPGSVVMATWEGSRPMLVEVQALVDDSHLANPRRVTLGLDQNRLAMLLAVLHRHGGIPTYDQDVFLNVVGGVKVLETASDLALLAAVISSLRNRPLPHDLLVFGEIGLSGEIRPVPSGQERLKEAAKHGFRRAIVPRGNAPKEAPAGLAVIPVTRLEQALDALFE

SEQ ID NO: 16436 - protein, 323 aa, Azotobacter vinelandii
MFLVCGEALFDLFVDPAQSELPRQVGFKAIAGGSPFNVAVGLSRLGVESALLTGISGDFLGQQLRRVLEDEGVSTRYLVPLDAATTTLSLVAVDGQGVPHYSFYGHSGADRQLRPEQVPALDGGVRGIHVGSYSLVVRPTADSLQQLVERSSRELLISLDPNVRLNVEPDLDVWRERIGAFARHAHLVKVSEEDLLLLYPGQDPLATAEAFLQHQCRLVCLTRGEHGVTVFNRAHGSWSSPAQAIVPVDTVGAGDTFQAALITYLAEQGFDSPAALDALDRSHIERMLAFAQAAAALTCQRRGPDLPRRHELAMPAGQPAPVV

SEQ ID NO: 16437 - protein, 458 aa, Azotobacter vinelandii
MSVPARAVQLNEANAFLKEHPEVLFVDLLIADMNGVVRGKRIERTSLHKVYEQGINLPASLFALDINGATVERSGLGLDIGDSDRICYPIPDTLSKEPWQKRPTAQLLMTMHERDGTPFFADPREVLRQVVARFEELELTVCAAFELEFYLIDQENVNGRPQPPRSPISGKRPQSSQVYLIDDLDEYVDCLQDILEGAKEQGIPADAIVKESAPAQFEVNLHHVADPIKACDHAVLLKRLIKNIAYDHEMDSTFMAKPYPGQAGNGLHVHISILDKDGRNIFAGDDPRQNAALRHTIGGVLETMPASMAFLCPNVNSYRRFGAQFYVPNALCWGLDNRTVALRVPTGSADAVRIEHRVAGADANPYLVMAALLAGAHHGLAGRIEPGEPIEGNSYEQVEPSLPNNLRDALRRLDEDEILSRYISPDYIDVFVACKESELEEFEHSISDLEYNWYLHTV

SEQ ID NO: 16438 - protein, 497 aa, Azotobacter vinelandii
MTTPTRNDWEERARSLIIEGRAFVDGQYLPAADGATFDCLSPIDGRLLAQVASCAAADADLAVAAARRSFESGRWSRLAPAKRKAVMIRLAELLEIHREELALLETLDMGKPIKYSLSIDVPAAARALRWSGEAIDKLYGEVAATPDDELGLVTREPVGVVAAIVPWNFPLLMACWKLGPALASGNSVVLKPSEKSPLTAIRLAQLAFEAGIPPGVLNVLPGYGHSVGRALALHMDVDCLVFTGSTRVAKQLMVYAGESNMKRIWLEAGGKSPNIVFADAPDLAAAAEAAASAIAFNQGEVCTAGSRLLVERSIKEAFLPLVLEALKTWQPGHPLDPATNVGALVDRQQLDTVLGYIEAGLGEGASLLAGGRRILEETGGTYVEPTVFDGVSNAMKIAREEIFGPVLSVIVFDTPEEAVQIANDTSYGLAAAIWTRDLSKAHRTARALRAGSVWINQYDGGDMTAPFGGFKQSGNGRDKSLHAFDKYTELKATWIKL

SEQ ID NO: 16439 - protein, 426 aa, Azotobacter vinelandii
MSRTNESLMQRRIAAVPRGVGQIHPIFAEHARNCSVVDVEGREYIDFAGGIAVLNTGHLHPKVVEAVQRQLHKLSHTCFQVLAYEPYVELCEKLNARVPGDFAKKTLLVSTGSEAVENAVKIARAATGRTGVIAFTSAYHGRTLMTLALTGKKVPYAAGMGLLPGGVFRARYPSALHGIDVAEALASVERVFKNDAEPRDIAAILVEPVQGEGGFNVAPPEFMRGLRAICDRHGILLIADEVQTGAGRTGTFFAMEQMGVAADLTAFAKSIAGGFPLAGVCGRAEPMDAIAPGGLGGTYAGSPLACAAALAVLEVFEEERLLERARDIGARLSEGLRAIQGRHPSIVEVRGLGAMVAMELCEGGDPHKPATALTGQLVVRARDKGLILLSCGAYGNVLRFLMPLTVPDELLERGLAILAECFDELA

SEQ ID NO: 16440 - protein, 224 aa, Azotobacter vinelandii
MQPFAIAPSILSADFARLGEEVDRVLAAGADIVHFDVMDNHYVPNLTIGPMVCTALRKYGIQAPIDVHLMVKPVDRIIGDFLEAGASYITFHPEASEHIDRSLQLIRDGGARAGLVFNPATPLDCLKYVMDKLDMLLLMSVNPGFGGQKFIPGTLDKLREARALIDASGRDIRLEIDGGVNVKNIGEIAAAGADTFVAGSAIFGQPDYKAVIDAMRAELARVRP

SEQ ID NO: 16441 - protein, 452 aa, Azotobacter vinelandii
MPHDPPYLPAPGALLTDLYQLTMLQGYVERDMLDGAVFEFFARKPPACRNFYLAAGLEQVLDYLEQLHFTQGELDWLSGLGLFRPAFLDYLAGLRFSGEVQAMAEGTPFFADEPILRVVAPLPEAQLVESRLINLLHFQTLIASKAARLTLAASGRRLVDFGLRRAHGAEAGLLAARASYLAGFQASATVLAGAQFGIPLAGTMAHSFVQAHLDEAEAFEHFARSLPQSVLLLIDTYDTEAAARKVVELAPRLAAAGIRVQGVRLDSGDLGEHARRVRAILDRGGLGDATVFASGNLDEYEVRRLLAEGAPIDGFGVGTRLDTSSDAPYLDCVYKLQEYAGQPRRKRSEGKATWPGRKQVWRRYDDDGRCRGDSLMLEGETGEGQALIRPVMRDGRRLAPSPSLREVRAHALRQLDTLPAALRALEPAPPYPVAVSEALRDLAERADRLAGL

SEQ ID NO: 16442 - protein, 484 aa, Azotobacter vinelandii
MQLTDSTLLRTRAFIAGQWVDADDGATFVVTDPADLSPIGTVASLGAAETARAIAAAEAALPAWRAKTAKERSVLLRKWFELIMANREDLARLLSREQGKPLAESRGEIAYGASFIEWFAEEAKRTYGDVIPHDKQGRRLVVIRQPIGVVAAITPWNFPNAMITRKAGPALAAGCTIVIKPASETPLSALALAELAVRAGIPAGVINVVTGDPRVIGGELTRNPAVRKLSFTGSTGIGKLLMAQCADTMKKVSMELGGNAPFIVFDDADLDAAVAGALASKYRNSGQTCVCTNRLLVQEGVYDAFARRLVAAVKALKVGPACEEGAQLGPLINAKAVLKVQEHIEDALTKGARLLAGGKPHSLGGSFFEPTVLGEATPEMLVAREETFGPLAPIFRFRSEAEAIQMANDTEFGLASYLYTRDLSRAWRVSEALEYGMVGVNEGVISTEIAPFGGIKESGTGREGSKFGIDDYVELKYLCFGIDA

SEQ ID NO: 16443 - protein, 329 aa, Azotobacter vinelandii
MQKRKLGNSNLEVSSLGLGCMGLSHGYGPATDRSEAIALIRAAVERGVTFFDTAEVYGPYLNEEVVGEALAPMRDQVVIATKFGLTFGEDNKQQILNSQPEHIRWAVEGSLKRLRTDCIDLLYQHRVDPEVPIEDVAGTVKDLIAEGKVKHFGLSEAGVETIRRAHAVQPVTALQSEYSLWWREPEQEILPTLEALGIGFVPFSPLGKGFLTGAIKQGTTFGSDDFRSIVPRFSPEALQANQALVDLLGQIAQDKGVTPAQIALAWLLAQKPWIVPIPGTTKLHRLEENLGGASVVLSDGDLRQIANALEQVKIQGDRYPAALQARVGR

SEQ ID NO: 16444 - protein, 330 aa, Azotobacter vinelandii
MKTRKLGNQLEVSALGLGCMGMTAVYGPAADKQEMIKLIRDAHDRGITLFDTAEAYGPFANEELVGEALQPIRDQVVIATKFGFDIDPDTSARGAGTNSRPEHIKRVVENMLRRLRTDVIDLLYQHRVDPAVPIEDVAGAVKDLIAEGKVKHFGLSEAGVQTIRRAHAVQPVTAVQSEYSLFWRGPEAELLPVLEELGIGFVPFSPLGAGFLTGKIDESTQFDSSDFRNYVPRFSPEARKANLALVEVVKAVATHKNATPAQVALAWLLAQKPWIVPIPGTTKLHRLEENLGAVTLDLSAEDLAEIAAEVSKVQVQGERLPEAVLKMTGL

SEQ ID NO: 16445 - protein, 415 aa, Azotobacter vinelandii
MTRNDKHDPHGHGPADPQRRQLLATAAILGVAPWLLSACTAPSASTANTAAPAQPAGTGSATTTGILPTSQRRKLGALEVSSIGLGCQWVPAAVEGSVSDRYGSTIDRKTAINLIRTAVDSGVTLFDTAEAYGPYLSEEVVGEALQGVRDQVVIETKYGFSFDPKVAAARGGRDSRPEHIKQVVEGMLKRLRTDRIDLLYQHRVDPQVPIEDVAGAIKDLIAEGKVLNYGLSEPGIQTIRRAHAEHPLAAIQNEYSMLWRGPEAEVLPVCEELGIGFVPWSPMGMGFLSGTITAETRFVPDGDREFRVAVPRFAPDNLRANMALVEVVKTWAQRKNATPAQLALAWLLAQKPWIVPIPGTTKIAHLKENLGAAAITFSGEELRELNATVAAVPIQGDRLPPGVMQLSGVEAPPKR

SEQ ID NO: 16446 - protein, 394 aa, Azotobacter vinelandii
MHNSSAKLLIIDDDEVVRASLAAYLEDSGFQVLQAGNALLGLEVFENEEPDLVICDLRMPQIDGLELIRRMSEQQGETPVIVMSGAGVMSDVVEALRLGAADYLIKPLEDLAVLEHSVRRALDRARLRVENRRYREKLEVANRELQASLSLLQEDQNAGRQVQLNMLPETPWEVDGLCFAHKIIPSLYLSGDFVDYFRIDERRLGFYLADVSGHGASSAFVTVLLKFMTTRLLYEFRRNGAFPDFKPSDVLAHINRGLINCKLGKHVTMLGGLIDLAADRLTYCVGGHLPLPVFYSDGEASYLKGSGLPVGLFQDAHYENYELQLPASFSLTLVSDGVLDLLPGETLKEREAVLPDRVRAAGGTLDGLRQVLGLAQLGEMPDDIALLVLNRNLA

SEQ ID NO: 16447 - protein, 246 aa, Azotobacter vinelandii
MRGKLVIGNWKMNGSLDANRRLLQELLPPLAAVKGLEVAVCPPFPYLAQVGALLEGSSVALGAQNLHSAGQGAFTGEVGAGMLEELGCRYVLVGHSERRSLFGESDETVAEKFEAALRAGLVPVLCVGETLAQRRDGSTEAVIAGQVRAVLQRVGGAGIAAGVIAYEPVWAIGTGETASPEQAQAVHRHIRALLGEATATPILYGGSVKPDNAAALFAQPDIDGGLIGGASLEAASFLAICRAAQS

SEQ ID NO: 16448 - protein, 253 aa, Azotobacter vinelandii
MNMKRKQVIGNWKMNGDLAANRRLLDELLPSLAALDGVELAVCPPFPYLAQVAALLEGSGVALGAQNLNVAAKGAFTGEVSAGMLGELGCRYVLVGHSERRSLYGECDETVAEKFAVALRAGLVPVLCVGETLAQRRQGRTEALVSAQLQAVLRRSGIEGLAAGVIAYEPVWAIGNGETASPEQAQAVHRHIRDLLAQHDPARGVATPILYGGSVKADNAAALFAQPDIDGGLIGGASLEAAAFAAICQAAAR

SEQ ID NO: 16449 - protein, 464 aa, Azotobacter vinelandii
MNIAVADIEAATDEPPLYQLDENPLLARQARQESNARSYPRRIPLALKRARGIHVEDVEGRVFIDCLAGAGTLALGHNHPVVVEAIRQVLADELPLHTLDLTTPVKDRFVQDLFGALPAEFARRAKIQFCGPTGTDAVEAALKLVRTATGRSTVLAFQGGYHGMSQGALSLMGNLKAKTPLGALLAQGVQFLPFPYDYRCPFGLGGEQGVEVGLRYIANLLSDPEGGVQPPAAVIVEAVQGEAGAIPAADAWLRGLREITARAGIPLILDEIQSGFARTGRMFAFEHAQIVPDVVVLSKAIGGSLPLSVVVYRDELDKWQPGAHAGTFRGNQMAMAAGSAVIRHIQEHDLARHAEQVGEHLRGLLQALQRTYPQLGDVRGRGLMLGVEIVEPDGEPDALGHPPLDPALASAIQRECLKRGLILELGGRHGSVVRFLPPLIIRHEEVEQVAGIFARAVSAAVSAG

SEQ ID NO: 16450 - protein, 314 aa, Azotobacter vinelandii
MHEVDVLCFGETMAMFVAEDSGDLARVERFGKRIAGADSNVAIGLSRLGFKVTWLSRVGDDSLGRFVLDSLTREGLDCRHVRIDPAHPTGFQLKSRETDGRDPKVEYFRRGSAASHLSIADLVPDLLKARHLHATGIPPALSESCRMLSRELMECMRSAGRSLSFDPNLRPSLWPSQARMIAEINELAALAHWVLPGIEEGRLLTGYQSPADIAAFYLERGAEAVVIKLGPEGAYYRTADSEGRIDGVPATRVVDTVGAGDAFAVGVISALLEGRSFPQALKRGNAFGSRAVQCIGDMEGLPRRHELSEETLNV

SEQ ID NO: 16451 - protein, 486 aa, Azotobacter vinelandii
MKEIKHFINGEYVGSASGKLFDNVNPANGEVIARIHEAGEAEVDAAVKAARAALKGPWGKMSVAERTEILHRVAAGITARFDEFLEAECQDTGKPKSLASHIDIPRGAANFSVFADLVKNVPTEAFEMATPDGSGALNYGVRRPKGVIGVISPWNLPLLLMTWKVGPALACGNTVVVKPSEETPSTTALLGEVMNAAGVPAGVYNVVHGFGGNSAGAFLTAHPDVDGITFTGETGTGETIMRAAAKGVRQVSLELGGKNAGIVFADADLDKAIEGTLRSAFANCGQVCLGTERVYVQRPIFDAFVARLKAGAEALVIGEPNDPKANFGPLVSHKHREKVLSYYQKAKDEGATIVTGGGVPDMPQHLAGGAWVQPTIWTGLKDDSPVVTEEIFGPCCHIRPFDTEEEAIELANSLPYGLASAIWTENASRAHRVAGRIEAGIVWVNSWFLRDLRTAFGGAKQSGIGREGGVHSLEFYTELKNICVKL

SEQ ID NO: 16452 - protein, 443 aa, Azotobacter vinelandii
MRNIDVNRLVDEARFNRFHWRVLCWCALLLIFDGYDLFIYGVVLPVLMKTWGLSPLEAGALGSYALFGMMFGALFFGPLADRIGRKKGIAICFLLFSGFTVLNGFVRNPLEFGVCRFVAGLGIGGLMPNVVALMNEYAPKKIRSTLVAIMFSGYSLGGMLSAGLGIYMLPRFGWEAMFQAAAVPLLLLPLILWFLPESVGYLLRQGRTEQARAILRRVDPGLALTDDDRLEMAEAKGEGAPVLQLFREGRALRTLSLWVAFFCCLLMVYALSSWLPKMMASAGYSLGSSLSFLLVLNFGAVFGAIGGGWLGDRMNLPKVLVAFFAVAALSIGLLGFKSPTPVLYALIALAGATTIGSQILLYACAAQFYSMAIRSTGLGWASGIGRNGAIVGPLLGGALVGMSLPLQMNFIAFAIPGLLAAIAMALFCLRQPAAGVAPGEALA

SEQ ID NO: 16453 - protein, 241 aa, Desulfitobacterium hafniense DCB-2
KTRRQTTNALLVDSREIPDQTIPVARDLEADAILTPTHSGLTARMISKYRPTSLIIAATPFVHVARQLSLTWGIYPLLIPESLGTDQLLSVSVNEAISHHLIKTGDVVVITAGVPVGKVGTTNIIKVQVIGDVIAKGTGIGRKAYSGTARIATSAALELFQKGDILVAPYTDKELIPLIAKAGAILVEEGGLTSHGAIAALNYGIPAIVGAADVLMKVKDGQVLTVDALAGVVYEGTVSII

SEQ ID NO: 16454 - protein, 399 aa, Desulfitobacterium hafniense DCB-2
MCEKTHTMIQRGQEVVMNTYGRLPMAIVKGKGTTVWDIEGKQYLDFVTGLAVSSLGHSHPAVVEAIQKQAEEILHTSNLYWIPNQIALAEKLVEHSFADQVFFCNSGAEANEAAIKIARKYAKEHYSEDKYEILTLVNSFHGRTLATLTATGQTKYQKGYAPLPEGFTYVPINDLAQLEEKMNPKVAAVMLEPIQGEGGVFPLEVEFLAKARKLCDDYGALLIFDEIQVGLGRTGKLFAYEWSNVVPDIMTLAKALGGGVPIGVMLAKEKVASTFKPGDHASTFGGNPLATAVGCAVMDVLTEEGFLEDVQKRAQYFKQELQKLADKYQTGTEIRGQGFILGWPLDRLGAEIVEGAREKGLLINFVGGKALRFLPPLNVSYQEIDEAITILDQIFAECW

SEQ ID NO: 16455 - protein, 456 aa, Desulfitobacterium hafniense DCB-2
MPDIKEILVKQKAFFQTGKTKELQFRVDMLNKLRSAIKIHEEEIMAALKADLNKAPFEAYATEVGMVLEELNYTLKHISSWVKPKRVRTPLVHFPSASYLYTEPYGSVLIMSPWNYPFQLALAPLVGAISAGNCAVLKPSEYSANTSAMIERIVKEIFDESFVAVVRGGREANKTLLNEKFDYIFFTGSVGVGKTVMESAARHLTPVTLELGGKSPCIIDDTADLELAAKRIVWGKFLNAGQTCVAPDYLLVHRTVKEKLIQEIKKSITAFYGHDPLGNEDYPKIINQKHFERLLGLLKSGRVVEGGRSDEKTRRIAPTILDDVTWESPVMQEEIFGPLLPVLEFESFDAALAMVNQHPKPLALYLFTRSKDHEAQAISKTSFGGGCINDTIIHLANPNLRFGGVGESGMGQYHGKGSYDTFSHTKSIMKKSNKLDIPLRYPPFRNHLSLLKKLMK

SEQ ID NO: 16456 - protein, 463 aa, Desulfitobacterium hafniense DCB-2
MALKVPRHEMPCQDPKERAHNFNEVALGYASETAIEEAQRCLQCKKPKCVEGCPVNISIPEFIQKITEEDFEGAAAVIKQSSSLPAVCGRVCPQESQCEAKCILGIKGESVAIGRLERFVADYEISKGCKIPEVAPPSGKKVAIIGAGPAGLACAGDLAKAGHKVTIFEALHVAGGVLMYGIPEFRLPKDIVQNEICNLEPMGVEILVNQVVGKVTSVHELMQNGYDAVFIGTGAGLPNFLGIPGENLNGVYSANEFLTRTNLMKGYRFPEYKTPVKIGKKVAVFGAGNVAMDAARTALRLGAEEVSIVYRRSRAEMPARHEELEHAEEEGVNFQLLTNPVAIQGDEKGAVKSLTCLRYELGEPDASGRRKPVPIPGSEFEIEVDTVVVAIGQGPNPLVTQSTEGLELNKWGNIVVNEETLETSIPGVFAGGDIVTGAATVILAMGAGKKAAAGINAYLKNKG

SEQ ID NO: 16457 - protein, 441 aa, Desulfitobacterium hafniense DCB-2
MKQTGLLFFPAFDWSLGDTHPEREERLLYTQEQLFEEGVMDLPQIKHYAPGLASLKDVQRTQGIFPAPESHDLDAHLIAAGSSLVLGEAWAKKEIHNGFALVRPPGHHSGATVLGNRGFCTLNNEAILINHLRTFHGIKKVAIVDTDVHHGDGTQDIFYHDPNVLFVSIHQDGRTLYPGSGFIYEKGGPNAWETTLDIPLPPGTGDEDLHHVLENWVLPRIYDFQPDLIINSAGQDNHFTDPLASMSVTARGYGRITELLNPDLAVLEGGYSIEGALPYVNLAIVLALAGEDYQGVIEPQKPRHPHSGSNAFRGFLKELKEQYRRAKPDWNIRADSFLPEGKWVYIPHSVYYDTEGFQEGRKDWIRQCNHCGGTVLIESQHTVTGNTFALVRIPFAACEQCTQAGYDLWEHLIGRKTSVLLQDQQHNKVELWHLDKGVTHF

SEQ ID NO: 16458 - protein, 405 aa, Desulfitobacterium hafniense DCB-2
SYLIGGLVIFFIMRMLGEMAVDEPVSGSFSHFAYKYWGEFPGFLSGWNYWFNYIVVSMAELTAVGIYINFWFPDIPHWLTALVCLVLVTLLNLISVGTFGEFEFWFAIVKVVAIIGMIVFGLFLIFSGINGEATGFDNLWIHGGFIPNGMIGILFSLVPVMFSFGGIELIGITAGEADNPQKSIPKAINQVMWRILIFYVGALSVLMVLYPWNQVGADGSPFVMIFSKIGIPAAATLLNIVVLTAALSVYNSGVYSNGRMLYSLAMQGNAPKLFAKLNKRGIPVAGVLVSSGITLVGVILNFLLPGKIFTYLMAVAIIAAVITWTTIIIVNLKFRKAKIAQGEGDALHFKTPLHPYTNYFCAAFLVMIVILMAFTESMKMAVLVLPIWLLILWISFKIKKSRESK

SEQ ID NO: 16459 - protein, 286 aa, Desulfitobacterium hafniense DCB-2
MMNIGYLGPKGSFSEEALQLFLTTQSDLLEPPLNLIPFTTIPKLLIACQNLEIEGAFVPLENSTEGQVGVTMDMLGQTESLYIMREFIFPVDQCLITAQPLHLAQIKQVYSHEQALGQCRDFLETHLAQAEQHSSPSTAEAVTKIAQNPDQPWAAIGPRRAAEIYNLHCKSEKIQDSMLNATRFIFVGHHLAEMNEEDKTSLLIITGDTPGALAHALQEFALRNINLSRIESRPSKKKLGEYVFFVDIDGYVFSPSIQEALWALKDKGVSTKLLGSYPKAKLSAKE

SEQ ID NO: 16460 - protein, 485 aa, Desulfitobacterium hafniense DCB-2
MQDVALLTDLYQLTMMQGYYQNGYENKEAVFDLYFRKIPSGGGYVIAAGLEQVVEYIENLRFSSEDMAYLRGLNIFDEGFLNLLKDFRFHGDIDAVPEGTVVFPYEPLVRVKGRILEAQLIETALLNIINFETLIATKASRVVAAAGGGSVMEFGLRRAQGPDAGILGSRAAFIGGCQFTSNVLAGKRYGIPLSGTQAHSWIQCFPDELEAFRAYARTFPDQCLLLVDTYNVLKSGVPNAIKVGLELEAEGHRFLGIRIDSGDLTYLSREARKMLDQAGLEHARIVASNDLDEHTISAIRAQGAAIDSWGVGTHLITSKDTPALGGVYKLSAEGQKGVFEPRLKVSENISKITNPGIKKIVRFYDRRGKAMADLIALEDEHFEEPLTIFDPIETWKRKTLTDFKTRELLRPVFRGGRRVYELPYLKDIQTYAQHECETLWDEVKRLVNPHRYIVDLSPKLFELRQSLLLEISTKIEEEQTKRLSK

SEQ ID NO: 16461 - protein, 446 aa, Desulfitobacterium hafniense DCB-2
MGKISISDVVDQIGVSKYTYKTYFLVGLTLIFCGFSYMIVSYTMPQMSAEWGLTKVQTGSLASWSLLGLMVGGMIAGIISDSIGRKKGLAIFTIWFSLLTFPIYFVNSFEAFAILRILGGVGFGACIPIAITLMAENVPTKNRGFFISSIMSFYVLGWVVAGVVAIYVVPTFGWRVCYLIGVLPVLYAFVLMAALQESPHWLLGKGREKEAIEVLKRIEMVSKGKANDYAPGSLFLPPRPKKVGVGALFSREYSRATMALWIIYFMGSVVIYGINGWLPTLLVDKGYGLVKGYSFAVLQNVFGAIGGLCTGYVADIIGRRTNVIIGWIATAVAILLLGVASNQWMVVICGMLVGLAMNWGLSGTQPLLAEGYPTEFRSTGVASAQAFGRVGGFLGPIVAGYVQQLGVGFTGTFVFFAVPAVIASFVALFFVVETKGKSIERISANA

SEQ ID NO: 16462 - protein, 298 aa, Desulfitobacterium hafniense DCB-2
MKLGFIGLGQMGKHMALNLLKSGEELIVYDQRPASYPEFEQRGARTAAQIRDVAEADIIFCSLPNSEVVCQVVLGETGLKKVLRAGQIIVDTSTINYSTTLEIGKQLESVGVEFIDAPVSGMESRAKEGTLTTMCGGKQELFENVKPYLQCFADKILYMGQPGSGQLTKLINQLLFDINVAALAEILPMSVKLGLDPEKVGAVVNSGTGRSYASEFFIPMILKGSFMDGYPMKHAYKDLVSGAEISASLCIPMPVLGAATTTYQMALLKGLGDRDKGGMIGVFEDLLQVHYRQPSPEE

SEQ ID NO: 16463 - protein, 301 aa, Desulfitobacterium hafniense DCB-2
MERRKVRIIGVPIDLGADRRGVDMGPSAIRYAGLHERLKKLGWEVEDVGNIDVPIAETREIKDPLLKYLPEISEVNQKLYPLVAQAIKEEVIPLIIGGDHSLGIGSLAGCAASGKQFGVIWFDTHGDYNSMETTSSGNIHGMPLAVANGIGVKELTSIGGAARKIKEENTVIIGARDFDDEERAMIRQSGITVFTMSDIDRLGMEAVVRQGLEIANRGTHGVHISFDLDVLDPSEAPGVGTPVQGGMTYREAHLAMEMVADCRCLLSMDVVEVNPILDAQNKTAELAVGLISSAFGQKIYP

SEQ ID NO: 16464 - protein, 505 aa, Desulfitobacterium hafniense DCB-2
MGKATGFLEYQRIDPKKRAPEERIQDWREIKLPRDPEVIKTQGARCMNCGVPFCNGGVVLNGMVSGCPLHNLIPDWNELIYKGQWEEAYRRLSRTSPFSEFTSRVCPAPCEGACTEGYIMEPVTINCIEYEIIEKAFAEGWVKPKKGKVTGKRVAVVGSGPAGLSAANYLNAVGHEVTVYERADRPGGLLMYGIPNMKLEKNVVERRINLMKESGIHFVLNTEVGRDVPAQDLVNQYDAVVLCIGATKARGLNVEGRDLKGVHYAVDFLKANTKSLLDSNFEGLETMAEKDGQEGGWISAQGKNVIIIGGGDTGTDCVATSIRHGCKSVHQFEIMPEPPAKRIEATNPWPEWPKKLKVDYGQEEAISLYGKDPRHYLINTKKIVGNEQGEVKEVHTVEVHWIKDSSGRMVPQEVPGSEKVWEADLVLLAMGFLGPEDAIPNELNLERDERSNLKAVYEEFETNVEKVFAAGDARRGQSLVVSALQEGKLAAREVDKYLMGRSGIR

SEQ ID NO: 16465 - protein, 296 aa, Desulfitobacterium hafniense DCB-2
MKIGFIGLGIMGKPMSLNLLKAGHEVVVYNRSPKAVQECVQAGAEAGASPKDVAERCPLIITMLPNSPQVKEVILGPDGVLEGARPGAMVIDMSSIAPGASQEVAQKLAEKNVRFMDAPVSGGEPKAIDGTLSIMAGGKSEDFEEFLPVLKAMGSSAVLCGDVGAGNVTKLANQIIVAVNIAAVSEALTLATKAGANPETVYKAIRGGLAGSTVLDAKGPMMLERRFDPGFRINLHIKDLNNVMETGHDIGSPLPITATVMEMMQTLKSYDLDHQDHSALVQYYEKLAGIEVKKAD

SEQ ID NO: 16466 - protein, 288 aa, Desulfitobacterium hafniense DCB-2
MSDRLETALAKARLKTPENPLGMGLITYLMAGDPDSDTTLRRLTGLVKAGVDILELGVPFSDPIADGPVIQAAGLRALQQGMNLQKVLNLAARFRKENQTTPLLLMSYLNPLIHYGYDRFLSEACTAGVDGLILPDLPWRESTPFRQRAYELLQDHLAFIPMIAQTSRPAHIHGLAQEQKGFIYVLSRNGITGGDAEIPPQTLQFIDSLQTALSAPCYVGFGIQSPTQVHTLSQACQGVIVGSALVQKFAQLDACALPAHELVHREQDIYAWIGSLRKTSVREELACE

SEQ ID NO: 16467 - protein, 415 aa, Desulfitobacterium hafniense DCB-2
MNKTTRGWTVTFAGTGINLALGVLYTWSVFAAALTEQLAWSKTAASLPYTVACAVFALMMVPGGRLQDRFGPRWVATAGGIFAGGGLILSSLTDSLFVLTLTFGLIAGIGIGLGYSAATPAAVKWFPPQKKGLISGIVVAGFGLASLYIAPLTNSLIGNLGVKSAFRIEGLIFLFAIVALSQVLAVPQSNPTPTAPSTPASPQAATSLNAPPSPPPAAKGDFSWQEMLKDPRFYLLWVMFAAGATAGLMIIGQLSTITKLQTGISWGFAMVALLAIFNAGGRVLAGWLSDRIGRSWTMRIFFSLQGLNMLAFTFYSSPALIALGAIMTGLSYGSLLSLFPSATYDFFGTKNGGVNYGLIFTAWGVGGVFGPLMAGAVVDLTNSYFYAYLIAAALCLIAAFLTIFLKSSPLEAEKA

SEQ ID NO: 16468 - protein, 250 aa, Desulfitobacterium hafniense DCB-2
MNEKMIEIRDLVKKFYIDTPNELEILKNISLTVGKGEFISIVGASGSGKSTLMNVIGALDRPTSGEYILDGAPIQNMSDLELSDIRNRKIGFVFQTFNLIPRNSALKNVELPMLYAGMGSRERREKAEELLKLVGMEDRLDHLPNELSGGQKQRVAISRALANDPAIILADEPTGALDSVTGRMVMDLFHQIHETKGTTIVLITHNYELAEETDRIVTLKDGIIIDEQIRPKTPASIGSGCQSEERGENG

SEQ ID NO: 16469 - protein, 224 aa, Desulfitobacterium hafniense DCB-2
MIKIAPSILSADFAHLGDQVALVEKAGAEVLHIDVMDGHFVPNITIGPLVVKALRPYSQMRFDVHLMIEHPERFIEEFAKAGADHITVHLEATPHIHRAIQQIKGLGLTAGVSINPATPLDGIKYILDELDMVLIMSVNPGFGGQKFIPAVLPKIEVLHRHLDQMQSSCEIEVDGGINLDTAPAVVKAGANILVAGAAVFACADPARAVQELREAAQGYKGDPK

SEQ ID NO: 16470 - protein, 488 aa, Desulfitobacterium hafniense DCB-2
SLFMTNNGKDNNKTGGIRVENFFKLKENGSNVRTELVAGLTTFFAMAYIIMVNPAMLSQAGMPWGAVFLATIIAAVIGTLVMGLVANVPYAQAPGMGLNAFFVFTVVFGLGFTWQEALAMVFLCGLINILITVTSIRKKIITSIPLSLQNAIGGGIGIFIAYIGIKNAGLLSFTSDPGTYVQLGEGGTVIASSSAVPALVTLNSPSVLLAILGLVLTVILLIRNVKGAILIGIIVTTLVGIPLGLTHMGSSISFSGALAELPQTFMAAFGNPGLVSLFSDPAKIPLVLVTIFAFSLSDVFDTIGTFIGTGRSSGIFSEADLKAMETSKGFSSKMDKALFADAIATSVGSLFGTSNTTTYVESAAGIGAGGRTGLTSIVVAVLFAASAFLAPVVSAVPGVATAPALIIVGIMMLSSFKEIKWGDLSEAIPAFFAGIFMAFCYSISYGIAAGFIFFCIVKVFKGETKEISPVLWIATLLFVLNFILLARI

SEQ ID NO: 16471 - protein, 422 aa, Desulfitobacterium hafniense DCB-2
MNYIIIGNSAAGLFAAEGLRKVDSQGKITVLTADHYPPYSRCLTTYYLAGDIREEQLFLRTTEELARLNLNTHYRVRVTGLDPEGQRVSTASGEVFDYDRCLIATGASAVSLDIAGAALPEVFTLRHLENAKAIQKFIKKGRKAVIIGGGLVSLKSAYALRKQGMEVHVIVSSGYILSQMLNSSAAERLEEHLKDHGIHISLNSDVAAIKGKEHVEAVELKCGRIIDTNLVIIGKGVQPNVEPFLNSGLKINHGILVNEYLETNLPHVYAAGDVAETWDFLRECPRINAVWPNATEQGRVAALNMAGRKTIYKGSMGMNSVDFFGLRIISGGVITPLAHKKDIENALPWKVTEGQESWSKPLAKASTYQSLIWKGNYLKGYVLIGYPERAGLLTAMIRTQEPLAPEVQRNIEAGNRKIVKLK

SEQ ID NO: 16472 - protein, 510 aa, Desulfitobacterium hafniense DCB-2
MDMRQTFEGLLDYWGGKTPDKEAVYDGLRRMSYGELKREAGQLAKALACLNIQAGDKVLAILPNWHEFIVLFFALAKMEAVLVPCGVSLTAKEISQRCQMIQPKLAFVSGHDQLRWLEAEAGCCKIIAVRFEDKKAMGYSELLALGEKNREQKLPGKRQDEVMCTIIFTSGTTGAPKGVELTDRSIMQTAISIGIRLESSHRDVFLVPLPCTHLFGIVTGMVVPLYVGAKIVIMERFRAKEALKLIEQEQITVHHGVPTMFIRELEDYKGHEVNLQSLRTGVAAGAICSEEVLKKITDIFKFNLMVAYGLTEFVGVSMTTLSDTIEDRLKTVGKPYEGIQVRAVHESGRTAEPGEVGELCCKGYGAMKGYYQLPAQTRKVLDAEGWLHTGDLARIDERGYITIVGRKKEVIIRGGYNIYPREIEEVYYNHPEVMEACVIGLPHQDLGEQTVAFIQLKSHSQQTAALLREYAKGKIAKYKVPDRVLLVEQLPKLSNGKIDKRELGKMAVSL

SEQ ID NO: 16473 - protein, 437 aa, Desulfitobacterium hafniense DCB-2
MEGFKIKSVKARQVFDSRANPTVEVDITLKDETVGRGIVPSGASTGLFEAVELRDGEETFDGKGVSKAIHHVNEQLAPLLLDIDVRDQKAIDSRLIEIDGTPNKSRLGANAILGCSMAACWAGANYYKVPLYRYLGGSAANKLPVPMVQIIGGGAHADNAIDIQDFLVIPTSAPTFSEGYEMVVNVYNAAKMIFKGAGKPVSIADEGGLWPTGFQSNEEGLKLLCESIELAGYTPGQDLGIALDIASSEFYDPERGTYRLELEEKTLTKEEMVGMLSDWVDKYPIISIEDGMSELDWEGNLLLTQKLGKKIQLIGDDLFTTNIERIRKGVEMKVDNAVLIKMNQIGTITETIETIEFTQNHGYLPVVSARSGETEDCTIVHLAIATNAGQLKVGSAARSERTAKWNEVLRIEEALGSSARYPSKGVFAAAGIQFNQY

SEQ ID NO: 16474 - protein, 454 aa, Desulfitobacterium hafniense DCB-2
MKNFSISEVMDSFGVNKFTWSIFFFLGLAMVFDGYDYMIVSYTMPQISAEWGLSAVEKGSLSSWSLFGLIIGGAISGIVSDKIGRKRTLVYSIAIYSLLNIPIFFAPSFGFYALFRVLAGLGLGACIPVVTTIFSESTPTNRRALFITFGMAWMIVGWVLAGLVATYLVPRVGWRWCYLVGGFPFIYSIFLHFKMKESVYWLANKGRNEDAVKRLQEIEKVATGKVTNWDPNALVVPPKSKVVGPKALFSKTYRMTTAGVWITYFCGCFTVYGINAWLPSLMLEKGLQLSSAYGLSIAQNAAAVIANCSTGFVAEVIGRRKNLIGSYGLGIVAILIMAFVGSSFWAILAANIFLGFAINYSITAVQPLMAEGYPTDIRNTGVSWCQAFGRLGGALAPIVAGMIIGLNLGYSSAFLFYVVPLLFGLLAAFLLIRNETKGKSIDQIQEENVLKAGS

SEQ ID NO: 16475 - protein, 1195 aa, Desulfitobacterium hafniense DCB-2
MSVVLAYHNSHDPFFRSPFGAVPCGGLLRLRLLMQPEDSSGAGSPVQECFLRLWVQDREERLPMLRVEEPILWEINREGTVTGEEAITGEGVLTGEGVVYEVEYPLPHEPGIIWYYFIFRAGGETCFYGNNQEELGGVGELRSSEPPGYQITVYRPMALPGWYTQGIMYQIYVDRFFNGDEQGKVLNPRPRSLIHGDWSDTPFYIKNEKGEVLRWDFFGGNLAGVIKKLPYLKELGVSILYLNPIFDSSSNHKYDTGDYLTLDPMYGDEEIFAQLIKEAQSLGIAIILDGVFSHTGDDSIYFNRYGRYPGLGAYQSPDSPYYSWYQCHGEGQEKEYSCWWGVSTLPEVWEMEPSYREFIIHSPQGVLQSWMKRGIKGWRLDVADELPDEFIQEFRQMMKTMDPEGVLIGEVWEDPTHKFSYGKLRQYFWGEELDATMNYPLRNIFLQYFLGQIDAGQAHKRIMNLYENYPRENFFGQMNLIGSHDRARILTLLGEAPPPEQLSAVEQEQYRLPAPARDLAVQRLKLLTLLQMSFPGVPCLYYGDEAGCEGYPDPYNRGTYPWGREDQEILQWFKRVLRYRREYEVLRQGEFSSWFEGKEIYVLQRKGEKEEIIVLVNRSAEESTEMTLKLEQNVGQVIDIFAGEVLHSLSLILPPLSAKALFYQKYERGHYFKQEIMTRACGILMHISSLPSPWGIGDLGEEAYAFVDFLAEGGQSLWQVLPLNPLGLGDSPYQSESALAGNFLLISLDLLIEAGLLTEGEARREWADYGQEVKKTEGSEGSEGSEGSEGSEGLGSEGFAWVERYKEKLLRKAYERFKEKLPRYPLDLSSPEGGSQPGTKGYLDPQGYDRFIEENQDWLQDYALYKCLKLKFPGKAWHQWEESYRLRKPEALEAVTEDYAEEINYIFFVQYTFADQWQRLKDYAQEKGVKIIGDLPIYVAYDSCDTWANRECFALDENNAPAGTAGVPPDYFNPEGQNWGNPLYDWDALRAADYAWWKLRFRQGLERFDALRLDHFRGFEGYWEVPPQAGSAKEGRWLKGPGKEFFESLVRELGPLPVIAEDLGCITPEVNTLRAILGFPGMRVTQFSPLQQEGNYVDYSGTHDNDTLLGWYRSQGYSDKDSLAQVERTIEELYQGNGIWVIFPLQDILKLDSRARMNTPGTIKGNWQWRVERGTLTQEVCARLRGLAEKYGRLS

SEQ ID NO: 16476 - protein, 103 aa, Desulfitobacterium hafniense DCB-2
MNRIDAKFQHLQAAGRKALIPFLTAGDPSLEATVPAMHALVEAGADVIELGVPFSDPMADGPTIQRSSERAIARGAGLGWVLKAVAQFRQRDADTPVVLMGYL

SEQ ID NO: 16477 - protein, 126 aa, Desulfitobacterium hafniense DCB-2
MPLHSAVHRAEKLERDYQARGFEVLGFPCDQFGHQEPGDEAEIKEFCSLTYDVTFPMYAKVDVNGDKAHPLWKWLKDEKGGFLGIDAIKWNFTKFLIGRDGRVLKRYAPTDKPESIAADIEKALAA

SEQ ID NO: 16478 - protein, 142 aa, Desulfitobacterium hafniense DCB-2
FGEGEGALIAGVGGFINITQSARAVVFMGTLTAGGLEVRVEQDQLRIAREGRVKKIVPEVSHLSFNGPYVASLGVPVLYITERAVFEMRADAQGDARLTLVEIAPGVDLQRDVLDQCATPVAVADDLRLMDARLFRPGVMKL

SEQ ID NO: 16479 - protein, 263 aa, Desulfitobacterium hafniense DCB-2
MILPVGVPNFAEALRAGAEVFHALKSVLKGRGLSTAVGDEGGFAPDLRSNEEALETILEAIGKAGYKAGEDILLGLDVASTEFYDNGKYHLVGEGKRLTSEQFVDFLANWAAQYPIVTIEDGMAEDDWNGWKLLTDKIGNKVQLVGDDLFVTNPKIFAEGIDKGVANAILIKVNQIGTLTETLEAIAMADRAKYAAVVSHRSGETEDTTIADISVATTATQIKTGSLCRSDRVAKYNQLLRIEEQLGSAARYAGRDAFVSLRR

SEQ ID NO: 16480 - protein, 325 aa, Rhizopus microsporus var. chinensis
AGVGTVPMTDYGNDIEYYGQVTIGTPGKKFNLDFDTGSSDLWIASTLCTNCGSGQTKYDPNQSSTYQADGRTWSISYGDGSSASGILAKDNVNLGGLLIKGQTIELAKREAASFASGPNDGLLGLGFDTITTVRGVKTPMDNLISQGLISRPIFGVYLGKAKNGGGGEYIFGGYDSTKFKGSLTTVPIDNSRGWWGITVDRATVGTSTVASSFDGILDTGTTLLILPNNIAASVARAYGASDNGDGTYTISCDTSAFKPLVFSINGASFQVSPDSLVFEEFQGQCIAGFGYGNWGFAIIGDTFLKNNYVVFNQGVPEVQIAPVAE

SEQ ID NO: 16481 - protein, 118 aa, Desulfitobacterium hafniense DCB-2
MQAYAEGFAILGRKAEFGLDLHQIAQIWRHGSVVRSWLLDLSADALGKNPSLQGIAPYVEDSGEGRWTVAEAIDLDVSAPVITASLMERLRSREKDSFADKLLAAMRNEFGGHAIRKE

SEQ ID NO: 16482 - protein, 383 aa, Desulfitobacterium hafniense DCB-2
LEDPSLCFVDFNVPMDDHGNITNDTRIRAALPTIHYLIDEGAKIILASHLGRPKGKPDPNYSLAPVAKRLGELLKRPVAMATDCIGPEVEKAAAQLQEGEVLLLENVRYHAEEEKNEPEFVKQLARLAEVYVNDAFGTAHRAHASTEGIAHHLPGVAGFLLQKEIESMGKALENPERPFVAIIGGAKVSDKIGVIENLLHKVDALIIGGGMANTFLKAQGYSLGKSLVEGDKLSLAQEILEQGRELQVDILLPQDVVAAKEFKADAPYRVTPVREIAEDEMALDIGPESAGLFSARIQKARTIVWNGPMGVFEMEQFAKGTEKVAQAVALCPGLTIVGGGDSVAAVEKMGVGEQMSHISTGGGASLKLLKGKNLPGIAALQNI

SEQ ID NO: 16483 - protein, 108 aa, Desulfitobacterium hafniense DCB-2
MLYPGLKSLPQHELAKRQMHGFGGMVSIYVKGGMDGARRMMERCHLFTIAESLGGVESLVNHPAVMTHASIPPDRRAALGITDNLVRLSVGVEDVADLRDELERALGA

SEQ ID NO: 16484 - protein, 176 aa, Desulfitobacterium hafniense DCB-2
MLERLMTLGKKHHLDAHYITRLFQLIIEDSVLTQQTLLQQHLNKINPHSARVAFLGPKGSYSHLAARQYAARHFEQFIESGCAKFADIFEQVETGQADYAVVPIENTSSGGINDVYDLLQHTSLSIVGELTLPIDHCVLVSTSTDAQQITTVYSHPQPFQQCSQYLSRYPHWNIEY

SEQ ID NO: 16485 - protein, 348 aa, Desulfitobacterium hafniense DCB-2
MTSELPTGRPVPASQPVRIRRALLSVSDKTGLIELARALAAHGVELLSTGGTAKAIRDAGLAVRDVAEVTGFPEMMDGRVKTLHPLVHGGLLGRAGLDEAVMAQHGIGAIDLLVLNLYPFEKVSADPASSFEDVIENIDIGGPAMLRSAAKNFARVAVATDPGQYGELIAELDGHDGALSAKTRFALSVAAFNRVAQYDAAISNHLSAIGEDGGKLEFPAQHNASYVKVMDLRYGENPHQSGAFYRDAQPLPGALASFVQLQGKELSYNNLADADAAWECVRQFERPACVIVKHANPCGVAEGVACGDAYELAYATDPTSAFGGIIAFNRTLDAATAKAILDRQFVEC

SEQ ID NO: 16486 - protein, 148 aa, Desulfitobacterium hafniense DCB-2
MEEKIGKVLLSREEIQKRVAELGEEITRDYKDQNLLVLAILKGAVPFMADLIREIRIPLKYDFMAVSSYGASTHSSGVVRILKDLERSVEDHHILIVEDIIDTGLTLKYLKENLAARNPLSIKVVTLLDKPDRRKAEVVPDYIWVYDS

SEQ ID NO: 16487 - protein, 273 aa, Desulfitobacterium hafniense DCB-2
MIATKFSLCTDPGDPNAGGNHRKNLRRSVEASLRRLGSDYIDLLYLHAWDATTPVEEVLRAMDDLVRAGKLVYVGISDAPAWQVARMQAIADLRGWSPLIALQIQYSLIERTVERELMPMARELGLGVVPWSPLGMGVLTGKYSRADLDIGSGVPEAVGTRKNVAASNGTLTARALDIAEMVKEVASELGKTPAQVALAWTLLDPAVASPIVGVRTLAQLHDNLGALEVRFDDSQRARLDAASRIELGFPHDFLQSPMVHSVVYGEVKPPVRL

SEQ ID NO: 16488 - protein, 147 aa, Desulfitobacterium hafniense DCB-2
FPSKGWRLFPFGWKGMWPIRKKSWISWSNHPQVAWVNYPSLKESKYYELAQKYLPKGAGSIFTFGIKGGIEAGKKFIDSLEIFSLLANVADAKSLVIHPASTTHAQLSEEDLVAAGVTPDMVRLSIGIEDAEDLIYDLEQALRKAAG

SEQ ID NO: 16489 - protein, 291 aa, Desulfitobacterium hafniense DCB-2
MSATSCPKPVVLLILDGWGHRDDPADNALAQAELPNWRALLASQAHTLIHTEGRHVGLPDGQMGNSEVGHMNLGAGRIVYQDLTRIDAAIEDGSFYANDELRAACAAAKAAGTTLHLLGLLSPGGVHSHERHIFAMIELARREGVAKVAVHAFLDGRDMPPKSAAPSLQRLQQACDEAGNARIASIGGRYYAMDRDKRWDRQLRAWDAIVEAKSEHHTETALEGLDAAYARGETDEYDAPTVIGDAQPMDEGDAVVFMNFRADRARQINDAYVDPKYDGYEARKTKLSRIV

SEQ ID NO: 16490 - protein, 165 aa, Desulfitobacterium hafniense DCB-2
MQHALNLEPQVTAWAERFAPKHHALFLGRGVHYPIALEGALKLKEISYIHAEAYPAGELKHGPLALVDAAMPVVVIAPNDKLLEKVKSNIQEVRARGGEMFVFADLDSHFGESEQVHVIRTPRHVGVLSPVVHAIPVQLLAYHAALARGTDVDKPRNLAKAVTVE

SEQ ID NO: 16491 - protein, 242 aa, Desulfitobacterium hafniense DCB-2
FFGLSGTGKTTLSADPERCLIGDDEHGWSKNGVFNFEGGCYAKCINLSEEKEPQIWQAIRFGTVLENVVLHPDTQVADYDDATLTENTRAAYPIDYIEGAVIPGVGGQPKVIVFLTADAFGVLPPIAKLTKEQAMYHFLSGYTSKLAGTERGITEPQATFSTCFGAPFLPLAPQVYAEMLGERIDTYGTRVYLVNTGWSGGAYGVGKRIKLGYTRAMITAALQGTLEQAEFTADPILASWFL

SEQ ID NO: 16492 - protein, 284 aa, Desulfitobacterium hafniense DCB-2
MELWYTEEHTENVRFSIKVDRQLYSGQSEFQRIDVFESKEFGTFFTLDGLMMVTQKDEFIYHDMIVHVPMATNPQIKDVLVIGAGDGGTVRELTRYDSIVNIDMVEIDKLVVDVCKEYLPQTACKLEDPRVRLFFEDGLRFIRTKENSYDLIIVDSTDPFGPGEGLFTKEFYGNCYKALKDDGILVNQHESPYYETYAQNMGRAHQRIKEFFPVCRVYQAHIPTYPSGHWLFGFASKKYDPLIDIDEQAWNDLGIKTQYYNTEIHKGCFALPNYVKEQLADAVE

SEQ ID NO: 16493 - protein, 351 aa, Desulfitobacterium hafniense DCB-2
RKGKAIRIGKLEQFIADNATEVGFPKVAATMGAIAVIGSGPAGLAAAVQLAQLGYAVTIFEGEAEPGGVLLHGIPEYRLPKDVVRRDIKKIENLGVEFRLNTLVGVDLFLDDLLTQGYQAVFIGTGAGLPKTLELPGEYLEGVISALYVLQTINLYNSGQLPEQELPVEKGEHVVVIGAGNVAMDAARTASRLGAEVTVLARRGLNDMAARDIERDEAIADGVKIRTYAAPLAILGEENVTGIKCVNTMVSPAGKVVIKEEESFVLPADKVIFAIGQRPYARIVTTSQGFEINKQGLLICNEHGMTTREGVFAAGDVVHGPATVVKAMGEGRRIAIEIHAYLLRKKLQSAK

SEQ ID NO: 16494 - protein, 321 aa, Desulfitobacterium hafniense DCB-2
MRRTKIVCTIGPSSESNEKIRQLLKAGMNVARLNFSHGTHGEHGKRIRTLREEAQKLGVHLGVLLDTKGPEIRTGTVPEEGVQLNSGDTFILDTDLSTLGSAERVGITYLQLWQEVHQGTHILLDDGLIDLEVIASEEGKIITKIQNGGVLKSKKGVNVPGVPIQLPAITEKDRDDIIFGLREGIDFIAASFARKAADILAVRRLVEEEGANVKIIAKIENREGIEHLDEILEVADGLMVARGDLGVEVPVEEVPIHQKDMIEKCHHLGKTVIAATQMLDTMIRKPRTTRAAASDVAHAIQTDRCTCFRETCRRTGEREYE

SEQ ID NO: 16495 - protein, 237 aa, Desulfitobacterium hafniense DCB-2
MIKRLGAEFIGTFWLVLGGCGSAVLAANFGGAGNPLGIGLLGVALAFGLTVLTGAYALGHISGGHFNPAVSFGLWAGGRFPAKDLLPYIVAQVLGAILAGFVLFHIASGTGSFSIDPNAAGTFASNGYDLMSPGGYSAASAFLTEVVMTAMFLVIILGATHKNAPAGFAPIAIGLGLTLIHLISIPVTNTSVNPARSTGVALFAGAAALSQLWMFWVAPILGGLIGGAVYRWLGKDD

SEQ ID NO: 16496 - protein, 326 aa, Desulfitobacterium hafniense DCB-2
  misc_feature (308)..(308): Xaa can be any naturally occurring amino acid
  misc_feature (310)..(318): Xaa can be any naturally occurring amino acid
  misc_feature (320)..(320): Xaa can be any naturally occurring amino acid
  misc_feature (322)..(322): Xaa can be any naturally occurring amino acid
  misc_feature (325)..(325): Xaa can be any naturally occurring amino acid
MEQYQVGILGGGPGGYVCALRAAQLGLSVVLVEKERLGGTCLNKGCIPTKTLVKSAELWREIKHAEEFGIQLGGALLHYPQIAARKKEVVNTLVSGIEQLMKAKKITVLKGWGEVKEANRIEVTTETGKVELHVENLVLATGSIPTKIPVPGVDLPGVVTSEELLEQETLPDSLVVIGGGVIGLEFASIYHEFGVKVSVVEMLPSLLPNIDEEIPKRLAPLLKRSGLEILTKAFVREIKPKEEGLVVIVEDGKGLKELPAQQVLLATGRRPSLSGIHGDALGLELDRGAIKVNSQMQTSVPKVYALGXMXXXXXXXXXEXLXLPXM

SEQ ID NO: 16497 - protein, 452 aa, Nostoc punctiforme PCC 73102
MQQLKSAEEIPGSYGLPILGETLEIFRDSELYLWRRFQQYGSVFKTSVLGRKRAYLIGPSANRLVLVEQAENMSSRIGWYFLESTFGNNILLQDGEEHRLTRRLMYPAFHGKAIATYFDTIQNIVQDFLKDWGERGTISLNSSFRQLTLMIATRLFLGSQNKSEVEQTSQWFTQLLDSSMAIFKWNVPFTLYGRGQNARGKLVAFLREAIAQRIEQGNLEESKDVLGLLLAAVDEDGNKLSETQVINEALLLLFAGHETTASLLTWVIFELGNHPEWRERLRQEQLAVVGNNPLSLSHLKQFPQLTNVLKEAERLYPPVYAYNRGVLKDIEYGGYRIPAGWFVTISPMLTHRLPELYTEPDRFDPDRFAPPREEDKKHPLALMGFGYGSHSCLGMEFAQMEMKIVLSTLLRHYDWTVKPDYSAIAPVRQPSKVKDILQAYIEPLLIKHPLDS

SEQ ID NO: 16498 - protein, 183 aa, Nostoc punctiforme PCC 73102
MTRLIFLGPPGAGKGTQAQSLAGHLNIPHISTGEILRQAMKEQTHLGIKAQNYVNSGELVPDQLVQDLVQERLNQPDAENGWILDGFPRKVTQAAFLEELLETIHQSGERVVNLDAPDDVVVERLLARGRKDDTEEVIRRRLEVYRAETAPLIDYYRDRQKLLTVNGNQSQEEVTTELQKVIA

SEQ ID NO: 16499 - protein, 276 aa, Nostoc punctiforme PCC 73102
MMQTLRKHYPEYLMEAAGLGIFLISAVVVTTLLEHPASPIPQAISDPLLRRFIIGVAMGLIAICIIYSPWGKQSGAHLNPVVTFTFFRLGKIQPWDVIFYILAHFIGGLLGLLFAVVVFRDAVTNPSINYIVTIPGAGGAGVAFLAELVISFGVMLMILFASNTPKLAPFTGIFAGVMIATYITVEAPLSGTSMNPARTLASAIPSHNWTAIWVYFTAPLLGMLLAAELYIRLKGKRAVRCAKLHHHNNKRCIFRCGYRHPEVDKRWLLSDKLPNP

SEQ ID NO: 16500 - protein, 503 aa, Nostoc punctiforme PCC 73102
MNIRKVSTTPLSDQKPGTSGLRKSVKVFQQPHYLENFIQSIFDSVGDLHSQTLVLGGDGRYYNRQAIQIILKMAAANGIGRIKVGQRGILSTPATSAIIRKYQAIGGIILSASHNPGGPNGDFGVKYNISNGGPAPEKVTEAIYDRSKVIDSYQILEAPDVDLETLGESHLGETVVEVIDSVQDYQELMESLFDFERIQQLLTRGNFRFSIDALHAVAGPYAHAIFEQRLGAPVGTVQNGTPLEDFGGGHPDPNLVYAHDLVDILYGENAPDFGAAFDGDGDRNMILGRKFFVTPSDSLAVLAANAKLVPGYSEGLAGVARSMPTSQAVDRVAAQIGIESYETPTGWKFFGNLLDAGKATLCGEESFGTGSNHIREKDGLWAVLFWLNILAVRQQSVEQIVREHWQTYGRNYYSRHDYEEIQTEQGNTLIERLRSLLPNLKGKQFGNYQVEYSDDFSYTDPVDGSISEQQGVRIGFTDGSRIVVRLSGTGTQGATLRHHVKIT

SEQ ID NO: 16501 - protein, 137 aa, Nostoc punctiforme PCC 73102
MPKQKKIEPLLGEELLKKVKELENESKEDKAKKCGYYTVTKNGIERVNMMKFLNALIDAEGIQLDSTPSANGRGGRSASYRISVQSNGNLLIGSAYTKQMNLKPGDEFIITLGKKHIRLRQVDPEDREGDEAIEATA

SEQ ID NO: 16502 - protein, 324 aa, Nostoc punctiforme PCC 73102
MDIKNGFVGAVGNTPLIRLNSFSEETGCEILAKAEFLNPGGSVKDRAALYIIEDAEKKGLLKPGGTVVEGTAGNTGIGLAHICNAKGYKCLIIIPDTQSQEKIDALIALGAEVRRVPAVPYKDPNNYVKLSGRVAAELENAIWANQFDNLANRHAHYETTGPEIWKQTDGKIDAWTASTGTGGTYAGVALYLKEQNPGIKCVVADPLGSALYSYVKTGEINIKGNSITEGIGNGRVTANMEGAPADDAIQIDDKEALRVVYQLLRKDGLLMGGSTGINVGAAVALAKQLGPGHTIVTILCDSGSRYQSRIFNPEWLASKGLSID

SEQ ID NO: 16503 - protein, 218 aa, Nostoc punctiforme PCC 73102
MTVTQLSAQELFRAAYENRYTWDKNFPGYTANITYKQDDKVFTGKVIITANLKAEVLDVDDEPAQKAIHGQAWEIAIHRVRRSFEDTHSANTFSYGKTDETGAVELLMGGKAEGDKYKVRNNEVCHVHRLIHGTYVTIDTFSSHDTGEGYLSHRYDSVYHDPKTGEQKGGRSEFVDEYEKVGDYFILNRREIRTETAGQISIQEFIFSDIKLLEPVAA

SEQ ID NO: 16504 - protein, 239 aa, Nostoc punctiforme PCC 73102
MGIADFLGLLHPAIAIIFVFPLLGTVINFAWQTRQRRLQILAGSKSKIPPVVGVEHKQLGERLTSAVVGLTLIGLSYPIGKNIIKNQLWNKAPFQVVFILLILAATIASLVFLYRAKQRAWRAVFATLTGAGLVILGCQDGVFRRTNEWYWSHYYIGITAALLMIFSLAVVQDIYQDKSNRWRIVHTILNCIALLLFIGQGMTGTRDLLEIPLSWQEPYIYQCDFANKTCPTPNSVPPK

SEQ ID NO: 16505 - protein, 471 aa, Nostoc punctiforme PCC 73102
MTTLPDLDYVYKQQSQQNQELNLSADDYSLLTDLYQLTMAACYTGEGIEQRRASFELSVRRLPEGFGYLIAMGLTQALEYLAKIRFSSAQIAALQATGIFAHAGDRFWSLLAEGKFTGDVWAVPEGTAVFANQPLLRVEAPLWQAQLVETYLLNTINYQTLIATKAARLRDIAGESATLLEFGTRRAFSPQGSLWAARAALAGGLDSTSNVLAALQLGQQPSGTMAHALVMALSAIEGTEEQAFSAFHRYFPGAPLLIDTYDTIAAAGRLAEKVNSGEMQLTGVRLDSGDLVTLSKQVRSLLPGVPIFASGDLDEWEIARLKAAGAEIDGYGLGTRLVTGSPVNGVYKLVDIDGIPVMKQSSGKVTYPGRKQIFRSYTGGKVKADRLGLLGESSQEEEPLLQLVVQEGQRVQPLESLATIRQRTAVSVASLPQQTRLLDHPVAVEVEISEALRVLTEETKKRTAEALSTQR

SEQ ID NO: 16506 - protein, 466 aa, Nostoc punctiforme PCC 73102
MSSTTVRRKSNTFYVILIAGAAALGGFLFGFDTAVINGAVLSLAKAFNTSSWVTGLAVSLALLGSAVGAFFAGQIADRYGRVKAMVVASVLFTISAIGSGMAFTIWDFIFWRVLGGIGIGVASVIAPAYIAECSPTHLRGRLGSLQQLAIVVGIFVALLSDYFIATSAGSADSPFLFGVAAWRWMFWTAVPPAVFYGMVALTIPESPRYLVAKGRESEAVNVLTKILGGDVLPKIEEIRQTVLRERQPKFSDLLSRSGGLLPIVWIGIGLSVLQQFVGINVIFYYSSVLWRAVGFSEKDSLSITVITGAVNIITTLIAIAFVDKFGRKPLLIIGSIGMTLTLGTMAYIFGNAPLDAAGNPSLAGSAGTVALIAANLYVFCFGFSWGPIVWVLLGEMFNNKIRAAALSVAAAIQWVANFLISTTFPPILQYFGLGSAYGLYTIAAATSFFFILFFIKETKGIELEDM

SEQ ID NO: 16507 - protein, 424 aa, Nostoc punctiforme PCC 73102
MNPEASQTPEPIDERLAEKEEQNNAVEHPVNPSVESVGETGGVSSSENYATFEPLISNAEVVDTTVELTENSNGEFVAQSEPENTALGLEIESENHSLYAEAEQRVAELQKAEAALKEEIVQLQASYKNLQGQVSETQTSLGRLVQESLVQLEQRKQTLQISVEQLERRQERIRNEMRTTFAGTSQDLAIRVQGFKDYLTGSLQDLAVAAEQLQLTPSVVEREKPAVKEAKPVEPQSGIPQFAQQQFQDTTKQIRRLIDQYRNKPDYYGPAWQLRRTFEPIHAERVSNWFFTQGGRGGLRTMGSRLQNILIASAAISILHKLYGDRIRTLVLANTPERLGEWRRGLQDCLGIGRPDFGPDRGVVLFEASDALAQKADRLTKANQLPLIIIDDSEEQISLSLLQFPLWLAFAPDPKTVRNYDDDF

SEQ ID NO: 16508 - protein, 272 aa, Nostoc punctiforme PCC 73102
MTAISDCFETLGHNHECALIPFITAGDPDLETTAKALQVLDQSGADIIELGIPYSDPLADGPVIQAAATRALQRGTKLEHVLEMLQGITPKLRSPIVLFTYYNPILHRGIDKFLQEIAAAGVAGLVVPDLPLEEAAGLLEPAKEMGIDVILLVAPTSDAKRIEAIAHSSQGFIYLVSVTGVTGVRSQLESRVSDLLKQIRGVTEKPIGVGFGISDAAQARQVKEWGADAAIVGSAVVKRLAEGTPEQGLSAIAQLCQSLKAAIKTSTNTPLD

SEQ ID NO: 16509 - protein, 496 aa, Nostoc punctiforme PCC 73102
MKRPGFIERHHLWTEIQKEASEKIKTIVKEQDLLLIRTAWSDQHGIVRSKSLLPQAFFSALENGMQISTGTFLLDTGGAIVFNPFVPGGSLDMPLMTGAPNLVAVPDPDTFKIVPWAKRTGFILCDEYFQNGQPMPFSSRGILRQSLIDLHQRGLEHIVGLEVEWYLAKLEDPMLAIANVGSSGKPGEPAKVSAVDHSFQYLLESHNPEIQDLLGLLAENLVEMKLPLRSVENEGGVGQFEFTFDPIPALQAADTMMIFRMATKQICRQQGYIASFMCRPGLQGSSSNGWHLHQSLVDLTTGENAFMSANSQTLTSDLAKHFVGGLLKHANAASVFTTPTINGYKRFRPYSLAPDRAGWGLENRGAMIRLQGGFDDPSTHIENRVGEPAANPYLYMASQLISGLDGVDCKLDPGSPTEEPYTTENPILPKSLSEAISYLSQSELFPQKMGQQFINFIIKMKESEINRFLQSVADQPPEEYLKQVTNWEQREYFELF

SEQ ID NO: 16510 - protein, 337 aa, Nostoc punctiforme PCC 73102
MKAYEIKSNAGIDALALVDRAEPKPTAGQVLIQVKATSLNYRDLLVAEGAYGAGQKYPLIPLSDGAGEVVAVGEGVTRVKIGDRVAGIFFQDWIYGSLTKEKMKSDLGGGIDGMLAEYVVLHQDALVILPDYLSYIEGATLPCAAVTAWHGLVTKGNIGAGDNVLLLGTGGVSIFALQFAKIHGARAIITSSSDDKLARAKQLGADETINYKTTPDWEKQVYQLTNRTGVDHVVEVGGAGTLPKSLQAVRIGGRISLIGVLSGRGSEIDPMPILFKSLTVQGIYVGSREMFEAMNQAMQQHQIKPIIDRVFPFAEAREAYHYLKSAAHFGKIVIRNS

SEQ ID NO: 16511 - protein, 254 aa, Nostoc punctiforme PCC 73102
MNNTIPAIIFDNIEKNFGSLKVLKGITGEINRGEVVAVIGSSGCGKSTLLRCFNRLETIDNGRLIINGINLSRPTVNYNQLRQLRTQVGMVFQQFNLFPHLSVLENMTLAPRKVLGKTPKESAQLARLYLEKVGLHDKASAYPEQLSGGQKQRVAIARSLCMNPQIMLFDEPTSALDPELVGEVLQVMQQLAAEGMTMVIVTHEMQFAKEVAHQVIFLDKGIVAEKGSAYEVLTNPQSDRLRIFLSRLQVIRNS

SEQ ID NO: 16512 - protein, 291 aa, Nostoc punctiforme PCC 73102
MTLSIAHLGPPGTYAEQAAVLYVNWLTKSTGDEATLSPYPTISQSLHAVADGQAHLAVVPVENSIEGSVTTTLDALWQLDSLRIQLALVLPIVHTLISCASGLDKIETVYSHPQALAQCQGWLERFLPTVQIVPSNSTTEALQRLEQETTTAAIASSRAAQLYNLPILATGINDYPENCTRFWVVSQGEADAGYQTSKVPTSHTSLAFSMPANTPGALVKPLQIFAQLGINLSRIESRPTKRSLGEYLFFMDLEADVKESQMQSALAELTIHTEILKILGAYNVLPIGAFT

SEQ ID NO: 16513 - protein, 476 aa, Nostoc punctiforme PCC 73102
MRRTKIICTVGPATSAPENLRGLVEAGMNVARLNFSHGAYEFHAQTAHYLRQISNEQQKPIAIMQDLCGPKIRLGTLPPEGLNLEAGTEVTFVLQEKGESIDELPLPLPTLFAMVRPGEPILINDGRVKLIVTDRDADRIRAQVKTGGLISTHKGVNLPQTPLPVSSITEKDLLDLRFGIQLGVDWVAVSFVQSPQDLEPAKRMIEAAGASIRLIAKIERAEALENFDSILKVADAIMIARGDLGVEVPIHEVPLIQKDIIRRCNRAGKPVITATQMLESMISAPDPTRAEATDVANSILDGTDAVMLSGETAVGQYPIAAVQMMHNIAVRTEQALDEGSKHAWCHEAGSLSVTESVAESVCRIAYETGSRAILCNTSSGNTARMVSKYRPTSPIIALTSDITAYRQLALSWGVEALLIPPVHHAEEMFTNVVNTVVDMGLANKGDKVVITSGVPIGKSGTTSLIKVHSIGQPISA

SEQ ID NO: 16514 - protein, 434 aa, Nostoc punctiforme PCC 73102
MSEQYRFETLQVHAGQEPAPGNNARAVPIYQTTSYVFDDTEHGARLFALQEFGNIYTRIMNPTTDVFEKRIAALEGGVAALATASGQAAQFLAISTIAQAGDNIVSTSFLYGGTYNQFKVSLPRLGINVKFVEGDDPESFRQAIDARTKALYVETIGNPQYNIPDFAALAHIAHENGIPLIVDNTFGAGGYLARPIEHGADIVVESATKWIGGHGTSIGGVIVDSGKFDWGNGKFPLFTEPAPGYHGLNFQEVFGPSGSFGNIAFIIRARVEGLRDFGPSLSPFNAFLLLQGLETLSLRVDRHVSNALELARWLEQQEQVLWVNYPGLPNHSYHERAKKYLRHGFGGVLNFGIKGGLEAGKAFINHVKLASHLANVGDAKTLVIHPASTTHQQLSDEEQLSAGVTPDLVRVSVGIEHIDDIKEDFQQAFGQVKI

SEQ ID NO: 16515 - protein, 436 aa, Saccharomyces cerevisiae [sequence omitted]

SEQ ID NO: 16516 - protein, 500 aa, Nostoc punctiforme PCC 73102
MLKKLFSFSDRYRILHQTWFAFFLTFVCWFNFAPFATTIGKELHLAPEQIKTLGICNLALTIPARLIIGMLLDRFGPRITYSILLMFAVVPCLATALAQDFNQLVISRLLMGIVGSGFVVGIRMVAEWFQPKEMGIAQGIYGGWGNFGAFGAEFALPILAISTSFFSGGASNWRLAIALVGIITAIYGVIYYNTVQDTPRGKVYKKPKKNGSLEVTSIKSFWAMMISNFGLIFALGLLAWRLEQKKIHFLTLSQMYLTWLVLAGLFAYQSYKAWQVNRELLTGKKTYPVSERFQFGQVALLEFTYITNFGSELAAVSMLPAFFEKTFGLEHVVAGMIAATYPFLNLVSRPSGGLISDKFGSRKWTMTIISVGIGVSYLMAHFINSNWPIPVAIAVTMFAAYFAQAGCGATYSIVPMIKKEATGQIAGNVGAYGNFGGVVYLTIFSLTDAPTLFSTMGIAALICAFMCAFFLKEPKGSFAPAYEGEASETATKSSVFLTEE

SEQ ID NO: 16517 - protein, 326 aa, Nostoc punctiforme PCC 73102
MKTRKLGKLGLEVSAIGLGCMGMSEFYSGRDENEAIATIHRALELGVNFLDTADMYGPFTNEQLVGKAIKDRRDRVVLATKFGNVRTEDGGWKGISGKPEYVYQACDASLKRLGVEVIDLYYQHRVDTTVPIEDTVGAMAELVKQGKVRYLGLSEAAPATIRRAVAVHPIAALQTEYSLWSREPEDEILPTVRELGIGFVAYSPLGRGFLSGAIASPDDLAPDDYRRNAPRFQGENFYKNLQLVEQVKAIATEKGVTASQLALAWLLAQGEDIVPIPGTKRRTYLEENVAATEITLTEEELNRLEAVVPKGIAAGERYPDMSTVNR

SEQ ID NO: 16518 - protein, 303 aa, Nostoc punctiforme PCC 73102
MARITTPFGRHSTASEVAQGIDLSGKRAIVTGAASGIGVETARALAHAGAEVTLAVHNVDAGAKTAADITAITGNQNIHVAKLDLTDRGAIAKFIAAWNEPLHILVNNAGVMALPEQHTPEGWEMQFATNHLGHFALTLGLHDALAADGAARIVSVSSSAHMLSPIVFDDIHFAFRPYDPWLAYGQSKTANVLFAVAGTGRWFRDGITANALMPGAIATNLQRHVGGIQTPAELQKTPEQGAATSILLATSPLVEGIGGRYFEDCNEATIVTQQTKDYSGVAPYALNTNNADRLWEESLRLLA

SEQ ID NO: 16519 - protein, 472 aa, Nostoc punctiforme PCC 73102
MEVDTQHYDDIIIGGGKAGKTLAPALVADGRKTALVERSLNMIGGGCINIACIPTKTMVASANVANTVRNSAAYGVKANTPIVDLAEVIQRKRAVVQSAREMNLHNLETALDKNLIIGEARFVAPKTIEVTTTEGKNRLLTAERLFINTGTRPLIPSIPGLTEVEFLTSESIMELEYLPEHLIVLGSGYIGLEFAQMFRRFGCGVTVIGQSEQILSQQDPDIAIAVQTLLERNGIEFLLKAKVLRVVRKASPLENRTGNETILQIQVGDREITLQGSHLLVAVGRAPNTDSLNLAAAGVATDTRGFIQVNDRLETNIPGIWALGDINGGPQYTHISLDDYRIIKANLIDGGDRSTGDRLVPSCLFIAPELAHVGLTETEAQQQGYAIRVAKIDASAVPRARTLGQTDGLLKAIMDTETGRILGCSLLCHEAGEVISTVQMVMQAQMPYTILRDGILTHPTMTEGLNILFSKL

SEQ ID NO: 16520 - protein, 4682 aa, Nostoc punctiforme PCC 73102
MTSLNCATFVDLLSYRSLSQPNQIAYTFLVDGDTEEVKLTYQELDQKARAIAVELQSLKAAPGERALLLYPSGLEFIVAFFGCLYAGVLAVPVYPPRRNQRMTRLQAIVKDSEARFALTTASVLTNIQQGFAQEPELTALHCIAIDKIVSDASNWQKPPLEKSTLAFLQYTSGSTGTPKGVIVTHGNLLQNSEYIKSAFELTPNSVSVTWLPSFHDMGLIDGVLQPLYTGFPSVMMSPASFVQQPIRWLKAISDYKATHCGGPNFGYELCVSKITPEQRANLDLSSWCSAYSGAEPVRRETLEKFAATFKSSGFQAKFFYPCYGMAEATLMISGGGVADEPVYCVVDPKALEKNQIIQVSEDTPKVKHLVGCGYAWLDTKIAIANPQSLTLCAPEQVGEIWVSGSSIAKGYWNRPEQTKETFHAYLADTAEGPFLRTGDLGFLKDGQLFITGRLKDVVIIRGCNHYPQDIELTVEQSHQALKAGSGAAFSVDIDGEEQLVIVQEVERTYLRHLNLDEVVEAIKTSVSQIHELQVYAVLLLKTGSIPKTSSGKIQRHACRAGFLAGTLNALNTVDVVIEPQLQNPKESKKMQFSLLYFSSNEAEFSDEKYKLFLEGAKFADRNGFTAVWTPERHFHAFGGLYPNPSVLSAALTSLTKRIRLRAGSVVLPLHNPIRVVEEWSVVDNLSHGRVDLAFARGWNPNDFVLSPDTHADSKEVMFSGIQTVQKLWRGENISLPNGVGKQTDIKVYPLPMQRELSIWITCTGGKERFIEAGASGFNILTALLFQPVEELAQKIALYRETRKQHGYDPDSGQVTLMLHTFIGEDIKVVRNQVREPFIEYMKSSVNLWRHGSDDLDKLTETEKANLLAYAFERYFHTSALFGTPSTCLEMVQRLHEIGVDEIACLIDFGIDGNTVLASLDSLNNLRQLVNGVDEPSIKETIESYNQPKTDVLKQTNNAIINNSLPAFSIETSLKIPSRQNEEVQVPQGSLLQWIGEVIVQQIANSLGKKSSQISLDKSFYSFGIDSLKAVEIMETLGEKFGFSISPTLLFEYPTPTEFALYLIQEQKTQLQKYLLVNWEPAKLWAVNLERQKAVVLSNKLFNPASTKVVEPINDRIRAEDIAVIGMSGRFPQSPDLQSFWELLSQGKNAIAQVPSLRWNLSDWYDKNPGAANKTYSCWGGFIDHIDQFDPLFFQISPREAELMDPQQRLFLEVAWEALENAGYSPESFAQSQVGVFVGCSNNGYYQRIAPALNTSDYSAGIGNQNAIIANRVSFLLNLRGPSVLIDTMCSSSLVALHMACRSLQQGECTTALAGGVNLLLSPEYYVGMSRMKMHSPNGRCATFDSQADGIVLGEGAGALLLKPLSQALKDGDRIYAVIKGSAVNHDGRTNGITAPNSRSHAEVICQALDAAGISADTISYVEAHGTGTSLGDPIEVEGLTKAFRKYTERKQFCKIGSVKTNIGHLECAAGMAQLLKVILAIQHRQIPANLHFQQPNPLIPFAETPFQVNTKLCSWESSGLRRAGISSFGIGGTNAHIVIEEAPPLEPVIPEIERPKHLLTFSAKTENALVQLVSRYETYLAANLDLPLGDICFTANTGRSHFQHRLSAIATSTSDLHQRLLNFISQQEVTGIKIGRIHENTPPKIAFLFTGQCSQYVGMGSQLYETQPTFRKILDYCNEILRPYLKEDLLKVIYPQPGETSLIDQTAYAQPALFALEYALVQLWKSWGVEPSVVMGHSVGEYVAACVAGVFSLEDGLKLIAERSRLMQSLPQTGAMVAVFACEADIWAITEIDLAEVAFAPRLEEKPSVGIAAYNGPQNTVISGEREAIERICANLKAAGIQTKKLVTSYGFHSPLMEPILAEFRQVAATVTYNAPQIDIISNVTGQLIGEAINPEYWCDHLISSVQFAKSIQTLHTADYEIFVEIGPKPILLGMGSKCLLGKGLWLASLRQGREDWQQILESLGELYVHGVQVEWSGFDRDYFRRRVQLPTYPFQRKRYWIDAPVSTSDNKFDTQKSLPSQLSTSQFDTEIAPPLKALQPKVDTTPQIKRLDLIVSKLHSYIVNLLKAEPSEVDFYAPFLEIGADSLMLIDAINYIDITYRIKITISQLFEQLTTIYAVASYIDQNLLPEPIFVDVQLPEPVYQTQPPTPQSPPLAFVESNGNGHSHTQQPTLKSTVQQTAGETAVERIMLQQLQVMSQVMSQQLDVLRATGNVLSSNGNSHLASSPPTPQNQVVKETGIAINQVQSNQTVTKNFSPIEPPPPREINQPQQQHLKTLISNYTQKTQSSKQYAQTYRSFLADSRAVAGFRPSTKEMVYPIIGERAKGARCWDIDGNEYVDITMGFGVLLFGHAAPFITAAVDEHLQQGIQIGPQANYAGEVAALISELTGMERVTFCNSGTEAVMTALRLARTKTGRSKIAIFAGSYHGHFDGILAKESLDGLSTVPIAPGITANAVEDVLVLDYGEPKSLEILQAHAAELAAVLVEPVQGRNPDLQPREFLQQLRQFTAVAGVALIFDEVLVGFRIHLGGAQAWFGIEADIVTYGKIVGGSIPIGVVAGKASYMNGIDGGLWNYGDASYPQVEKTFFAGTFNKNHLGMAVARAVLKYLKSQGPALQQHLNQRTSDLAIALNTYFEQEEVPIKIVYFGSLFRFAFSGNFDLLFYHLIYKGVYIWEGRNCFLSTAHTDEDIEYVIQAVKHSIEEMRAVGFIPKRSPKLSAGSNGNGTVKTTQNGVLTKPVVTESVPVLEAIAREGKLPLSLAQQRLWFLDQLEPNSAFYNIPAAVRLQGQLNVAILEQSFREIIRRHEALRTNFITLDGQPHQVIHPNLNWQISVVDLQHLPVSKRENESQKIAIAEAQRPFNLETESLVRATLLVLSQTEYILQVTMHHIVSDGWSMSILIEEFTALYTAFSQGQPTPLVELPIQYVDFAVWQRKWLQGTVLQSQLTYWKKQLSGAATILSLPTDRPRPTMQTVRGAHQPFALSFELTEALKALSKKEGVTLFMTVLAAYNILLYRYTGQADILVGSPNASRNRPEIQGLIGYFLNILLLRADMSGNPSLREFLKQVRKTALGAYAHQDVPVEELIEALQPVRDLSYTPLFQVMFILDSATPISEMQLPGVTWSSMTVENYTSKLDLTLTLENTAQGLVGEWEYNTDLFEAATITRMAEHFRNLLEGMVANPEQRIAELPLLAAWERQQLLVEWNNTQREYPHKCIHQLFEEQVELTPNAVAVVFGNQRLTYQELNSRANQLAHYLQELEIKPDTLIGICLERSLDIFVGILGILKTGAAYVPLDPDYPQERLDYMFSDSQVSILLTAKKLVTQIPRHSAQLVYLDADWDVIATKSQQNLASEVKPENLAYVIYTSGSTGRPKGVMVPHRSLVNAYFGWEQAYELRTKTSSHLQMANFSFDVFTGDLVRGLCSGAKLVLCPREWLLTPELLYKLMQEEKVDCAEFVPAVIRNLIAYLEKTKQNLDFMRVLAVGSDSWYVKEYEEFQRFCGLETRLINSYGVSEATIDSCYFESTNVKLPVEALVPIGKPFPNVQIYILDSDLQPVPIGVLGELYIGGAGLAHGYLNRPDLTQERFIANPLSNEPTSRLYKTGDLARFLADGNIEFLGRIDNQVKIRGFRIELAEIEAVLRQYPTVSQTVAMAREDIPGDKRLIAYVVGNQESVPVISDLRRFLKEKLPEYMIPAAFMVLQTIPLTPNGKVNYRELPAPEISRAGLEASFIAPRNPIEEILAQIWVDVLGVKQVGIHDNFFELGGHSLIATQLISRIRTALKVELPLRSLFEASTVADLAERIALQQDAPHLNAPSLQSVVRDGQLSLSFAQQRLWFLNQLEPNSALYNIAGTARLQGELNVIALEQSLGEIIRRHESLRTNFITQEDGQAVQIIRPDAAFTMPVVDLRQLSASEQEIEIQRLATVEAQQAFDLANQLLIRATLLVLSKTEHILLFCMHHIVSDGWSMGVFVQETAAIYGAFSQGQPTPLPELAIQYVDFAVWQRQLLQGEIKESQLAYWQQHLAGATALLELPTDRPRPAVQTFRGANQSFVLSFELTGSLILLSRQEGVTLFMMLLAAYDTLLYRYTGQTDILVGSAIANRNHNEIEGLIGFFVNTLVFRTDVAGNPSFRELLNRVREVALGAYSHQDLPFELLVETLQPERNLSYTPLFQVAFVLQNAPMSEIELPGLTLSSMTPDNKTAKFDLTLTLENTATGLMGVWEYNTDLFEASTIERMTGHFQTLLESVVIQPEQRIGELPLLTAKEQYQLLEEWNHTQKDYLGNICIHQFFEMQVERTPDAVALVFENQQLTYRELNQQANHLAHYLRTLGIRVDVLVGLCVERSLEMLVGLLGILKAGGAYVPIDPEYPQERISHILSDSQVSLLLTQHRLVARLPEHQATLVVIDESWEQIIQHSQENPISGVKDSDLVNVIYTSGSTGKPKGVMVKHSGLCNLAQAQIDLFDLLPSSRILQFASFSFDASIWEVVMALGSGARLYLGTKESLLPGLELIELLRDYGITHITLPPSALAVLPQAELPALQNIIVAGEACAPDLIKQWSVGRRFFNAYGPTETTVCATVAECGNGERSDKPPIGRPIPNTQAYILDSYLQPVPIGVPGELHIGGAGVAQGYLNRPELTTEKFILNPFEDSAALASPRASAEGSRLYKTGDLARYLPDGNIEY

SEQ ID NO: 16521 - protein, 439 aa, Nostoc punctiforme PCC 73102
MLSIPINLNLPRIPHLITSLPGPLAQAIVQRDRAVTSPSYTRDYPLVVSRGQGCMVEDVDGNVFLDMTAGIAVTATGHAHPEVVKAIQEQSERLLHMSGTDFYYEPMVELAEQLAIRAPFPQPQGNSAFPAKVFFTNSGAESNEGALKLAKYYTKRSLIVAFLGAFHGRTYGAMSLTGSKAVQRANFGPLVPGVTHIPYGTHASLDYLEQQLFGTILPPQEVAAIVVEPIQGEGGYIVPEDGFLKRIRDICDRHGILMVVDEVQAGMGRTGRLFAIEHWGVMPDIITTAKGIASGLPLGAILAKPELMTWPPGSHATTFGGNPVACAAGIATLRLLESGLMANATQMGELLQASLSELHQRFPRVSPPRGKGLMVAVDLLDEQGNLDRELRDRIIQEAFLRGLLLLGCGKAAIRFCPPLVIDSDQIQIALQIISNILTS

SEQ ID NO: 16522 - protein, 320 aa, Nostoc punctiforme PCC 73102
MRIAKDITELIGRTPLVQLNKIPQASGAVARIVVKLESMNPASSVKDRIGASMVEMAEEAGLIHPGKTVLVEPTSGNTGIALAMVAAAKGYHLILTMPDTMSHERRSMLKAYGAQLELTPGVEGMRGAIGRAEQILAQTPNAYMLQQFRNPANPKVHAETTAEEIWNDTDGEVDILVAGVGTGGTITGVAEVIKGRKPSFQAIAVEPSSSPVLTGGKSGPHKIQGIGAGFVPAIYRPELVDEVIQVADEQAIAYSRRLAKEEGLLSGISTGAALYAAIQVAQRPENAGRLIVMIQPSFGERYLSTSLFKDPEENEWLSKV

SEQ ID NO: 16523 - protein, 2210 aa, Nostoc punctiforme PCC 73102
MNNISKKVDKDKLEQLNSSQRILLALDEAVKKLKDVERAKTEAIAIVGLSCRFPGGVTNPEEFWQLLIDGVDAITEIPSQRWHLEDYYHPNPDTPGKMYSRYGGFLQQVDQFDAQFFGISPREAIKLDPQQRLLLEVTWEALENAGIIPQEQVNGQTGVFIGITTNDYARLITPGGDLSQIDPYYLTGNPLNAVAGRLSYTLGLHGPCMAVDTACSSSLVAVHLACQSLRNQECDRALAGGVNLILSPENNIGLSKAKVLSADGRCKTFDSEADGITRGEGCGVLVLKRLSDAVADGDRILALIRGSAVNQDGASSGFTVPNRNAQENLIRQTLTRANVKPEEVDYVEAHGTGTSLGDPIEVRALAAVLGAGRTAENPLKIGAVKTNIGHLESAAGIAGMIKVILSLQHQQIPPHLHLKQLNTHINWDELPVSVTTQATPWPVGNKQRLAGVSSFGASGTNAHVILAEAPTNNSLSKPQNAKFIERPQHLLNLSAKTEKALRELVQRYINYLQSNPEKSLADICFTANTGRSHWKYRLSILADSTMSALAQLTTWALGQDLPGVVLGEAESTSKKIAFLFTGQGSQYAGMGQKLYQTQAKFRQIIDQCDQILQPYLDKPLLEVLYPQPDTNSPIDNTAYTQVALFALEYALYQLWQSWGIKPDVVMGHSVGEYVAACVAGVFSLQDGLKLIAARGQLMQALPENGAMVAVMTTAEQLQPLLAAYKEKVAIAAVNAPQSLVISGEKSAISAITSQLETAGIKTKPLQVSHAFHSPLMQPMLADFLQVASQIKFSPPQLKLISNVTGELATTEIATAEYWCRHILNPVEFAASMVTLQQQKVAICVEIGPKPILLGMGRQCNPTVEGLWLPSLRSRQDDWQVMLLSLAQLHCHGVAVDWLLFDADYSRVRLHLPTYPFQRQRFWIETVDGQRDQPALISRNGKGRKIIHPLLGQRLPLATSQSIHFESQISAASPTFLQDHCIYDATILPATAYIEMALSAGAIVFKTDRVQLEAVSIQQALVFSGDEPKTLQVVLTPENTRVYSWQVLSYLEDESNVDNWTLHASGKVGLGNAETHSAAVDLAGLLSEDSTEISVKEYYQSLHDRGFDYGEQFQAIARLWQGETQAVGSVRLPLPLTADASKYLLHPVLLDACFQILGTNFPDNGQQDVYLPVGVEQLQVYQRAGNSLWSRVEKIEFQDVKQQHLQADLSLVNDAGELVAKITGLSFRRITQKAFQRILAKVLPAPQTTDNWLYQIAWQRQNLEPASSNKQPSSWLIFADQGGLGQKLAQLLTAAGDRCIMVSAGAVYQQLQADRYQINLAHPEDFGRLIQDNPCQGIVHLWSCDATTEPQLTSCGSVLFLLQAIYNAKLPALPSLYLVTKGTQTVGGQLTPLQVQSATLWGLGRVIALEHPELHCVRLDINPDAPEDHIPSVAQELLVPSREDQIAYRQGLRYVARLVRSDVAREADVNSQAFQLQISEYGVFENLTLAAMQRRQPGPGEVEIAVRAVGLNFRDVLNALGMLREYTEQMGITDAKELPFGGECSGIVVAVGENVSHLQVGDAVIAAQTIGSFASFVIVRSEFVVRKPENLTFEEAATIPTAFLTAYYGLYQQAQLKSGERILIHAAAGGVGQAAVQLAQRVGAEVLATASPRKWEHLRATGVKQVMNSRSLEFADQIREITSGQGIDVVLNSLNGEYIPKSLEVLSDRGRFIEIGKIGIWDAEQVKDSRPDVGYIPFDLLDISLENPSLIGEMLGELMAEFQQGSLKPLPVSVFSIQDVANAFRYMAQSKHIGKVVVSIPQRQMPKETTIQADSSYLITGGLGALGLQVAQWLVEQGAQNLVLMGRRGVSPENQPAIEQLEQAGARVLVVTADVSQQEDVSQMLATLNASMPPLRGIIHAAGLLADGMLLRQTWENFELVMAPKVAGAWNLHTLTKELDLDFFVCFSSVSALLGSPGQGNYAAANAFMDALAHHRQALGLPGSSINWGPWADAGMAAALSSREQARWAAQGVQPIPLEPGLQILAKVVQQNLAQVGVLPVDWSKFTAQFPSDVELPFLAEFTNAISKVTPQVAELRQQLEAAAPKQRPILLMNYVRSQIAKVLNLTSTEEIDPKEGFLQLGMDSLMAVELRNRLQSSLGCSVPASLIFDYPTVDALVSYLIQELWTDRPPEPSTENSPPPAQGIAESELEELSDSEAEALLLSKLDNLKY

SEQ ID NO: 16524 - protein, 445 aa, Nostoc punctiforme PCC 73102
MGKQQIWKNWWENHTCTPEHYYQPEQIDEVVEIIKSANLEQKQIKVIGSGRSWSDIPCTDGYMISLDKFNQVLDIDIEQKTVIVKSGIRIYQLVDILAKHGLALSSLGSICEQSIAGAISTGTHGNSLHQGGLASSILELELVNGIGEVIKCSKSENPDLFSAALIGLGAIGIITQVKIQCCNQFWLTETLQCWNIKDVLENLDTLKKNDYCRFWYTTTNKDAIVQTFSDSQILEKTGFIHFIKRIITQIFWFLWISWHDNPAEHDSQSFTRKDESQHILCYPRFFLKLYKLSFRMTKYCQNVLISEYGIPEEMASIAMNKILSLVDRGIIKGHLRFEVRFGAAEDVWLSTAYQRPTCYIQVLFEKKNFTSTQDQNDAFIQVENIIKNLAGRPHWAKDHLYTNDDLRSTYPRWQEFLQIRQQTDPQQCFTNSYLNKIFDDVRRTA

SEQ ID NO: 16525 - protein, 117 aa, Nostoc punctiforme PCC 73102
MPLIKVQTSVSAPQKAEIESMLLNLSAKLAKHLGKPESYVMTAFEPEIPMTFAGNTDPVCYIEIKSIGTMKPDQTAAMSQEFCQQINQTLGVPKNRIYIEFADAKGAMWGWNGTTFG

SEQ ID NO: 16526 - protein, 476 aa, Nostoc punctiforme PCC 73102
MSYAQTKTQSKSGYQAGVKDYRLTYYTPDYTPKDTDLLAAFRMTPQPGVPPEEAGAAVAAESSTGTWTTVWTDLLTDLDRYKGRCYDIEPVPGEDNQYICYVAYPLDLFEEGSVTNVLTSIVGNVFGFKALRALRLEDIRFPVAYIKTFQGPPHGIQVERDKLNKYGRPLLGCTIKPKLGLSAKNYGRAVYECLRGGLDFTKDDENINSAPFQRWRDRFLFVAEAINKAQAETGEIKGHYLNVTAPTCEQMLQRAEYAKELKQPIIMHDYLTAGFTANTTLARWCRDNGILLHIHRAMHAVIDRQKNHGIHFRVLAKALRLSGGDHIHTGTVVGKLEGERGITMGFVDLLRENYIEQDKSRGIYFTQDWASLPGVMAVASGGIHVWHMPALVEIFGDDSVLQFGGGTLGHPWGNAPGATANRVALEAVVQARNEGRNLAREGNDIIREAAKWSPELAVACELWKEIKFEFEAMDTV

SEQ ID NO: 16527 - protein, 143 aa, Nostoc punctiforme PCC 73102
MRLRSLTVVFISCLIALLSWVITPPAIALTQIKLFDVSYKDCPPELAQGAVISSGSAAANCFIVIGKAENGTNKTVYDADIFGRIYDANNDSVMQNRTRLGSITEVPPGISDFQLRITVPANQPTPLKLKQFKAAGFSGQVRR

SEQ ID NO: 16528 - protein, 325 aa, Nostoc punctiforme PCC 73102
MSNSRVLCLGEILFDCLADQLGLKLEEVKSWTPYPGGAPANVACALVKLGTTAGFIGAVGEDEPGNALVKLLQDVGVDTTGVQRHPTAPTRQVYVTRDLAGDRTFAGFGQYDTAEFADTRLQAKQLPDALFQEADFLVLGTLELAYPESEQAIYRALELAEHYDLKIVLDINWRPVFWDEPKIAHQKIPELFKRVDFLKLSKEEAEWLFETADPGAITYRLASIEGVLVTDGENGCTYCLGENEGKLPSFSIPVVDTTGAGDSFLAGFIHQLSHYGIHSLRDAETAKRIVTYASAVGALTTIKPGAIASQPTDAEVEAFLASHQL

SEQ ID NO: 16529 - protein, 308 aa, Nostoc punctiforme PCC 73102
MAVSVVKKLDKLTTTELSAWVQQAKIQAKQGRVLDRIPQLALADPDWFAVHVCCESGKNISFGDTACIFPLMSVIKTFSLLYLLEHFGAETVFSWVGVEPSDAPFNSLEQLVSDRGRPRNPMINSGAITLADKLPGKDATQRTLLFCQWLNQLAGCQLSLDEVMLASVRLTRSTANEAITNYLTETGYLENLEIALDTYEQICCISGRIKDLALLGKLLACDGLVNPQNRRIVNAVMLTCGLYEASAEFAVRIGLPMKSGIGGGLVAIVPGEGAIACYSPGLDNIGNPVAGLVFVEAFSQKLELSIFG

SEQ ID NO: 16530 - protein, 337 aa, Nostoc punctiforme PCC 73102
MAATDFKDYYAILGVSKTATQDEIKQAFRKLARKYHPDVNPNNKQAEARFKEVSEAYEVVSDVDKRKKYDQFGQYWKQAGEGFPGGGVGADMGGFDFSQYGNFDEFINELLGRFGGAAPRGGGGRQSYSQSYSYRPPTGAPSGFGGFNDYGFQDPGAGTSQDSEAIITLTFAEAFNGVQKRFSLGNETIDVRIPSGAKPGTRLRVRGKGQINPMTQQRGDLYLKVELQPHSFFQMEGDNLVCEVAITPDEATLGASIDVPTPDGSVNVKLPAGVRSGQSLRLRGKGWPLAKGGRGDQLVKVAIAPPKDLSQQEREYYEKIRAIRTYNPRSHLQQVKL

SEQ ID NO: 16531 - protein, 458 aa, Nostoc punctiforme PCC 73102
MTFDYDLFVIGAGSGGLAASKRAASYGAKVAIAEYDLVGGTCVIRGCVPKKLMVYASHFPALFSEASGYGWKVGNAELDWEYFITSIDKEVRRLSQLHINFLEKAGVELFSGRATLLDSHTVEVDGRKVTADKILIAVGGRPIKPDLPGMEYGITSNEIFHLKEQPKHIVILGAGYIGTEFACIMRGLGSEVTQITRGDKILNGFDEDVRTEIEEGMTNHGIRLIKNNVVKTVERVAEGFKLTLSGEDQEPIIADVFLVATGRTPNVDGLGLENAGVDVVASSIEGPGYPTTSAIAVNEYSQTNQPNIFAVGDVTDRINLTPVAIGEGRAFADSEFGNNRREFSHKTVPTAIFSNPEAATVGLTEAEAREKLGDAVTIYRTRFRPMYYTLTGKQEKTMMKLVVDSNTEKVLGAHMVGDSSAEIIQGVAIAVKMGATKKDFDATVGIHPSSAEEFVTMR

SEQ ID NO: 16532 - protein, 452 aa, Nostoc punctiforme PCC 73102
MAFDYNLFVIGAGPGGLAAAKKAASYGVRVAIAEQESIGGTCVNRGCIPKKLIVYAADFALQKQIAPSYGWSECQTYFDWTLFIKSVHQHLDTLNQSYFQQLHKAGIELISDRATFIDAHTVDINGLKVTADKILIAVGGQPLKPKIPGIEYAITSREMFQLPYLPKRLAIIGGGYIGVEFSSMMHAFGCQVTVIEKDEMILSGFDDEIRSAVEQGLRKRGIKLLTSSTVQEIKYSDESLLLTITGKKREIITADTILVATGYAPNTKNLGLENAHVELGEHGAIKVDEYSRTTQENIFAVGDCTSRVQLSPVAKAEGIAFANTVFGNKVQKLDYDYVPSAVFCRPEAAGVGMTEAKAREKFGESVQCYYTQFQPLLYQLTDQNEPTTMKLVLNGDSGQVLGAHLVGEHAADIIQSLGVAIRKGITKEDLDEIIGIHPTVGEEFFSLDRVQE

SEQ ID NO: 16533 - protein, 370 aa, Nostoc punctiforme PCC 73102
MTTEINLFSSYQLGNLELPNRIVMAPLTRNRASKGNVPYELNATYYAQRASAGLIISEATQVTPEGQGYPATPGIHSPEQVEGWKLITDAVHQQGGRIFLQLWHVGRISHPDLQPNGALPVAPSAIAPKGEAATYEGPKPFVTPRALETSEIPQIVEQYRQGAANALAAGFDGVEIHSANGYLIDQFLRDRTNQRTDKYGGSIENRTRFLLEVTEAVTSVWDSNRVGVRLSPSGTFNDIGDSNPLETFGYAAQALNQFNLAYLHIYEATEADIRHGGIIVPTSHIRDRFTGTLIVNGGYTREKGDAVLANKAADLVAFGTLFISNPDLPRRLALNAPLNEANQATFYGGGEQGYTDYPFWSAANEAVAKA

SEQ ID NO: 16534 - protein, 235 aa, Nostoc punctiforme PCC 73102
MTQNLSQKPIVISPSILSADFSRLGDEIRAVDAAGADWIHVDVMDGRFVPNITIGPLIVEAIRPVTTKPLDVHLMIVEPEKYVEGFAKAGADIISVHCEHNASPHLHRTLGQIKELGKKAGVVLNPGSPLELIEYVLDLCDLVLIMSVNPGFGGQSFIPGVLPKIRKLRQMCDERGLDPWIEVDGGLKANNTWQVLEAGANAIVAGSAVFNAKDYAEAITSIRNSKRPTPELAKV

SEQ ID NO: 16535 - protein, 441 aa, Nostoc punctiforme PCC 73102
MVFKTATEQLIVLKNVSKSYQQPNGQQIVILENINLELRPGEIVALLGPSGSGKSTLMRIVAGLIPPSQGEVIYHNRPLVGLNPGVAIVFQSFALYPWLTVLENVELGLKAKGEAPDSRRQKALRMIDIIGLDGFENAYPKELSGGMRQRVGFARALAVEPELLCMDEPFSALDVLTAENLRFELLDLWLERRIPTQAILIVTHGIEEAVIMADRIIVLGRNPGRIRADLPVTLPHYRDRKHPTFQALVDRVYTIITNPELEKIELTTTTSVEPATPPAKYQSLPSVRTGSIAGLLELLEDRQEKDLYRLAQELQLEVDDILPIVEAAKLMDFVELAEGDISLKPVGQEFINGGIDERKQIMRSQLLANIRLVQQIYRLLEAKNNQRIPEELVLDILESHFSPEEAERQLKTVVDWGRYAEIYGYDEPSGQIFLEQVVVSH

SEQ ID NO: 16536 - protein, 244 aa, Nostoc punctiforme PCC 73102
MCPLPQQPSHTTKPPRAVFPQEIPSGSSLQSDFAQDSIFAFPPNRDTLGGTSYFIVRNEGNILIDCPALNQTNQDFLAAHGGVRWLFLTYRGAIGKTAEIQKALGCEVLIQEQEAYLLPGLPVTTFSQEFTLDAAVKIIWTPGHSPGSSCLYYSKLGGILFSGRHLVPNQKGEAVPLRVTKTFHWPRQINSVQLLLQTFTPETLKYICPGANTGFLRGKRFIDRAYQHLASLDLPALLRMQPLL

SEQ ID NO: 16537 - protein, 494 aa, Nostoc punctiforme PCC 73102
MTQTNNKNNLLEEPDLGTFIAQTTATDKWQVLSYKAPILPIHAALLRTGKIFFFCGSGNDPARLNTPYDSVVWDVNKGTFTHQAPPLDSNNQPIDLFCAGHSFRSEGLLMVAGGTLRYDPFYGSPSALLFDPITEKWVKIPSMNNGRWYPTVLTLGSGRIFALSGPDKDGKLNRQPEIYSVTFSNGWNAFPITSPFPAYAQLFLLSSGKIFYSGAQMGNSGVAPTILTLPDTFTQSIAEKVVPGLQNPDFGNQGASVLLPPAQDQKVMIIGGGNSTTATNRVNIVDLKATNPTYVAAKSLNYARMHHSAVLLPDRTVFVCNGSKMSEDTTQSMLPAEIYNPATNTWTVVAKQSVPRVYHSVALLLPDGRVVAAGGNPQRTVNELRLEIYSPAYMSRSRPIIQSAPQTLSYGLQFTIQTPQAGNIKWVSLIRPMATTHSCDTEQRIVDVPINSRNSTSLNVTVTNNRNIAPPGWYMLFISDSNGTPSVATWTRIF

SEQ ID NO: 16538 - protein, 355 aa, Nostoc punctiforme PCC 73102
MAHLFEPFKIREVTFRNRIAVSPMCQYSSTNGYANDWHVIHLASRAVGGAGIVFTEAAAIEPRGRISPQDLGIWSDAHIETLAKTVALIHNFGAVAGIQLAHAGRKASTAKPSKGGKTLDESQEGWRPLVSSSAIAFSQDSPVPEALSLKGIQEVIDAFVQGAKRSLQAGFKLVEIHAAHGYLLHQFLSPLANQRQDDYGGSFENRTRLLREVVQAVREVWPQTNPLWVRISATDWVDGGWDIEQSIALSDKLKSLGVDLIDTSSGGIIPGVKIPIQPGYQTQFAERIRREANIHTGAVGLITAPEDADEIIRTEVADIVLLGRELLRNPYWPHLAAKQLGHDKLWPVQYDRAWL

SEQ ID NO: 16539 - protein, 134 aa, Nostoc punctiforme PCC 73102
MTPNENNTQSNINELPPHSGTRYWGEVEVIEEGDTYRISRVEIKPRHGIKPQIHYHRNEHWVVVSGVAKVTCGDAEILLNRNESTYVPAATLHKVENPGHIPLVILEIQNGEYLGEDDTERPYDLNLVKSVTEG

SEQ ID NO: 16540 - protein, 478 aa, Nostoc punctiforme PCC 73102
MPVVTNSIKFGTDGWRGVIGDEFTFERLALVAPVAAKVLYDTYFSTVGSRTIIVGYDRRFMAEDFARAVADTVSAVGFDVLLSEDYAPTPAYSWAAKELNALGALVITASHNPGKYLGLKVKGYFGGSVPSEVTKKIEEQLSVGVPLAATPGKQEKFDPWPSYTQALERKVDIAKLREAIASGKLTLFADVMHGAAAGGLARLLGNQVKEINSQRDPLFGGGAPEPLPKYLSKLFEVIKTHRETDKSGLTVGLVFDGDCDRIAAVDGEANFLSSQVLIPILIDHLTLRRNFSGEIVKTVSGSDLMPLVAALHNLSVFETAVGYKYIADRMLVAKVLLGGEESGGIGYGSHIPERDALLSALYVLEAIVESGLDLGEYNRYLQKQTGFTSAYDRIDLPLASMEVRSRLLQQLQTKPLTEIAGLAVIDCQTIDGYKYRLADQSWLMIRFSGTEPVLRLYCEASTIEQVHQTLAWAKQWAG

SEQ ID NO: 16541 - protein, 375 aa, Nostoc punctiforme PCC 73102
MAQIVMQNQRGITTFQPLDVELRNVFKFFNQEPAVHGIDLDVRQGEFFSILGPSGCGKTTTLRLIAGFEIADAGKVLIQGQSMTNVPPYRRPVNTVFQSYALFNHLNVWDNIAFGLRLKKIHKSEIEIRVQEALKLVKMESLRSRFPSQLSGGQQQRVALARALVNRPTVVLLDEPLGALDLKLRKEMQIELSNLHKDLGVTFVMVTHDQEEALSLSDRIAVMNQGKIEQVGTPSQIYERPQTSFVADFIGDTNLFSGEIVAVDSSSIKISTKTGLSIIISRAEDTPSQLSQAVVVSVRPEKIQLSLYPPNLPANCFEGRLINVMYLGTHVNYVVELTNGIRINVLQPNTFGALPGSDTPIYAWWAENDCLAINQ

SEQ ID NO: 16542 - protein, 159 aa, Nostoc punctiforme PCC 73102
MKSQEEELLDGQDKTPKQSLSWTEALLATTGPFQQISLSQVQQISPTALAYLGDAIYELYVRMFYLLPLQRSGIYHSLVVEQVRAETQALHLRSLTPHLRDTELEIVRRGRNAATGRLKRLNPEIYQQATSLETLIGYLYLTDYQRLTELLQMLHVEKE

SEQ ID NO: 16543 - protein, 507 aa, Nostoc punctiforme PCC 73102
MAKPKTFFTCNECGAESPQWFGKCPACGTYNSLEEQISIQSSVDVPSRGGVSSWQSAQGNGKSHNKPAKARASLTFDQITDRQIARWESGYGELDRVLGGGVVPGSMVLIGGDPGIGKSTLLLQVSNQLAQKYRILYVTGEESGQQVKLRASRLGVSKPLSVVNEEKVTVVDPTLPIDPDSIGADLYVLPETDLEEILREIDSLKPNVAVIDSIQTVFFPALTSAPGSVAQVRECTAALMKVAKHEDVTMLIVGHVTKEGAIAGPKVLEHLVDTVLYFEGDRFASHRLLRTVKNRFGATHEIGIFEMVTDGLREVSNPSELFLGNRDDPAPGTAIVVACEGTRPIVVELQALVSPTSYPSPRRAGTGVDYNRLVQILAVLEKRVGIPMSKLDSYVASAGGLNVEEPAVDLGIAIAIVASFRDRIVDPGTVLIGEVGLGGQVRSVSQMELRLKEAAKLGFKRAIVPKGTKFPDLNIEILPVSKVIDAIIAAIPHQELTADDLEPDEDE

SEQ ID NO: 16544 - protein, 1056 aa, Nostoc punctiforme PCC 73102
MTNGKVRIYELSKELNLDNKELLAICDQLSIAVKSHSSTISESEAENIRTAAEKLAATNVSAKKELGTTSHKPNSPPNGGRNRPAAPHKQQILEIRKPKILRNTTSNAPEASVANNTQAALSEANPPSPPRPFATPASPMKPAAPTRPVPRTQSETQEQPPVTDLEQTPNPSQAPEKVASQKPEKVVPPRPKSEKPQKPQLVAPPARPAAEVAQAEVAQVSDEPVSQADKPILKRDQRLRPVEGDREQIKPRVAKLPTDQSPQSAPQRQARPTPAPTRPEQRGNRPSAPSQLGEGQRPRPARPGESVAAAMPIATPPRQMSGIAGKSQGLGDEPVTPDLLDLKRPSPPRPTKGGKKWVEEEIIDEVKEKAKAGVKGKRIKPILDDEFEEDLLDDDDIDSPATVQVSLSIARPPKPKATRPVQMPGASLASAPTARGSRKPGSKSGSNRDHHNNRRQQEADTKRDRPEKVTITGPLTVQELSDVLAVPDTEIVKILFLKGMAVSITQNLDIPTITLVGKELEIEVETVEREAEARKITEMVGAEDQEYLHRRPPVVTIMGHVDHGKTTLLDSIRKTKVAAGEAGGITQHIGAYHVDVVHEGKPQQIVFLDTPGHEAFTAMRARGARVTDIAVLVVAADDGVRPQTIEAISHAQAAGVPIVVAINKIDKEGAQPERVKQELTQYGLTAEDWGGETIMVPVSAIRGENLDTLLEMILLVAEVGELSANPDRTAKGTVIEAHLDKAKGAVATLLIQNGTLHVGDILVAGSAFGKVRAMVDDRGKRVDIASPSFAVEVLGLSDVPAAGDEFEVFQNEKEARSLASDRADRQRLSRLLQGRVTLTTLSAQAQEGELKELNLILKGDVQGSVEAIVGALKQIPQNEVQIRMLLATAGEITETDIDLAAASNAVIIGFNTTFASGARQAADEAGVDVREYNVIYKLLEDIQDALEGLLEPELVEEPLGQTEVRAVFPVGRGAVAGCYVQSGKLVRNCKVRVRRGGKVIYEGVLDSLKRMKEDAREVNAGYECGVGMDKFNDWVEGDIIESYQMVTKRRTLTLTR

SEQ ID NO: 16545 - protein, 473 aa, Nostoc punctiforme PCC 73102
MTTPQELLKKIQDEKIQLIDLKFIDTVGTWQHLTLYQNQIDETAFTDGVPFDGSSIRGWKAINESDMTMVLDPNTAWIDPFMEVPTLSIICSIKDPRTGEPYNRCPRVIAQKAVDYLVASGIGDTVFFGPEAEFFLFDSARFAQTANEGYYFLDSEEGAWNSGKEGTAEKPNLGYKPRFKEGYFPVAPTDSFQDIRTEMLLTMAELGVPIEKHHHEVATGGQCELGFRFGKLIEAADWLMTYKYVIKNVAKKHNKTVTFMPKPIFGDNGSGMHCHQSIWKDGQPLFAGDKYAGLSDMALYYIGGLLKHAPALLAITNPSTNSYKRLVPGYEAPVNLAYSEGNRSASIRIPLSGKNPKAKRLEFRCPDATSNPYLAFAAMLCAGIDGIKNKIHPGEPLDKNIYELSPEELAKVPSTPSSLELALQALENDHGFLTESGVFTEDFIENWIDYKLNEAKQLQLRPHPYEFYLYYDA

SEQ ID NO: 16546 - protein, 437 aa, Nostoc punctiforme PCC 73102
MKTNQIPPGSFGLPVLGETLSFVFDRDFAKKRYHQYGPIFKTHLLGRPTVVMAGPEALEFVLSSHIENFSWREGWPDNFKTLLGESLFLQDGEEHRRNRRLMMPALHGPALASYFSTMEDITRSYLQKWEKKQEFTWFQEFKQLTFDIASQLFLGTRPGPECVRLSQLFTTLTNGLLAINPLPLPFTTFGKAIAARNEILEHLTQVVRERQQNPTQDTISLLIKAKDEDGNSLSEKEIIAQAVLLLFAGHETTTSMLTWLCTELACHPEVLEKARVEQLQLASQGDLDLEQLGKMPYLEQVLWEVERLHQPVGGGFRGVIKDFELNGYHVPTGWQLYYSIGVTHQIEEIYSEPELFDPDRFSPQRQEHKKYPFSLVGFGGGPRICIGIAFAKMEMKIVAAHLLRSYHWEILPNQSLEVVAVPTNRPKDGLRVRFQPR

SEQ ID NO: 16547 - protein, 161 aa, Nostoc punctiforme PCC 73102
MSNTISDIAVKTINGEDKQLKDYTGKVLLIVNVASYCGYTSQYEGLEKLNQKYREQGLRILGFPCNDFGAQEPGSNEEIVQFCTSKYSVTFELFDKIHAKGPQQHPLYERLTKAVEPTGTIAWNFEKFLVNKKGEVTARFNSSVQPNSPELIAIIEKELAK

SEQ ID NO: 16548 - protein, 486 aa, Nostoc punctiforme PCC 73102
MNKHIRPWQRLLALAIGSMVFAVFAPTIVQATDPPTVQSLSETTTKLQISIDTIWVLITGFLVFFMQTGFAMLEAGLNRQRGVVNALLENFINAAVTILVWWGIGFGIAFGTSAGGLVGIDTFFLSQLPGADGSYILAAPGSTAAINTYTLFFFQFAFAATATTIATGSMAGRTDFIGDLIYSAIMGAIAYPIVVHWVWNSDGWLSKLSYHDFAGSSVVHTVGGWTALVGAYLLGSRPGRPAWGTLPPAHNLGLATLGTMILWFGWYGFNPGSTLSTGNTGLIGLVTVNTTLSAGAGALSAIIFQYTRKGKWDLVYSLNGSLAGLVAITAPCAYVAPWASVLIGLTSGILVTVGMDLIESVHIDDPVGAFAVHGINGMMGTLSVGFLGQAELTLNQKAGLFLGGGFELLGIQLLGVVAIAVFTVAFSFLMFGGLKAVGHLRVNSEADRIGIDAYEHGASVWSDVYAIEKKEINCAETTEIEALDSE

SEQ ID NO: 16549 - protein, 244 aa, Nostoc punctiforme PCC 73102
MNNVVIRTEFLCKSFGKLDVLKDISTEFYQGEVVAILGPSGSGKSTFLRCINLLEQPTRGRIYFHEQEITKPKTNIAKVRQYLVMVFQHFNLFPHMNVLENVTYAPIKVKGINKQKAQEHGLELLAKVGLESKANVYPSKLSGGQKQRVAIARALAMEPEMILFDEPTSALDPEMVKDVLEVMKDLALSGMTMAIVTHEMGFARVVANRIMFLDQGILAEDTTPGEFFQNPQCDRAKQFLEKML

SEQ ID NO: 16550 - protein, 429 aa, Nostoc punctiforme PCC 73102
MSKFLDTAIEAIAAREILDSRGRPTIEAEVHLANGVVGLAQVPSGASTGSFEAHELRDGDKSRYGGKGVLKAVKNVKEALAPKLLGLDALNQELLDRTMIAIDGSPNKSSLGANAILGVSLAAAKAGAESLDIPLYRYLGGPLANLLPVPLMNVINGGAHASNNVDFQEFMIVPIGATSFREALRWGAEVFATLSQVLDEKGLLTGVGDEGGFAPNLESNQVALELLVAAIKKAGYKPGEEVALALDVAASEFYKNGQYVYDGKPHAPAEFIDYLGQLVDQYPIVSIEDGLHEEDWQSWQLLTQKLGSQVQLVGDDLFVTNATRLQRGIEEKAANAILIKLNQIGSLTETLETIDLATRNSIRSVISHRSGETEDTTIADLAVATRAGQIKTGSLCRSERVAKYNRLLRIEDELGDRAVYAGAVGLGPK

SEQ ID NO: 16551 - protein, 1284 aa, Nostoc punctiforme PCC 73102
MNNQFKDLVELLLTRAKEQPSRIAYTFLLDGEDESQSIQISYQELDRQARAIAIHLQSIMNAGDVYDGQSPRALMLYPAGLDFITAFFGCLYAGIVPIPAYPPRQNHKLSRLEAIVLDAEAKIVLTTSGVMANLKDIGKYSSALAEIEWLPTNDLILGDGSSWVRPEINGETLAFLQYTSGSTGTPKGVMVTHDNLLRNSADLDLGWDHDENSVIVTWLPTFHDMGLIYGMLQPLYKGCTCYMMAPVSFLQKPIRWLQAISRYRGTHSGAPNFAYKLCAEKITPEQRAKLDLSSWRMALNGAEPVRADVLEEFVEAFKPSGFDGRAFCPGYGLAEATLKVSAVRSKDLPVYLHVDAEALEQHRVVEVSANHPRCRQFVGCGWTEIDTQIVIVNPETLTQRGDDEVGEIWASGSTIPLGYWNRPEATAETFQAYLKDTKAGPYLRTGDLGFVHNGELFVTGRIKDVIIIRGRNHYPQDIELTVEKSHPALRPTCTAAFTVEIEGEERLIVAQEIERLHLRKLDVEEVVGAIRRAVSQQHELQLYAVILLKTATIPKTSSGKIQRRTCRAKFVENALEVVGEWKFETEAESEVPVQSVVSKTKADNIIEWLRGYAGDRINSRLIDERRCIPPYIVLDFGNRGLLGMQIPEEYGGLALSYRDTFRVFEQLAAIDLTLASFVAVHHVLGTRPILNYAPENVRQEILPLLAGGRELAGFAITEQTAGSNPRAIATRAIPDAGGWRIRGEKIWIGHGSWAGVTNVFAQTLDANNQPTGISSFIIRQGTPGFSQGPEALTMGVRGMVQNTIYLKDVLVTPENLLGTLNNGMEVAQDAMMHGRLIIGVMSLGGMKRCAQLMLRYSSRRSVSTGRLLNNPISLVWLSDLTAAITSLETLLFKIADLLDQGRAIPQEAFTACKTAGPELVWQAADRLVQMLGGRGYIETNIAPQILRDARLFRIFEGPTETLNMFLGSRAMNQSAELHRFLSEELGAPTVAKNLVVAVDQIKTHLTSVQPAFLESKSAQHWAYIRTGEVVTFAILLAAVQGELERSPSAELQRAVTWAKLQFEQKLASVLTGTPAEKILSDAEAVSAQISDYIAAIGDVVQTSAGENHNLDELLQLEAVGEVAEDEGAGEELLTDAINLVPYTDAINRVSTPNSCTDAIHRVSIQNWLEKWLIKKLRIAARSVNANTSFADYGLDSVMAVELAQDLEEWLKYPLESTILWNFPTVKSLAEHLAFLATTPEPQDSVKVSAKAVFEFIPPTTTPLETSIAQELAKLENLLGKNGRR

SEQ ID NO: 16552 - protein, 275 aa, Nostoc punctiforme PCC 73102
MTSISNSFQTLRDRQQCALIPFITAGDPNLETTAQALRILDRNGADFIELGIPYSDPLADGPVIQAAATRALQKGTKLEQVLEMLQAVTPTLKAPIILFTYYNPILHRGIKTFLAQIAAVGVQGLVVPDLPLEEAEELIQTAASFGIEVILLVAPTSSKDRILAIARQSQGFIYLVSVTGVTGIRAQIQDRVKDLITDLRSVTDKPIGVGFGISGPEQAHQVREWGADAVIVGSAFVKRLAEGSPTERLQAVEKLCQELKAAITPVSLQQVVSAK

SEQ ID NO: 16553 - protein, 498 aa, Nostoc punctiforme PCC 73102
MTTPLSCRNYINGQWLNAVGEATLESRNPADKTEIVATYPRSQVNDVDTAVASARKAYRSWRTVPAPARAEYIFRVGEILLQHKEELAQLISREMGKPLTEARGDVQEGIDCAFYSAGEGRRLFGQTTPSEMSNKFAMTVRMPIGVCALITPWNFPVAIPCWKAMPALVCGNTVILKPAEDTSACATKLIEIFQQAGLPPGVINLVHGVGEEAGKALVEHPNVDLVSFTGSSETGAFVGATCGRTHKRVCLEMGGKNAQIVMEDADLELALDGAVWGAFGTTGQRCTATSRLILHRDIKEKFTTMLYERTSKLRLGAGNDTDTDIGPIINEKQLQQVSKYLDIAREEGAKVLIGGEIASEGSLKNGYFFQPTILDRVTPDMRVAREEIFGPVVALIEVSSFEEAIAILNDSNYGLSSSVYTRDINRAFTAMRDIEAGITYINGPTIGAEVHLPFGGVKQTGNGHREAGTTALDVFTEWKSVYVDFSGSLQRAQIDNRS

SEQ ID NO: 16554 - protein, 1626 aa, Nostoc punctiforme PCC 73102
MMNQPNAFDSLDEIAIVGMNGRFPRAKNIEQFWQNLRDGVESISFFSDEELLSSRIDPATLSQPQYVKAGSVLEDIELFDASFFDFSAKEAQITDPQHRLFLECAWEALESAGYNSEIYAGRIGVYAGASLNTYFLTNLYTQPKIIESVGSYRISIGNSPNFLPTYVSYKLNLKGPSLNVQTACSTSLVAVHLACQSLLNGESDIALAGGVSIQVPHKTGYRYQQGGIMSPDGHCRAFDAKAQGIISGNGVGIVVLKRLEDALADGDCIHAVIKGSAINNDGSLKVGFTAPSVDGQAKVIAEALAMARVESETISYVETHGTGTVLGDPIEIASLTQAFRPTDKKNFCAIASVKTNIGHLDAAAGVAGLIKTVLALKHQQIPPSLHFEQPNPQIDFANSPFYVNDKLSEWKSNGTPRRAGVSSFGIGGTNAHVILEEAPVWEQGRQRRQGRKYHLLVISAKTKSALETATANLANHLKQHLELNLADIAYTLGVGRRGFSDRRILVCQNLNDAVTVLETPVSERVFTKFTEPSGQQIAFMFPGQGTQYVNMGRELYETEIIFRKQVDYCCEFLKSYLKLDLRTLLYPHQQTEALTQQLQQTHITQSAVFVVEYALAQLWMAWGVRPNAMIGHSIGEYVAACIAGVFSLEEALILVANRGQLMQQLPSGTMMAVSLPEKKIQPMLGKKLSLAAINAPDMCVVSGLEEAVDDLQKRLIDQGVDCHRLHTSHAFHSSMMDSILLPFQEQVSKISLNSPKIPFVSNVTGTWITPAQATDPKYWARHLRQTVRFSEAIAELLQQPKRILLEVGPGRTLSTLANKQKAAQQVILSSLRHPQNQQSDVAFLLNTLGRLWLEGINVDWSEFYADEERHRIPLPTYPFERKRYWIEPILANDDNLSPKNEILVSQPEDIITNSIKVPDTQIVNQPIANTAIEQIISQHLQVMSKLVDLLPQGSLAREVLPSLGAIHQDGQIAQTSTNGSAFSGNQSTFTKAESEQQIKDRKINPTPKAASQQIEKESMMLSPRQQRHLDSLIAHFVKRTQESKRLTQAYRSCHANSRAVSGFFPFIKEMIYPIHAERGEGARLWDVDGNEYVDISMGFGTLLFGHSPSFAIAAIQEQSKQGILNGPQSRFAGQLAELICELTGAERTAFCNDGTEAVMAAVRIARSVTGRSKIALFAGSYHGGSDGVLVKGVRTNDGTLRSVPMTSGIPSSLAEDVMVLEYGTPESLNILKDNAHNLAAILVEPIQSSRPDFQPKEFLFQLRQLTQETGTVLIFDEVVTGFRMHPGGVQALWGIQADITTYGKAVAAGIPIGVVAGKAVFMDALDGGMWNYGDESYPQVKTTFFAGTFFKHPLIMGVAWATLNHIKNSGSKLQEELNQRTTQLAETLNSYFEQKQVPIRVVNFGSLFRFNCQTQLGNLFFYHLLAKGIYVWEGRTLYLSTAHTDKDVEQVISAVKESVVEMQAGGFFTSEQTSKNSGQTSANQTLTGSSLNLATESLSVTSNVKSADELFENLIEQIPNALGNTYAASRKKIEKTIADIWQELFGFDNVNIHDNFFELGGDSLTALQAISLLNKKLDLDIPIESIYEAPTINSLTNIVCPEQNEILSAKQSISRGQRRREKRNQR

SEQ ID NO: 16555 - protein, 488 aa, Nostoc punctiforme PCC 73102
MQIQTPDWVKHAVFYQIFPDRFARSKQPRKRLLQEARWEDWDSMPTLQGYKGGDLWGIMEDLDYIQNLGINAIYFTPIFQSASNHRYHTHDYYQVDPMLGGNEAFKELLDAAHQRNIKVVLDGVFNHSSRGFFFFHDVLENGPHSPWVNWFKIEGWPLSPYNGEFPANYVGWAGNRALPEFNHDNPEVREYIMEIAEYWLKFGIDGWRLDVPFEIKTPGFWQEFRDRTKAINPEAYIVGEVWGDSRQWLDGTQFDGVMNYLFAGPTIAFAAGDRVVLEQVQSRDYQPYPPLFAAEYATKIQEVLQLYPWEIQLTQLNLLASHDTARLMTIAGGDIASVELSTLLLLTFPGAPSIYYGDEVGLPGGIDPDSRRGFPLEANWNQEIFNTHRQLITIRQTYPALRTGDYQVLYAQGQLYLFARTLGTEELIIAINAGTSSATANVDVASLHTQPNKLLYGTAEAEWNGEEGTQQLSLTLPARSGCILGTGD

SEQ ID NO: 16556 - protein, 331 aa, Nostoc punctiforme PCC 73102
MQNLPNFRDYYEILGVSKDASGEEIKKVYRRLARQYHPDLNPGNKESEEKFKDIGEAYEVLSDSAKRSQYDQFSRYWKQKGFAGNKQTPKAKTWQSGASDRNGNQDVDPSQFSDFESFINQVIGVKNKSGASKSSNGNTSDPFRSPRTKVAYTVNTPPRTTRRDIEARLTLPLEKAYQGGNERIRLEDGRSLEVNMPLGMVTGQTIRLRNQGVGGGDLYLKITVEPHPLFKLEGLNILCQVPVTPSEAVLGGQVEAPTLDGPVKMTIPPGVRSGQKFRLGNKGYPSDDGKRGDQLVEIQIVTPKNISQEERELYEKLRQIETFKPRADLLS

SEQ ID NO: 16557 - protein, 472 aa, Nostoc punctiforme PCC 73102
MTKPIEVRNPRTGKFDYVIIPPPPRLLAQQCKRSRRAQVSWQKLGLEGRIEALQQWKAAIVSERDRLTEALVNDTGRLSTSILEIDSFLSSIDRWCRLAPELLQDSAKNTAIPFIALQQTSVPYPLVGIISPWNFPLLLSTIDTIPALLAGCAVIVKPSEIAPRFVAPMTTALNAVPKLRDVLTFIEGAGATGSILIDNVDLVCFTGSVATGRKVAEAAAKRFIPAFLELGGKDPAIVLESANLELATSAILWGSVVNTGQSCLSIERIYVAESIFEKFYHQLVAKAHRLGLAYPTVESGEIGPIIAERQAAIISDHLLDAVEKGAVIHCGGVIEDLGGGWWCRPTVLTQVNHSMKVMTEETFGPIMPIMPFSTVEEAVSLANDSIYGLSAAVFASEAEALEIAQQIEAGAISINDAALTAIMHEGEKNAFKFSGMGGSRMGAAALKRFMRKKAILIKTNATNDPWWFDNES

SEQ ID NO: 16558 - protein, 330 aa, Nostoc punctiforme PCC 73102
MKPKVVITHWVHPEIITNLSEYCEVVANPTRETLPREEILKLAQDAEALMVFMPDRIDEAFLKACPKLKIIAGALKGYDNFDVDACTRQGIWFTIVPSLLAVPTAELTIGLIIGLARQMLLGDRLIRQGTFAGWRPHLYGMGLANRTLGIVGMGSLGQALAQRLSSFEMNLIYTDAIPLPKEKAAAWCLSQVSLDTLLATSDFVVLMVPLQPETFHLINEKSLARMKPGSFLINPCRGSVVDEQAVSDALASGHLAGYAADVFELEDWARSDRPSKIPPSLLEKQDQTFFTPHLGSAVDDLRYDIAIEASQNILQVLQGHSPQGAINCPS

SEQ ID NO: 16559 - protein, 403 aa, Nostoc punctiforme PCC 73102
MSLNWIVPAERIQKLPPYVFARLDELKAKAREQGLDLIDLGMGNPDGATPAPVVEAAIAALKDPANHGYPPFEGTASFRRAITNWYHRRYGVVLDPDSEALPLLGSKEGLTHLAIAYVNPGDLVLVPSPAYPAHFRGPAIAGGKIHSLILKPENDWLIDLAAIPDEVARQAKILYFNYPSNPTAATAPREFFEEIVAFARKYEILLVHDLCYAELAFDGYQPTSLLEIPGAKDIGVEFHTLSKTYNMAGWRVGFVVGNRHVIQGLRTLKTNLDYGIFSALQKAAETALQLPDVYLHEVQQRYRTRRDFLIDGLGELGWDIPRTKATMYLWVKCPVGMGSTDFALNVLQQTGVVLTPGNAFGVAGEGYVRISLIADCDRLGEALHRFKQAGIRYQPEAVVSASG

SEQ ID NO: 16560 - protein, 311 aa, Nostoc punctiforme PCC 73102
MKNEKWNTENILSQKGRVAIVTGSSSGIGYETARVLANKQASVIIAVRNLDKGNKALAKILQQNKDADVKVMELDLANLASVKNFAENFQKNYVRLDLLINNAGVMIPPYSKTTDGFELQFGTNHLGHFALTGQLLERLIDTEDSRIVNVSSGAHSIGKIDFDDLNWEKRSYAKWKAYGDSKLANLYFTYELDRKLKDKGIDTLVTASHPGWTATELQRTAGGVVKYLNGILAQDITMGALPTLRAATEAGLKGAEYFGPNGFMEMRGYPIKVESNELSKDQAIAKKLWEVSEKLTNVKFEFNKKTQSAGK

SEQ ID NO: 16561 - protein, 387 aa, Nostoc punctiforme PCC 73102
MEIQLGRGKTARRAYGIDEIALVPGNRTLDPSLADTKWRIGNIEREIPIIASAMDGVVDVRMAVRLSQLGALGVLNLEGIHTRYVDPEPILDRIASVGKDEFVALMQELYAEPIKPELIEKRIQEIKEQGGIAAVSATPAGASKYGEAVAKAGADLFFVQATVVSTAHLSPESVIPLDLAEFCRSMPIPVVLGNCVTYDVTLNLLKAGAAGVLVGIGPGAACTSRGVLGVGVPQATAIADCAAARDDYYKETGNYIPIIADGGLITGGDICKCIACGADGVMIGSPFARAAEAPGRGYHWGMATPSPVLPRGTRIRVATTGSLEQILIGPAGLDDGTHNLLGALKTSMGTLGAKNIKEMQQVEVVIAPSLLTEGKVYQKAQQLGMGK

SEQ ID NO: 16562 - protein, 332 aa, Nostoc punctiforme PCC 73102
MLSRQLGKNGSTISALGLGCMGMSDYYGPADRKESIATIHAALDAGINLLDTGDFYGMGHNELLLHEALAGRRREDVFIAVKFGALRSPDGNFIGFDGRPEAVKTSLAYTLKRLGTDYIDLYQPARLDPKVPIEETIGAISEMVKAGYVRQIGLSEVGANVIRRAHGIHPISWLQIEYSLLSRSIEDDILPTVRELDIAVTAYGVLSRGLLSGHWSKERSEQAQDFRGHLPRFSGENLDRNLLLVEALRLIAQERSATVAQVAIAWVLSRGNDIVPLIGARRCDRLNEALGALELHLSKDDLARIEAAVPLNAVAGDRYDPGQMAMLDSEKR

SEQ ID NO: 16563 - protein, 260 aa, Nostoc punctiforme PCC 73102
MTEPLIELKGVSKSFGSHKVLDNVDLTIYRGEALGIIGPSGTGKSTILRVMAGLLAPDEGEIYVQGVRRDGLIEDAGQPVGIGMVFQQAALFDSLTVEENVGFLLYQNSKLPRSRIRDLVKEKLEMVGLPSISDLYPAELSGGMRKRVSFARAIMSNPDNPSEGPEVLLYDEPTAGLDPIASTVIEDLIRYLQCLNGVCSTYAVVTHQDSTIRRTADRLIFLYEGRVQWQGTVSEIYNTENPLIKQFMSGSVQGPIQVVG

SEQ ID NO: 16564 - protein, 324 aa, Nostoc punctiforme PCC 73102
MVEYYTQRASAGLIITEGTHPSPMGRGYTTCPGLHNQEQVGGWRKVTDAVHAAGGRIFVQLMHAGRVSHSSLLPNHARPIAPSAVPVVSEEVHVWDGKVPFEIPRPLELSEIPEIVEEFRRAAELSIEAGFDGVELHAATGYLPNQFQVSGSNQRTDAYGGTLENRTRFTLEVVNALCKVRGAEQIGVKIAPGFTVNDTFDDNPAETYTYVAKALSPLGLAYLHVGYNQGYARGTAPNFNPIDLLRTVYQGTLLAVGGFDRQQGDEAITSRRADAIVFGRPFISNPDLVERLRLNAPLSKGDIRTFYGGSEHGYTDYPTLPQLH

SEQ ID NO: 16565 - protein, 320 aa, Nostoc punctiforme PCC 73102
MRIARNITELVGRTPLVQLNRIPQTEGCVAEIVVKLESLNPSASVKDRIGVSMINAAEEEALITPEKTILVEPTSGNTGIALAMTAAAKGYRLILTMPETMSGERRAMLRAYGAELELTPGMEGMSGAIRRAQQIVNSTPNTYMLQQFRNPANAKVHRETTALEIWEDTDGQVDIVVAGVGTGGTITGVAEVIKARKPSSKAIAVEPANSPVLSGGQPGPHKIQGIGAGFIPQVLKLKLIDEVITITDEEAITYSRRLAKEEGLLSGISSGAALCAAIRVAQREENKERLIVMIQPSFGERYLSTPLFQDLEARLPASVG

SEQ ID NO: 16566 - protein, 274 aa, Nostoc punctiforme PCC 73102
MEKQQLIKLLIGDFTWQRLLKSFIFIYIFFAGYIYLRVDSMIFLPRPSSYQDNPKIIKLKSGENTNISATYLLNNQANYTILYVHGNSEDLGDIKEILEKLHAWGFSVFAYDYRGYGTSQEKATENHAYEDINSAYNYLTQNLKIPPERIIVLGRSVGGGSAVNLAMRKPIAGLLIESSFISAFQVIVPFRILPFDKFPNLDNIKKVKCPILVIHGKADDVIPFAHGEKLFNAAISPKLYLWVEEANHNDLFWVAEKKYQKALQEFTTLVKTNQ

SEQ ID NO: 16567 - protein, 278 aa, Nostoc punctiforme PCC 73102
MTNQAPIPVIVNGAAGKMGREVIKAVAQAPDLNLVGAIDHSLEHQDKDAGELAGLSEPLEVPITNQLEPMLGYVAGDRQSPPGVIVDFTHPDSVYDNIRSAIAYGIRPVVGTTGLSPEQIQDLADFADKASTGCLIIPNFSIGMVLLQQAAIAASKYFDHVEIIELHHNQKADAPSGTAIQTAQLLGELGKTFNPALVEETEKLPGARGSIADEGIRIHSVRLPGLIAHQEVIFGAAGQIYTLRHDTSDRACYMPGVLLAIRKVLALKSLVYGLEKIL

SEQ ID NO: 16568 - protein, 427 aa, Nostoc punctiforme PCC 73102
MSLQTLVEQATIPPDSGSVASSPFDADSFNEAVMSTYGRFPLALERGAGCRVWDTQGREYLDFVAGIATCTLGHAHPVMVEAVTRQIQKLHHVSNLYYIPEQGELAKWLVEHSCADRVFFCNSGAEANEAAIKLARKYAHTVLDIEKPIILTANASFHGRTLATITATAQPKYQKYFDPLVPGFHYVNYNDINAVEVAISELDEGDYRVAAILIEPLQGEGGVRPGDVAYFKKLRQICDETGILLIFDEVQVGMGRSGKLWAYEHLGVEPDIFTSAKGLGGGIPIGAMMSKKFCDVFQPGEHASTFGGNPFVCGVALSVCQTLERENILQNVQDRGEQLRSGLRAIAAKYPQQIGEVRGWGLINGLELRADIQLTAADIVNAAINEGVLLVPAGPKVVRFVPPLIVTEAEVNTALEAVDKAMSNDKP

SEQ ID NO: 16569 - protein, 484 aa, Nostoc punctiforme PCC 73102
MTIDYDVVIIGGSLAGYYAALAATQLRATVALVEPKVDYGFTHHHALTEIGKLAQKLNDAASFGIHATKTDISEDCHISMAWQEAMLYAQCVAANLKEQHSPAILAALGVDVIVGSGQFQSSPQLAFAVNNRLLHARTYLLASGSRPEIPEIEGLQSTGYLTLSNIWQSLQGETLPKNWVIIGGIPQSIEIAQTLARFGCSVTLVVKHPYALSHIDHEIAILLQAQLEVEGVRVLTDKQVTQVRLIEAKKWIQAGDKAIETDEILVATGQQPNIESLNLAMVGVKWHRRSLVVNDKLQTTNHRIYACGDVIGGYDFANIANYEAKIALNNALFFPRLRVNYRSIPWAMFSVPMVAQVGLTEAQAKRLFSRDEVLVLRQYFKTVAAAQLRDETTGMCKLIVLHNGEILGASILGAEAGELINLIALAMSQKIKVKDLANLSPVYPSFSEILEQAAREWSKQKLNSDIAWQEFLEGFFHFRRNWNL

SEQ ID NO: 16570 - protein, 321 aa, Nostoc punctiforme PCC 73102
MPTANDFKDYYNILGVSKTATSDEIKRAYRKLARKYHPDVNPGNPEAEEKFKDINEANEVLSNPEKREKYDSFGQYWKQAEASGTPPGGTSTYAENFDQYSNFDDFINDLLGGLGGRTRAGRTYYRTSARQPDDFGSFGSQAPAPDSEAAIALSFSEAFHGVQKRLQLDDETINVRIPAGAKPGSRIRIKGKGRPSPFSQQRGDLYLTIELLPHPFFQFSDDNLTCEVPIRPDEAVLGAQIQVPTPEGRVTLSVPKGVRSGQSLRLRGKGWTQPKGGRTDLIVKLQIVSPKELSEIERDCYEKIQANSSFNPRTALEGVTL

SEQ ID NO: 16571 - protein, 400 aa, Nostoc punctiforme PCC 73102
MSKKSLASLSSADISGKRALVRVDFNVPVDDQGKITDDTRIRAALPTIQDLTQKGAKVILASHFGRPKGVDDKLRLTPVAKRLSELLGQEVIKTDDSIGDEVAAKVAALQNGQVLLLENVRFYPEEEKNDAEFAKKLAANADFYVNDAFGTAHRAHASTEGVTKFLSPSVAGYLVEKELQYLQNAIENPQRPLAAIIGGSKVSSKIGVIETLLEKCDKLIIGGGMIFTFYKARGLSVGKSLVEEDKLELAKSLEAKAKERGVALLLPTDVVLADNFAPDANSQTVSIENIPDGWMGLDIGPDSVKFFQEALADTKTVIWNGPMGVFEFDKFAAGTEAIAHTLAEIGKTGTTTIIGGGDSVAAVEKVGLADQMSHISTGGGASLELLEGKVLPGIAALDDA

SEQ ID NO: 16572 - protein, 145 aa, Nostoc punctiforme PCC 73102
MTETATAPLTGKALLAKVKELSTLPRRERAKQCGYYTVTKNNQVRVNLTDFYDALLSARGIPLSPEAPKDGRGREPTYRVSVHQNGQIVIGATYTKAMGLKSGDEFEIRLGYKHIHLIQLGESDKKLTSPDIDSDESDEDLEDEE

SEQ ID NO: 16573 - protein, 499 aa, Nostoc punctiforme PCC 73102
MNLFELLAGEDNHSALVTPGGRSLTYKQLRDNVVGLVSQLNSFGLTRGERIAIAMTNGSPMAITFLAAALCGTAAPLNPKYKQDEFAFYYEDTQANALITLSGEPEAAIAAVTPNMMLINAKVNADGTLSFELVKTGSKPRESSNPAAPNADDLAMILHTSGTTSRPKRVPIRHRNLIASANNIITAYSLTDADTTLCLMPLFHVHGLVGCLLSTLASGGTLICPNGFNALEFWKLVDTYKPTWYSAAPTMHQTILARASRNTEIVQANRFRFIRSSSASLPPIIIEQLEATLNAPVVESYSMTEASHLMTTNPLPPKERKPGSVGYGFGVDVGIMDSEGNLLSQGSLGEVVVKAPNVIDGYENNPEANATAFVNGWFRTGDQGTVDADGYLRLTGRIKELINRGGEKISPLEVDDVLLRHPAVAEALAFAVPHKSLGEDIHAAVVLKGEVGEKELLAHCSTMLADFKVPKQIHILDQLPRGATGKLQRLAMAKLLNIG

SEQ ID NO: 16574 - protein, 458 aa, Nostoc punctiforme PCC 73102
MKILDSLTTPSLLQTLQLIAKPTKTLENYATKYGDIFTMRVMGLKSPPIVFFSHPQAISDCFAVPAHKLDFKKATHVFKPLFGENSIVFKEARSHQQQRQLLLPAFHGDNLKSYGQAICQIAEELTQSWTSGTNICIHKLMSKITLEIILQVVFGITHGVRYQQLKEQLSALLEDVTKPWYSSLFFFPSLQKDLGAWSPWGIFLKRREQIDKLIYAEISERRWQNDAMRTDILSLLMSAHDVNGQQMTDEELRDQLVSLLLLGYETTSGVLAWIFYLIHSHPEVKHRLMQELSTLDNLTNPEAITQLPYLTAVCQETLRIHPIALICTPRMLKEPVEIMGHKFTSETVLVPCIHLAHRRTDTYPEPEQFRPERFLNQKFSPYEYLPFGGGYRGCIGAAFSMYELKLVTAIILSRFELSLTDKRPAYPVRRGITIVPSGGVKMVVTKKAKFKRQTILST

SEQ ID NO: 16575 - protein, 460 aa, Nostoc punctiforme PCC 73102
MKLPKGPQSPAVLQMLRWITSPMSFMETCAKRYGDMFTIRLDSKSPPLIFVSKPEVLEQILTNDIKGLEAPGDTNLVFESLLGKHSVITISGAEHQRQRQLLLPPFHGERMRSYSQIISDITEKVISQYQIGQPFNIRSVTQAITLRVIMQAVFGLDEGPRAEKLQHCLAEMLEKGSSVLSAALLYFPALQRDFGPINFWGKQMRRQQAADKLIYEEIRERQEQPDPSRTDILSLLMAARDEAGQPMTDEKLRDELMTLLVAGHETTATALAWAFYWIQKIPTVRQKLLKELDSLGDNPDPSTIFKLPYLNAVCSETLRIYPVAMLTFARVVRTPLSLGGYELEPGIGVIGSIYLTHHREDLYPEPKQFKPERFLERQFSPYEYLPFGGGARRCIGLAFAQLEMKLALAKILSTRELELVDNSEVRPKRRGLVTGQDRPIQMVVTSQRQVKFPILQTATV

SEQ ID NO: 16576 - protein, 338 aa, Nostoc punctiforme PCC 73102
MGIVVENVSKQFGSFKAVDEVSLEIKSGSLVALLGPSGSGKSTLLRLISGLEMPDSGKILLTGKDATYQSVQQRNIGFVFQHYALFKHLTVRQNIAFGLEIRKAQPKKIKGKVEQLLELVQLSGLGDRYPSQLSGGQRQRVALARALAVEPEVLLLDEPFGALDAKVRKDLRAWLRRLHDEVHVTTVFVTHDQEEAMEVSDEVVVMNKGRVEQVGTPSEIYDNPATAFVMSFIGPVNVLPSNSKIFQSSGFDAPHPQVFLRPQDVILEKAANGATTPATVSRLIHLGWEIQVELTFDDGQVVMAHLTRDRFNDLELEPKQRIYVKPKDAKSFPVSYSI

SEQ ID NO: 16577 - protein, 411 aa, Nostoc punctiforme PCC 73102
MPGGVSSPVRAFKSVGGQPIVFDRVKGAYIWDVDGNQYIDYVGTWGPAICGHAHPEVIAALHEALEKGTSFGAPSTLENVLAEMVIDAVPSIEMVRFVNSGTEACMGVLRLMRAFTNRDKIIKFEGCYHGHADTFLVKAGSGVATLGLPDSPGVPKAATSTTLTAPYNDLESVKALFEENRDEIAGVILEPVVGNAGFIAPDAGFLEGLRELTHEYGALLVFDEVMTGFRIAYGGAQEKFGVTPDLTTLGKVIGGGLPVGAYGGRRDIMSMVAPAGPVYQAGTLSGNPLAMTAGIKTLELLQKPGTYDYLERITKKLADGLLQIAKETGHTACGGQISAMFGLFFTSGPVHNYEDAKKSDTAKFGRFHRGMLERGVYLAPSQFEAGFTSFAHTEEDIDQTLAIARDVMSSL

SEQ ID NO: 16578 - protein, 216 aa, Nostoc punctiforme PCC 73102
MSSNDLRSLHYAIPVEKIRYDERGLVPAIVQDYLDGTVLMMAWMNQESLQKTLETEETWFWSRSRQELWHKGATSGHIQKVQSIRYDCDSDALLIGVEQLGDIACHTGERSCFHQIEGNIVSPPGDALSQLFQIICDRRDNPTESSYTCKLFAGGDNKILKKIGEETAEVVMAFKDDEADAIAGEVADLLYHTLVALAHHQVDLKSVYRKLQERRQ

SEQ ID NO: 16579 - protein, 476 aa, Nostoc punctiforme PCC 73102
MSQGFDYDLVIIGAGVGGHGAALHAVSCGLKTAIIEAGDMGGTCVNRGCIPSKALLAASGRVRELRNAHHLKSLGIQIGSVEFDRQAIANHANNLVSKIQGDLTNSLKRLGVDIIRGWGKIAGAQKVAVTGDGAEKIITAKDIILSPGSIPFVPPGIEVDGKTVFTSDQGVKLESLPDWVAIIGSGYIGLEFSDVYSALGCEITLIEALDQLMPGFDRDIAKLAERVLITPRDIETKVGIYAKKVTPGSPVVIELANFKTKEDVDVIEVDACLVATGRIPATKNLGLESVGIELDRRNFIPVDDRMAVLSAGEVVPNVWAIGDANGKMMLAHAASAQGIIAVENIVGRERIVDYRSIPAAAFTHPEVSYVGLTETAAKELGQTEGFEIATSRSYFKGNSKALAENEADGIAKVIYRKDTGEVLGVHIFGLHASDLIHEASAAIANRQSVQSLAHLVHAHPTLSEVLDEAYKRAIAI

SEQ ID NO: 16580 - protein, 306 aa, Nostoc punctiforme PCC 73102
MLPVIYSDEFLDHKTGKYHPEKPERLTAIANALKAATFADKIDWRSPTAVSEQPLLMSMLVKAHSPAYIKKLWQIASSGGGPLDGDTPVSPRSYDVALLAVSAWLDGVEAVLKSANPAFVLARPPGHHAESDAGMGFCLFSNAAIAAFFALEQPGINRVAILDWDVHHGNGTQAIVETEARIAYCSLHQYPCYPGTGRATERGFHNNVLNLPVPPGSDIAVYQPLFERQVIPFLANFQADLLIVSAGYDGNADDPLASINLQPEDYALFTNYCLGLTRKILFGLEGGYDFDTLSQSVVATIESCLL

SEQ ID NO: 16581 - protein, 476 aa, Nostoc punctiforme PCC 73102
MTLQSFGVIGLAVMGENIALNVERNGFPIAVYNRSREKTDAFMAQRATGRNVKAAFTLEEFVALLERPRKILVMVQAGKPVDAVIAQLKPLLEEGDIIIDGGNSWFEDTERRTQELEPAGLRYLGMGVSGGEEGALNGPSLMPGGTTSSYEFLSPIFNKIAAQVDDGPCVTYIGPGGSGHYVKMVHNGIEYGDMQLIAEAYDLLKNVAGLNPSQLHDVFAEWNTTDELDSFLIEITKNIFPYIDPETNKPLVDLIVDAAGQKGTGRWTVQTALELGVAIPTITAAVNARIISSIKDERVAASKVLTGPSGKYDGQTKDFINKVRDALYCSKICSYAQGMALLSTASKTYNWNLDLGEMARIWKGGCIIRARFLNKIKKAFSENPALPNLLLAPEFKQTILDRQTAWREVIATAATVGIPVPAFSASLDYFDSYRRDRLPQNLTQAQRDYFGAHTYLRLDKPGSFHTEWVPIAEAGK

SEQ ID NO: 16582 - protein, 153 aa, Nostoc punctiforme PCC 73102
MADFLPSPEEQEDNRSGLEPELGGFLRDSPERSGLEPELGGLLRQNGVYVDEITCIGCKHCAHVARNTFYIEPDYGRSRVVRQDGDAEEIIQEAIDTCPVDCIHWVDYTELKKLEQERKYQVIPVVGYPVEQAVAASERRRKKQKLKTKKSRY

SEQ ID NO: 16583 - protein, 319 aa, Nostoc punctiforme PCC 73102
MRIAQDITELIGRTPLVQLNKIPQAEGVVARIVVKLEGMNPAASVKDRIGLSMVLSAEAAGSIQPGKTILVEPTSGNTGIALAMVAAARGYRLILTMPETMSQERRAMLRAYGASLELTPGAEGMRGAIRKAEEIVANTPDAFMLQQFRNPANPKVHQETTAEEIWTDTDGEVDIVIAGVGTGGTITGIAEVLKGRKKTFKAIAVEPSNSPVLSGGEAGPHRIQGIGAGFIPDVLRLELVDEVIRVSDEQAIAYGRRLAKEEGLLSGISSGAALCAAIQVGKRPENAGRLIVMIQPSFGERYLSTPMFQDLSLETAGVR

SEQ ID NO: 16584 - protein, 470 aa, Helicobacter pylori 26695
MKIKNILLSGGSGKRLWPLSRSLYPKQFLKLFDHKSLFELSFKRNASLVDETLIVCNEKHYFLALEEIKNEIKNKSVGFLLESLSKNTANAIALSALMSDKEDLLIVTPSDHLIKDLQAYENAIKKAIDLAQKGFLVTFGVSIDKPNTEFGYIESPNGLDVKRFIEKPSLDKAIEFQKSGGFYFNSGMFVFQAGVFLDELKKHAPTILKGCERAFESLENAYFFEKKIARLSEKSMQDLEDMSIDIALMQQSHKIKMVELNAKWSDLGNFNALFEEAANEPKENVSLNQTPVFAKESENNLVFSHKVSALLGVENLAVIDTKDALLIAHKDKAKDLKALVNEVETNNQELLQTHTKVYRPWGSYEVLHESGCYKVKILEVKPNARLSLQKHFHRSEHWVVISGMASVELDHQLFELQANESTYIPKNTLHRLANYGKIPLIIIEVQVGEYVGEDDIVRIDDDFNRQNQNA

SEQ ID NO: 16585 - protein, 1185 aa, Helicobacter pylori 26695
MQKIIDDSLELAKKLQDSISNHLSDQEKAFHSKMQKLLNNPENKVMLIELMDRSFRCLDNKARFEMIEHVLDKYKSREIFSPFEKVLLMGFLSFGKMLPDMSVPFFVNKIRSDTKAMVLDQEESQLKERILKRKNEKIILNVNFIGEEVLGEEEANARFEKYSQALKSNYIQYISIKITTIFSQINILDFEYSKKEIVKRLDALYALALEEEKKQGMPKFINLDMEEFRDLELTVESFMESIAKFDLNAGIVLQAYIPDSYEYLKKLHAFSKERVLKGLKPIKIRFVKGANMESEETIASVKDWALPTFSNKQDTDSNYNKMLDFVLEGDNYKYIHIGAASHNIFEIAYVYTRIHAINDPVVLEHFSFEMLEGMSLQASQELKEMHKLILYAPVCDEAHFNNAIAYLVRRLDENTSSDNFMKAFFNLKVGTSEWKDQEQRFLNSLKGIATLDNATHRTQDRNAKQSGHTTYPNHSFKNESDTDFILKANREWAKKVREKMRNAPILELYPEMDGRFEDPNLTPLEVFDRIHHKKIASVHLADKEAILKALEVAKSDKSRFSQKSFTEIHALMSQTAQLFRERRGDLIGISALEVGKTFAETDAEVSEAIDFLEFYPYSLRVLQEQNTKTQFTPKGVGVVIAPWNFPVGISVGTIAAPLATGNRVIYKPSSLSSVTGYKLCECFWDAGVPRDALIYLPSKGSDISEHLLRDESIQFAILTGGEDTAYKMLKANPTLALSAETGGKNATIVSKMADRDQAIKNVIHSAFSNSGQKCSATSLLVLEKEVYEDENFKKTLIDATLSLSVGDPFDFKNKIGALADKPNEKVIKAIDELKSYENYEIPVSFVNDNPYLMKPSIKYGTKKGDFTHQTELFTPILSVMEAKDLDEAIEIANSTGYGLTSALESLDEREWEYYLERIEAGNIYINKPTTGAIVLRQPFGGVKKSAVGFGRKVGIFNYITQFVNICQEEEDENALKNPLSEALENLTQKGYDEHTHELKRAIFMAKSYAYHYKHEFSQTKDYVKIRGEDNLFSYTKVKSVGYRITEKDTLSDMLGVALACLISQIPLTLSIENERTNKDLTFFLECLKALQASAPIVYESLQKFSEKLNTFNRVRYLKSDLDLLHEQASALGMVLATAKPCLNGRFELLYYHLERSVSISYHRYGNLGSRVLRQPTCHKSCCAEK

SEQ ID NO: 16586 - protein, 314 aa, Helicobacter pylori 26695
MKTFKKGVILDAKSVGLKALEVLKEVADFDFYEVTPPSQIVERSIEAEIMVLNKVVITQEVLSQLPKLKLICITATGTDNVDIKSAKALGIEVKNVSAYSTESVAQHTLACALSLLGRINDYDRYCKSGEYSQSDLFTHISDIKMGLIKGSQWGVIGLGTIGKRVAKLAQAFGAKVVYYSPKDKKEEYERLSLKDLLATSDIISIHAPLNESTRDLIALKELQSLKDGAILINVGRGGIVNEKDLAEILETKDLYYASDVFVKEPFEKDHAFLNPKIQNKLLLTPHIAWAYSDSLKTLVEKTKENIQDFLASQK

SEQ ID NO: 16587 - protein, 306 aa, Helicobacter pylori 26695
MMIITTMQDAIGRTPVFKFTNKDYPIPLNSAIYAKLEHLNPGGSVKDRLGQYLIGEGFKTGKITSKTTIIEPTAGNTGIALALVAIKHHLKTIFVVPEKFSTEKQQIMRALGALVINTPTSEGISGAIKKSKELAESIPDSYLPLQFENPDNPAAYYHTLAPEIVQELGTNLTSFVAGIGSGGTFAGTARYLKERIPAIRLIGVEPEGSILNGGEPGPHEIEGIGVEFIPPFFENLDIDGFETISDEEGFSYTRKLAKKNGLLVGSSSGAAFVAALKEAQRLPEGSQVLTIFPDVADRYLSKGIYL

SEQ ID NO: 16588 - protein, 426 aa, Helicobacter pylori 26695
MLTIKDIHALEVMDSRGNPTIQASVVLSDNTKASAIVPSGASTGKREALELRDNDKTRFLGKGVLRACENVNSVIKHHLIGLEAINQAFVDERLRALDGTPNYANLGANAVLGVSMALARASAKALNLPLYRYLGGANALTLPVPMLNIINGGTHANNSIDFQEYMIMPLGFESFKEALRASAEVYHTLKKLLDGKNQLTSVGDEGGFAPNFSNNVEPLEVISQAIEKAGYKLGEEIALALDVASSELVDENFNYHLKGENKILDSHELVAYYKELVAKYPIVSIEDGLSEDDWEGWAFLSKELGRQIQLVGDDLFVTNASLLQKGIEKNIANAVLIKPNQIGTISETLETIRLAKHHAYQCVMSHRSGESEDSFIADFAVALNTGEIKTGSTARSERIAKYNRLLEIEHELKGGIYIGKELFKHG

SEQ ID NO: 16589 - protein, 234 aa, Helicobacter pylori 26695
MTKIAMANFKSAMPIFKSHAYLKELEKTLKPQHFDRVFVFPDFFGLLPNSFLHFTLGVQNAYPRDCGAFTGEITSKHLEELKIHTLLIGHSERRTLLKESPSFLKEKFDFFKSKNFKIVYCIGEELTTREKGFKAVKEFLSEQLENIDLNYPNLVVAYEPIWAIGTKKSASLEDIYLTHGFLKQILNQKTPLLYGGSVNTQNAKEILGIDSVDGLLIGSASWELENFKTIISFL

SEQ ID NO: 16590 - protein, 456 aa, Helicobacter pylori 26695
MILKKSGILAKKTSLFECQHCGFTSPKWLGKCVQCNAWESFIELNQAQKEVLNTLKKPIPQAQKSVSIAAIEHEEVIKFSSTQSELDIVLGGGIAKGGLYLVGGSPGVGKSTLLLKVASGLAKNQQKVLYVSGEESLSQIKMRAIRLDCIEKELYLLNEINWPVIKANIESENYFACVIDSIQTLYSPEISSAPGSISQVREITFELMRLAKTRDIAIFIIGHITKEGSIAGPRVLEHMVDSVLYFEGDPSRELRILRSFKNRFGPTSEIGLFEMKEQGLVSAKEASSLFFSKEEPMEGSAITITLEGSRALILEIQALVSECSFGSPKRLANGFDTNRLNMLIALLEKKLEIPLNRHDVFINVSGGIKISEPACDLAVIASILSSFKNRKIDNKTAFLGEVSLNGRILEAPNLNARLKEMENYGFLKAILPKKPSQKTSIKCYEANAVGKIVEWM

SEQ ID NO: 16591 - protein, 430 aa, Helicobacter pylori 26695
MELLHSINDFNEAKQVIAGGVNSPVRAFKSVKGTPPFILKGKGAYLYDVDNNHYIDFVQSWGPLIFGHADEEIEENIINALKKGTSFGAPTELETTLAKEIISCYEGLDKVRLVSSGTEATMSAIRLARAYSQKDDLIKFEGCYHGHSDSLLVKAGSGCATFGSPSSLGVPNDFSKHTLVARYNDLNSTEECFKKGNVGCVIIEPIAGNMGLVPAQKEFLLGLKALCEKYQAVLILDEVMSGFRASLSGSQEFYGVVPDLVTFGKVIGAGLPLACFGGRAEIMDLLSPIGSVYQAGTLSGNPLAVCAGLSALYKIKRDKTLYTRLDALAIRLTQGLQKSAQNYNIALETLNMGSMFGFFFNENAVHDFDDALKSDTEMFAKFHQKMLFKGVYLACSSFETGFICEPMTEEMIDLTIAKADESFDEIIKGV

SEQ ID NO: 16592 - protein, 338 aa, Pseudomonas sp. ACP
MNLQRFPRYPLTFGPTPIQPLARLSKHLGGKVHLYAKREDCNSGLAFGGNKTRKLEYLIPEALAQGCDTLVSIGGIQSNQTRQVAAVAAHLGMKCVLVQENWVNYSDAVYDRVGNIQMSRILGADVRLVPDGFDIGFRRSWEDALESVRAAGGKPYAIPAGCSDHPLGGLGFVGFAEEVRAQEAELGFKFDYVVVCSVTGSTQAGMVVGFAADGRADRVIGVDASAKPAQTREQITRIARQTAEKVGLERDIMRADVVLDERFAGPEYGLPNEGTLEAIRLCARTEGMLTDPVYEGKSMHGMIEMVRNGEFPEGSRVLYAHLGGVPALNGYSFIFRDG

SEQ ID NO: 16593 - protein, 481 aa, Helicobacter pylori 26695
MIVRTQNSESKIKEFFEFCKENEVEFVDFRFSDIKGTWNHIAYSFGALTHGMLKEGIPFDASCFKGWQGIEHSDMILTPDLVRYFIDPFSADVSVVVFCDVYDVYKNQPYEKCPRSIAKKALQHLKDSGLGDVAYFGAENEFFIFDSIKIKDASNSQYYEVDSEEGEWNRDRSFENGVNFGHRPGKQGGYMPVPPTDTMMDIRTEIVKVLNQVGLETFVVHHEVAQAQGEVGVKFGDLVEAADNVQKLKYVVKMVAHLNGKTATFMPKPLYGDNGSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQVFSEEFIQAYQSLKFNAEVFPWESKPHPFEFITTYSC

SEQ ID NO: 16594 - protein, 191 aa, Helicobacter pylori 26695
MKQLFLIIGAPGSGKTTDAELIAKNNSETIAHFSTGDLLRAESAKKTERGLLIEKFTSQGELVPLEIVVETILSAIKSSGKGIILIDGYPRSVEQMQALDKELNAQNEVILKSVIEVEVSENTAKERVLGRSRGADDNEKVFHNRMRVFLDPLGEIQNFYKNKKVYKAIDGERSIEEIVGEMQEYILSFGN

SEQ ID NO: 16595 - protein, 481 aa, Helicobacter pylori 26695
MRILQRALTFEDVLMVPRKSSVLPKDVSLKSRLTKNIRLNIPFISAAMDTVTEHKTAIAMARLGGIGIVHKNMDIQTQVKEITKVKKSESGVINDPIFIHAHRTLADAKVITDNYKISGVPVVDDKGLLIGILTNRDVRFETDLSKKVGDVMTKMPLVTAHVGISLDEASDLMHKHKIEKLPIVDKDNVLKGLITIKDIQKRIEYPEANKDDFGRLRVGAAIGVGQLDRAEMLVKAGVDALVLDSAHGHSANILHTLEEIKKSLVVDVIVGNVVTKEATSDLISAGADAIKVGIGPGSICTTRIVAGVGMPQVSAIDNCVEVASKFDIPVIADGGIRYSGDVAKALALGASSVMIGSLLAGTEESPGDFMIYQGRQYKSYRGMGSIGAMTKGSSDRYFQEGVASEKLVPEGIEGRVPYRGKVSDMIFQLVGGVRSSMGYQGAKNILELYQNAEFVEITSAGLKESHVHGVDITKEAPNYYG

SEQ ID NO: 16596 - protein, 327 aa, Helicobacter pylori 26695
MSLKVFDYEDVQLIPNKCIVNSRSECDTTVILGKHAFKMPIVPANMQTIINESIAEFLAENGYFYIMHRFDGAARIPFVKKMKKRQWISSISVGVKKEECLFVEELAKQGLAPDYITIDIAHGHSNSVIEMIQRIKTHLPETFVIAGNVGTPEAVRELENAGADATKVGIGPGKVCITKIKTGFGTGGWQLAALRWCAKAARKPIIADGGIRTHGDIVKSIRFGATMVMIGSLFAGHEESSGETKIENGIAYKEYFGSASEFQKGEKKNIEGKKIWIQHKGSLKDTLVEMHQDLQSSISYAGGRDLEAIRKVDYVIVKNSIFNGDAI

SEQ ID NO: 16597 - protein, 289 aa, Helicobacter pylori 26695
MGFADFFKNFKINKLRTAPSKEEQPSHWVKCPKCYALMYHKEVFSKYSVCLKCHYHFRMKAAERIEFLCDVGSFEEFDKHLRPNDPLNFVDKESYKQRIKKYEKRTNRPSSVISGEAKINRMPLQIVVFDFSFMGGSLGSVEGEKIVRAINRAVAKREALLIVSASGGARMQESTYSLMQMAKTSAALNRLSEAKLPFISLLSDPTYGGVSASFAFLGDLIIAEPGAMIGFAGPRVIKQTIGADLPEGFQTAEFLLEHGLIDMIVHRKDLKKTLSDLIAMMTHKTSKIF

SEQ ID NO: 16598 - protein, 491 aa, Helicobacter pylori 26695
MAQKTLLIITDGIGYRKDSDHNAFFHAKKPTYDLMFKTLPYSLIDTHGLSVGLPKGQMGNSEVGHMCIGAGRVLYQDLVKISLSLQNDELKNNPAFLNTIQKSPVVHLMGLMSDGGVHSHIEHFIALALECEKSHKKVCLHLITDGRDVAPKSALTYLKQMQNICNESIQIATISGRFYAMDRDKRFERIELAYHSLMGLNHTPLSPSEYIQSQYDKNITDEFIMPACFKNYCGMQDDESFIFINFRNDRAREIVSALGQKQFSGFKRQVFKKLHIATMTPYDNTFPYPVLFPKESVQNTLAEVVSQHNLTQSHIAETEKYAHVTFFINGGVETPFKNENRVLIQSPKVTTYDLKPEMSAKEVTLAVLEQMKLGTDLIIVNFANGDMVGHTGNFEASVKAVEAVDACLGEILSLAKKLDYAMLLTSDHGNCERMKDENQNPLTNHTAGSVYCFVLGDGVKSIKNGALNNIASSVLKLMGLKAPATMDEPLF

SEQ ID NO: 16599 - protein, 436 aa, Helicobacter pylori 26695
MNFQENLAALDLEYLWHPCSQMQEHQNFPIIPIKKAQGIYLYDFNDNAYMDLISSWWVNLFGHNNAYISQQLKNQIDDLEHVLLASFSHKPIITLSQRLCQLTHMDKCFYADNGSSCVEIALKMSYHAHFLKNQTRRKKLFLSLSNSYHGETLGALSVGDVKLYKDTYTPLLLKNLTTPVPKNDHEIENSLNALKRLLDKHSEEICAFIAEPLLQCAGNMHIYSARYLKQAVLLCKQKNIHIIFDEIATGFGRTGSMFAYEQCEIKPDFLCLSKGISGGYLPLSALLTHNEIYNQFYAPYEENKAFLHSHSYTGNALACACANATLDIFEKENVIEKNKALSGFIFNTLQNALKPLMEQQVVSDLRHLGMVFAFEVFIQTKERLSLAVFKKTLKKGLLLRPLNNTIYLMPPYIITHEEVKKAVAGLVEILDELRKG

SEQ ID NO: 16600 - protein, 348 aa, Helicobacter pylori 26695
MRVQSKGFAIFSKDGHFKPHDFSRHAVGPKDVLIDILYAGICHSDIHSAYSEWKEGIYPMVPGHEIAGAIKEVGKEVKKFKVGDVVGVGCFVNSCKACKPCKEHQEQFCAKVVFTYDCLDYFHDNEPHMGGYSNNIVVDENYVISVDKNAPLEKVAPLLCAGITTYSPLKFSKVTKGTKVGVAGFGGLGSMAVKYAVAMGAEVSVFARNEHKKQDALSMGVKHFYTDPKQCKEELDFIISTIPTHYDLKDYLKLLTYNGDLALVGLPPVEIAPALSVFDFIHLGNRKVYGSLIGGIKETQEMMDFSIKHNIYPEIDLILGKDIDTAYHNLTHGKAKFRYVIDMKKSFD

SEQ ID NO: 16601 - protein, 248 aa, Helicobacter pylori 26695
MSVILETKGLKKTYQNHLVLDGINFTLNKGEVAVILGPSGCGKSTFLKCLNGLEKINEGEILFENTNLNNKATNWNQMRQKIGMVFQNYELFPHLNVLDNILLAPMKVQKRSKDEVISQAIELLKRVGLEHKQQAYPKELSGGQKQRVAIVRSLCMRPKIMLFDEVTASLDPEMVKEVLEVILELATTGMSMVIVTHEMKFAQKIAHKIVFFDSGKIAEENNAKEFFNHPKSQRAQKFLETFHFLGSC

SEQ ID NO: 16602 - protein, 435 aa, Helicobacter pylori 26695
MGFFKLKEHNTNIATEFRAGLTTFITMIYIVPLNALILSQANMPYEALLSATAIITILSSVFNGLWANTPIAMSVGLGLSAYFSFGLVQGLKLPWQSALGIVALSGAIFVILSFTKFRSWVMRSIPSDLRRAVSAGIGAFIAFIGLKEMHIVVTHKATLVTLGDFGDPHVLLGVVGIILTFALYTLKIRGSFIIAVLITSILAWVLKLAPYPSEFFSMPASIGPIAFQLDFKGIFFDASGAFTLALVPVIITFFVTDLFDSLGTLAGIGHKTDFFNDEEKNKELEKTLEADAVASLGSAVVGVSTTTAFIESASGVEEGGRTGLTAVFTGLFFVLTLFCLPLLKAIPSNAIYPVLVVVGVLMFSVLEGVNFKDMAISVSTFLTVVMMPLTFSIADGLAFGFLSYSIIKLVQKDFKALNSGIIILCIISVSVFIFR

SEQ ID NO: 16603 - protein, 329 aa, Helicobacter pylori 26695
MQQRHLGPLKVGALALGCMGMTYGYGEVHDKKQMVKLIHKALELGINFFDTAEAYGEDNEKLLGEAIKPFKDKVVVASKFGIYYADPNDKYATMFLDSSPNRIKSAIEGSLKRLKVECIDLYYQHRMDTNTPIGEVAEVMQLLIKEGKIKAWGMSEAGLSSIQKAHQICPLSALQSEYSLWWREPEKEILGFLEKEKIGFVAFSPLGKGFLGAKFEKNATFASEDFRSVSPRFNQENLAKNYALVELIQDHAHAKGVTPAQLALSWILHTQKIIVPLFGTTKESRLIENIGALQVSWSQKELEIFQKELTAIKIEGARYPERINEMVNQ

SEQ ID NO: 16604 - protein, 155 aa, Helicobacter pylori 26695
MLHKKYRPNVAAIIMSPDYPNACEVFIAERIDIEGAWQFPQGGIDEGETPLEALHRELLEEIGTNEIEILAQYPRWIAYDFPSNMEHKFYSFDGQKQRYFLVRLKHTNNIDLNKHTPEFRAYQFIHLKDLLKRIVPFKRQVYRQVIAYFKREGYL

SEQ ID NO: 16605 - protein, 262 aa, Helicobacter pylori 26695
MRYQNMFETLKKHEKMAFIPFVTLGDPNYELSFEIIKTLIISGVSALELGLAFSDPVADGITIQASHLRALKHASMAKNFQLLKKIRDYNHNIPIGLLAYANLIFSYGVDGFYAQAKECGIDSVLIADMPLIEKELVIKSAQKHQIKQIFIASPNASSKDLEQVATHSQGYIYALARSGVTGASRILENDSSAIIKTLKAFSPTPALLGFGISKKEHITNAKGMGADGVICGSALVKIIEENLNNENAMLEKIKGFIGGMIF

SEQ ID NO: 16606 - protein, 369 aa, Helicobacter pylori 26695
MELSYYEILEVEKHSNQETIKKSYRKLALKYHPDRNAGDKEAEEKFKLINEAYGVLSDEKKRALYDRYGKKGLNQAGASQGDFSDFFEDLGSFFEDAFGFGARGSKRQKSSIAPDYLQTLELSFKEAVFGCKKTIKVQYQSVCESCDGTGAKDKALETCKQCNGQGQVFMRQGFMSFAQTCGACQGKGKIVKTPCQACKGKTYILKDEEIDAIIPEGIDDQNRMVLKNKGNEYEKGKRGDLYLEAQVKEDEHFKREGCDLFIKAPVFFTTIALGHTIKVPSLKGDELELKIPRNARDKQTFAFRNEGVKHPESSYRGSLIVELQVIYPKSLNKEQQELLEKLHASFGYEGEPHKSVLETCISKIKDWFK

SEQ ID NO: 16607 - protein, 402 aa, Helicobacter pylori 26695
MLAKMSFMQNVKNIQEVEVSHKRVLIRVDFNVPLDENLNITDDTRIRESLPTIQYCIDNKAKDIILVSHLGRPKGVEEKLSLKPFLKRLERLLNHEVVFSQNIVQLKQALNENAPTRIFLLENIRFLRGEEENDENLAKDLASLCDVFVNDAFGTSHRKHASTYGTAKFAPIKVSGFLLKKEIDSFYQAFNHPLRPLLLIVGGAKVSSKLTLLKNILDLIDKLIIAGAMSNTFLKALGYDVQDSSVEDALINDALELLQSAKEKKVKVYLPIDAVTTDDILNPKHIKISPVQDIEPKHKIADIGPASLKLFSEVIESAPTILWNGPLGVHEKQEFARGTTFLAHKIADTYAFSLIGGGDTIDAINRAGEKDNMSFISTGGGASLELLEGKILPCFEVLDKRH

SEQ ID NO: 16608 - protein, 466 aa, Helicobacter pylori 26695
MLSVYEKVNALDKRAIEELFLSEDILMENAAMALERAVLQNASLGAKVIILCGSGDNGGDGYALARRLVGRFKTLVFEMKLAKSPMCQLQQERAKKAGVVIKAYEENALNQNLECDVLIDCVIGSHFKGKLEPFLNFESLSQKARFKIACDIPSGIDSKGRVDKGAFKADLTISMGAIKSCLLSDRAKDYVGELKVGHLGVFNQIYEIPTDTFLLEKSDLKLPLRDRKNAHKGDYGHAHVLLGKHSGAGLLSALSALSFGSGVVSVQALECEITSNNKPLELVFCENFPNLLSAFALGMGLENIPKDFNKWLELAPCVLDAGVFYHKEVLQALEKEVILTPHPKEFLSLLKLVGINISMLELLDNKLEIARDFSQKYPKVVLLLKGANTLIAHQGQVFINILGSVALAKAGSGDVLAGLILSLLSQNYTPLDAAINASSAHALASLEFKNNYALTPLDLIEKIKQL

SEQ ID NO: 16609 - protein, 217 aa, Helicobacter pylori 26695
MKVAPSLLSADFMHLAKEIESVSNADFLHVDVMDGHYVPNLTMGPVVLENVTQMSQVPLDVHLMVENASFFAELFAPLKPQIISIHAENEKHPHRVLQLIKNLGITPGIVLNPHTHEESIKYLLESVGLVLLMSVNPGFGGQKFLDLVLEKCLKVKELIKRYNPSCLLEVDGGVNDKNIFELQQAGVDVVVSGSYIFKSKDRKLAIEGLQNVRQSLA

SEQ ID NO: 16610 - protein, 163 aa, Helicobacter pylori 26695
MMDPIKTYEIKEEELAKTAYATIKTNKGNIALELFYKDAPQAVSNFVTLAKEGFYNGLNFHRVIAGFVAQGGCPYGTGTGGPGHRIKCEVAHNPNKHKRGSISMAHAGRDTGGSQFFLCFVDLPHLDGEHTVFGKITSAEGLSVLDKIKQGDIIESVVFSSSL

SEQ ID NO: 16611 - protein, 261 aa, Helicobacter pylori 26695
MNATNNQVLIEVKDLHSAFGSTIIHRGVSFSVHKGEVMAILGGSGSGKSTLLRCMILLNRPTKGEVLLFGEDIWKLKEAEQQKIFNRCGICFQFGALYSSLTVLENVGVMLEQYGAYSKKIVEEISKMWIEKVGLPPRAYHLYPYELSGGMKKRVGIARAMATNPEILFLDEPTSGLDPYSAGKFDELIMTLKESLQLTVVMITHDLDSVHDCVDRFIMLKDGLLEFNGDLKDFIKKAQTQGLDEGNLFNSTRGEKFWKGM

SEQ ID NO: 16612 - protein, 162 aa, Chlamydomonas reinhardtii
MANPEFYGLSTTTLSGQPFPFKDLEGKAVLIVNVASKCGFTPQYKGLEELYQQYKDRGLVILGFPCNQFGGQEPGDASAIGEFCQRNFGVTFPIMEKSDVNGNDANPVFKYLKSQKKQFMMEMIKWNFEKFLVDKSGQVVARFSSMATPASLAPEIEKVLNA

SEQ ID NO: 16613 - protein, 242 aa, Vibrio cholerae
SVLEVLIANGIEVIVQENNGYTPTPGISHAILTYNLKHTDKADGIVITPSHNPPQDGGIKYNPPHGGPAEGELTQAIEDRANAYISQQLAGVKRMPIALAKQSELLKQVDLVKPYVDDLVNVVDMAAIQKAKLKIGVDPLGGSGIDYWRQIGNAYQLDLTLVSEAIDPSFQFMSLDKDGVIRMDCSSPYAMAGLLALKDEYDLAFGNDPDYDRHGIVTPKGLMNPNHFLAVCIDYLYRHRQG

SEQ ID NO: 16614 - protein, 241 aa, Vibrio cholerae
VSEVLIANGIEVIVQENNGYTPTPGISHAILTYNLKHTDKADGIVITPSHNPPQDGGIKYNPPHGGPAEGELTQAIEDRANAYISQQLAGVKRMPIALAKQSELLKQVDLVKPYVDDLVNVVDMAAIQKAKLKIGVDPLGGSGIDYWRQIGNAYQLDLTLVSEAIDPSFQFMSLDKDGVIRMDCSSPYAMAGLLALKDEYDLAFGNDPDYDRHGIVTPKGLMNPNHFLAVCIDYLYRHRQG

SEQ ID NO: 16615 - protein, 244 aa, Vibrio cholerae
VLEVLIANGIEVIVQENNGYTPTPGISHAILTYNLKHTDKADGIVITPSHNPPQDGGIKYNPPHGGPAEGELTQAIEDRANAYISQQLAGVKRMPIALAKQSELLKQVDLVKPYVDDLVNVVDMAAIQKAKLKIGVDPLGGSGIDYWRQIGNAYQLDLTLVSEAIDPSFQFMSLDKDGVIRMDCSSPYAMAGLLALKDEYDLAFGNDPDYDRHGIVTPKGLMNPNHFLAVCIDYLYRHRQGWAG

SEQ ID NO: 16616 - protein, 241 aa, Vibrio cholerae
SVLEVLIANGIEVIVQENNGYTPTPGISHAILTYNLKHTDKADGIVITPSHNPPQDGGIKYNPPHGGPAEGELTQAIEDRANAYISQQLAGVKRMPIALAKQSELLKQVDLVKPYVDDLVNVVDMAAIQKAKLKIGVDPLGGSGIDYWRQIGNAYQLDLTLVSEAIDPSFQFMSLDKDGVIRMDCSSPYAMAGLLALKDEYDLAFGNDPDYDRHGIVTPKGLMNPNHFLAVCIDYLYRHRQ

SEQ ID NO: 16617 - protein, 245 aa, Vibrio cholerae
SVLVVLIANGIEVIVQENNGYTPTPGISHAILTYNLKHTDKADGIVITPSHNPPQDGGIKYNPPHGGPAEGELTQAIEDRANAYISQQLAGVKRMPIALAKQSELLKQVDLVKPYVDDLVNVVDMAAIQKAKLKIGVDPLGGSGIDYWRQIGNAYQLDLTLVSEAIDPSFQFMSLDKDGVIRMDCSSPYAMAGLLALKDEYDLAFGNDPDYDRHGIVTPKGLMNPNHFLAVCIDYLYRHRQGWAG

SEQ ID NO: 16618 - protein, 240 aa, Vibrio cholerae
LEVLIANGIEVIVQENNGYTPTPGISHAILTYNLKHTDKADGIVITPSHNPPQDGGIKYNPPHGGPAEGELTQAIEDRANAYISQQLAGVKRMPIALAKQSELLKQVDLVKPYVDDLVNVVDMAAIQKAKLKIGVDPLGGSGIDYWRQIGNAYQLDLTLVSEAIDPSFQFMSLDKDGVIRMDCSSPYAMAGLLALKDEYDLAFGNDPDYDRHGIVTPKGLMNPNHFLAVCIDYLYRHRQG

SEQ ID NO: 16619 - protein, 240 aa, Vibrio cholerae
VLIANGIEVIVQENNGYTPTPGISHAILTYNLKHTDKADGIVITPSHNPPQDGGIKYNPPHGGPAEGELTQAIEDRANAYISQQLAGVKRMPIALAKQSELLKQVDLVKPYVDDLVNVVDMAAIQKAKLKIGVDPLGGSGIDYWRQIGNAYQLDLTLVSEAIDPSFQFMSLDKDGVIRMDCSSPYAMAGLLALKDEYDLAFGNDPDYDRHGIVTPKGLMNPNHFLAVCIDYLYRHRQGWA

SEQ ID NO: 16620 - protein, 321 aa, Arabidopsis thaliana
MADVHKGKVCVTGAGGFLGSWVVDLLLSKDYFVHGTVRDPDNEKYAHLKKLEKAGDKLKLFKADLLDYGSLQSAIAGCSGVFHVACPVPPASVPNPEVELIAPAVDGTLNVLKACIEANVKRVVYVSSVAAAFMNPMWSKNQVLDEACWSDQEYCKKTENWYCLAKTRAESEAFEFAKRTGLHLVSVCPTLVLGPILQQNTVNASSLVLLKLLKEGFETRDNQERHLVDVRDVAQALLLVYEKAEAEGRYICTSHTVKEEIVVEKLKSFYPHYNYPKKYIDAEDRVKVSSEKLQKLGWTYRPLEETLVDSVESYRKAKLVD

SEQ ID NO: 16621 - protein, 453 aa, Arabidopsis thaliana
MDTDLISNLPDDVLGKILSLVPTKLAAATSVLSKRWRNLLPLVDSLDFDETMLFYPDNKDGEDEASSYESGQRRRHSFSHFVDKTLALLSNAPLTEKFSLKCYHEDDGARINRWIRTALERGCLELNLEAANYLPIDSQYFTSNTLVKLTISDGFYPGGHLLPFGGVFFPALKTLTLVSVCFTSVEMINFFIHGCPALEELFLCVWMQYMSSPNVRRVTITSDFDDDIQRPSMVLKTPSLVYLDYSSYVAGNYYVVLDSLVEARLDLRLYEPIIYDEDGLWNAEVFGNITNLIEAIRTIKILHLSPSSLEVFYYCCDLPVLEDLVNLSIESDKEKGWEVMPRLLNKSPNLQTLVVKGLVHRVTYCCGDACACIRMKDREIVSCLSRCRVKVLKILGYGGSFRELKQMRHFLGKLKCLETVKVGVKEGSKKSNYLVANVMALPRVSSKCKIQFI

SEQ ID NO: 16622 - protein, 477 aa, Arabidopsis thaliana
MSFVWSAAVWVIAVAAVVISKWLYRWSNPKCNGKLPPGSMGLPIIGETCDFFEPHGLYEISPFVKKRMLKYGPLFRTNIFGSNTVVLTEPDIIFEVFRQENKSFVFSYPEAFVKPFGKENVFLKHGNIHKHVKQISLQHLGSEALKKKMIGEIDRVTYEHLRSKANQGSFDAKEAVESVIMAHLTPKIISNLKPETQATLVDNIMALGSEWFQSPLKLTTLISIYKVFIARRYALQVIKDVFTRRKASREMCGDFLDTMVEEGEKEDVIFNEDSAINLIFAILVVAKESTSSVTSLAIKFLAENHKALAELKREHAAILQNRNGKGAGVSWEEYRHQMTFTNMVINETLRMANMAPIMYRKAVNDVEIKGYTIPAGWIVAVIPPAVHFNDAIYENPLEFNPWRWEGKELRSGSKTFMVFGGGVRQCVGAEFARLQISIFIHHLVTTYDFSLAQESEFIRAPLPYFPKGLPIKISQSL

SEQ ID NO: 16623 - protein, 399 aa, Arabidopsis thaliana
MVEVYEFWAVIVSLIVVKLCHWIYQWKNPKGNGKLPPGSMGYPIIGETFEFMKLHDAIQLPTFVKEKLLRHGPVFRTSLFGGKVIISTDIGLNMEIAKTNHIPGMPKSLERLFGATNLFVNKDTHKHARSLTNQFLGSQALKLRMIQDIDFLARTHMKEGARKGCLDVKETASKIVIECLSKKVMGEMEPEAAKELTLCWTFFPRDWFRFAWNFPGTGVYRIVKARNRMMKVIKETVVKKRASGKKLGEFFETIFGDTESVTMSIEIATEYIFTLFVLANETTPGVLAATIKLISDNPKVMQELRREHEGIVQDKIKKDETADLTWEDYKSMTFTQMVINESLRITSTVPTVLRIIDHEIQFGDYTIPAGWIFMGYPYVHFNPEKYDDPLAFNPWRWKT

SEQ ID NO: 16624 - protein, 326 aa, Arabidopsis thaliana
MSAVLTAGGGLTAGDRSIITAINTGASSLSFVGSAFIVLCYCLFKELRKFSFKLVFYLALSDVLCSFFLIVGDPSKGFICYAQGYTTHFFCVASFLWTTTIAFTLHRTVVKHKTDVEDLEAMFHLYVWGTSLVVTVIRSFGNNHSHLGPWCWTQTGLKGKAVHFLTFYAPLWGAILYNGFTYFQVIRMLRNARRMAVGMSDRVDQFDNRAELKVLNRWGYYPLILIGSWAFGTINRIHDFIEPGHKIFWLSVLDVGTAALMGLFNSIAYGFNSSVRRAIHERLELFLPERLYRWLPSNFRPKNHLILHQQQQQRSEMVSLKTEDQQ

SEQ ID NO: 16625 - protein, 180 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFIAYKPPSFTG

SEQ ID NO: 16626 - protein, 487 aa, Arabidopsis thaliana
MATETVLATAVSNGKSKGCCKSGPGYATPLAAMAGPREKLIYVTALYSGTGRDKPDYLATVDVDPSSPTFSSVIHRLKMPYIGDELHHTGWNSCSSCHGDASADRRYLVLPGLISGRIYAIDTKTDPKAPSLYKVVEPKEIAEKTGLAFPHTSHCLASGDMLVSCLGDKEGNAKGNGFLLLDSDFNVKSRWDKPGHGPLFGYDFWYQPRFKTMISTSWGAPKAFSKGFNLQHVADGLYGSHLHIYQWAEGEMKQIIDLGNTGLLPLEIRFLHDPSKDTGYVGSALSSNMIRFFKNSDDTWSHEVVISVKPLKVENWILPEMPGLITDFLISLDDRFFYFVNWLHGDIRQYNIEDPKNPVLTGQIWVGGLLQKGSPYKAVGEDGNTYQFDVPQIKGKSLRAGPQMIQLSLDGKRLYATNSLFSAWDRQFYPEIMEKGSHIIQIDVDTDKGGLTLNPDFFVDFGDEPDGPALAHEMRYPGGDCTSDIWI

SEQ ID NO: 16627 - protein, 347 aa, Sulfolobus solfataricus
  misc_feature (1)..(1): Xaa can be any naturally occurring amino acid
  misc_feature (44)..(44): Xaa can be any naturally occurring amino acid
  misc_feature (138)..(138): Xaa can be any naturally occurring amino acid
  misc_feature (186)..(186): Xaa can be any naturally occurring amino acid
  misc_feature (269)..(269): Xaa can be any naturally occurring amino acid
  misc_feature (306)..(306): Xaa can be any naturally occurring amino acid
  misc_feature (317)..(317): Xaa can be any naturally occurring amino acid
  misc_feature (322)..(322): Xaa can be any naturally occurring amino acid
XRAVRLVEIGKPLSLQEIGVPKPKGPQVLIKVEAAGVCHSDVHXRQGRFGNLRIVEDLGVKLPVTLGHEIAGKIEEVGDEVVGYSKGDLVAVNPWQGEGNCYYCRIGEEHLCDSPRWLGINFDGAYAEYVIVPHYKYXYKLRRLNAVEAAPLTCSGITTYRAVRKASLDPTKTLLVVGAGGGLGTXAVQIAKAVSGATIIGVDVREEAVEAAKRAGADYVINASMQDPLAEIRRITESKGVDAVIDLNNSEKTLSVYPKALAKQGKYVXVGLFGADLHYHAPLITLSEIQFVGSLVGNQSDFLGIXRLAEAGKVKPXITKTXKLEEANEAIDNLENFKAIGRQVLIP

SEQ ID NO: 16628 - protein, 276 aa, Bacillus subtilis
  misc_feature (1)..(1): Xaa can be any naturally occurring amino acid
  misc_feature (39)..(39): Xaa can be any naturally occurring amino acid
  misc_feature (51)..(51): Xaa can be any naturally occurring amino acid
  misc_feature (156)..(156): Xaa can be any naturally occurring amino acid
  misc_feature (221)..(221): Xaa can be any naturally occurring amino acid
  misc_feature (225)..(225): Xaa can be any naturally occurring amino acid
XNVPFWTEEHVRATLPERDAESHKGTYGTALLLAGSDDXPGAALLAGLGAXRSGLGKLVIGTSENVIPLIVPVLPEATYWRDGWKKAADAQLEETYRAIAIGPGLPQTESVQQAVDHVLTADCPVILDAGALAKRTYPKREGPVILTPHPGEFFRXTGVPVNELQKKRAEYAKEWAAQLQTVIVLKGNQTVIAFPDGDCWLNPTGNGALAKGGTGDTLTGXILGXLCCHEDPKHAVLNAVYLHGACAELWTDEHSAHTLLAHELSDILPRVWKRFE

SEQ ID NO: 16629 - protein, 355 aa, Callistephus chinensis
MVISANTRVESLATSGSDLIPKEYIRTHDELTTITNIFDEEKSDQGPQVPIIDLHDINSNDPKTRDKCTYELRKAATEWGVMHLVNHGISSDLINRVKAAGKSFFDQPVEEKEKYCNDIASGKIQGYGSKLANNACGQLEWEDYFFHLAFPEEKRDLSIWPTTPHDYIPATTEYAKQLRALATKILAALSLGLGLEEGRLEKEVGGMEELLVQLKINYYPKCPQPDVALGVEAHTDVSALTFILHNMVPGLQLFYGGKWVTAKCVPDSIIMHIGDTIEILSNGKYKSILHRGLVNKEKVRISWAVFCEPPKDKIILKPLPETISEDEPPLFPPRTFQQHMEHKLFRKNNDAVDPK

SEQ ID NO: 16630 - protein, 498 aa, Aspergillus niger
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASRNAIRNYAISKDTGFVTYKNWPIYKDDTTIPMRKGTDGSQIVTILSNKGASGDSYTLSLSGAGYTAGQQLTEVIGCTTVTVGSDGNVPVPMAGGLPRVLYPTEKLAGSKICYG

SEQ ID NO: 16631 - protein, 499 aa, Aspergillus niger
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASRNAIRNYAISKDTGFVTYKNWPIYKDDTTIPMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 16632 - protein, 167 aa, Helianthus annuus
MATQSKKTLYDFTVKDAKGNDVDLSVYKGKVVLIVNVASKCGLTNNSYDELNQIYLKYKEKGFEILAFPCNQFGQQEPGTNEEIVDFVCTKFKSEFPIFDKIDVNGENAAPVYEFLKTGFYGILGGDIQWNFSKFLVDKNGQPVDCYYPTTSPLTVERDIQKLLGLL

SEQ ID NO: 16633 - protein, 175 aa, Hypocrea jecorina
AGGVGTLLVQMLRTVGAKIVATASTEEKLALAKKYGADYVVNSNDDIVARVNEITGGHGIDVIFDGVGKATFDADLQMLALKGHLISFGNASGAVPPFNILQLGPKNGRLMRPVVNGYVAERADLERYTSELFDLVLSKKVEVKIHKIYPLKDAAQAHIDLESRKTTGKLLLKID

SEQ ID NO: 16634 - protein, 174 aa, Lycopersicon esculentum
MDLIDKAKNFVSEKIANMEKPEATITDVDLKGIGFDGLAFHAKVSVKNPYSVPIPIMEIDYVLKSATRVIASGRIPDPGSIKANDSTMLDVPVKVPHSVLVSLVRDIGGDWDVDYTLELGLIIDIPVIGNITIPLSYSGEYKLPTLSDLWKGGKEEEKKEDEEEKEDPSKVVEI

SEQ ID NO: 16635 - protein, 261 aa, Saccharomyces cerevisiae
AQSFAEAMRMGSEVYHHLKILAKEQYGPSAGNVGDEGGVAPDIDTAEDALDMIVEAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 16636 - protein, 181 aa, Saccharomyces cerevisiae
MPFVKGFEPISLRDTNLFEPIKIGNTQLAHRAVMPPLTRMRATHPGNIPNKEWAAVYYGQRAQRPGTMIITEGTFISPQAGGYDNAPGIWSDEQVAEWKNIFLAIHDCQSFAWVQLWSLGWASFPDVLARDGLRYDCASDRVYMNATLQEKAKDANNLEHSLTKDDIKQYIKDYIHAAKNS

SEQ ID NO: 16637 - protein, 419 aa, Arabidopsis thaliana
MDRISQLSDDLLLQILSFIPGKDVVATSLLSKRWQSLWMLVSELEYDDSYHTGDYKSFSQFVYRSLLSNNAPVIKHLHLNLGPDCPAIDIGLWIGFALTRRLRQLKINIRTSSNDASFSLPSSLYTSDTLETLRLINFVLLDVPSSVCLPSLKVLHLKTVDYEDDASLPSLLFGCPNLEELFVERHDQDLEMDVTFVVPSLRRLSMIDKNYGQCDRYVIDVPSLKYLNITDDAVYDVRQIENMPELVEAHVDITQGVTHKFLRALTSVRQLSLCLSLSEVMCPSGIIFSQLVHLNLSTVVKGWWDLLTSMLQDSPKLQSLKLIDKQHESGLCGIETPIGWKLPSSVPECLLFSLEAFEWIGYKGRRGDREVATYVLKNAACLRTAKFSPESTDVGEKYHMLKELASVPTASTSSKLLFD

SEQ ID NO: 16638 - protein, 504 aa, Arabidopsis thaliana
MVVINSLRRLARTTQVHLHSKYATCMSGNSTSRRIFTTEAAPEKKNTVGSKGHDMLAPFTAGWQSADLDPLVIAKSEGSYVYDDTGKKYLDSLAGLWCTALGGNEPRLVSAAVEQLNTLPFYHSFWNRTTKPSLDLAKVLLEMFTANKMAKAFFTSGGSDANDTQVKLVWYYNNALGRPEKKKFIARKKSYHGSTLISASLSGLPPLHQNFDLPAPFVLHTDCPHYWRFHLPGETEEEFSTRLAKNLEDLIIKEGPETIGAFIAEPVMGAGGVIPPPATYFEKVQAVVKKYDILFIADEVICAFGRLGTMFGCDKYNIKPDLVTLAKALSSAYMPIGAILMSQEVADVINSHSSKLGVFSHGFTYSGHPVSCAVAIEALKIYKERNIPEYVAKVAPRFQDGVKAFASGSPIIGETRGTGLILGTEFVDNKSPNEPFPPEWGVGAFFGAECQKHGMLVRVAGDGILMSPPLIISPEEIDELISIYGKALKATEEKVKELKAQHKK

SEQ ID NO: 16639 - protein, 395 aa, Arabidopsis thaliana
MAVIIPRSDPPSRIHPEPPQTLEIDHFDHLPDSILLLVFNKIGDVKALGRCCVVSRRFHSLVPQVDNVVVRVDCVISDDDSSSLSSIKSRSGSSAGSFSAIFRLVVGGIVKPLQALGQFLGTKRSSSSCGGSGSSSSSLSISGDDDGGEIEQGGVTHHSPTQVLKNFDEIRYLRIELPSGELGIDDGVLLKWRAEFGSTLDNCVILGASSVIPPNPMRVSQACDTTTVVEAPGSGSDDNGSIPESFYTNGGLKLRVVWTISSLIAASARHYLLQPIIAEHKTLDSLVLTDSDGQGVLCMNRDQLEELRVKPLAASSASKRTLVPALNMRLWYAPTLELPDGTVLKGATLVAIRPSESKKEVSDISWVSSAFEEPYETAAKMLVKRRTYCLEMNSF

SEQ ID NO: 16640 - protein, 441 aa, Arabidopsis thaliana
MNRRQQVKRRVGKYEVGRTIGEGTFAKVKFARNSETGEPVALKILDKEKVLKHKMAEQIRREIATMKLIKHPNVVQLYEVMASKTKIFIILEYVTGGELFDKIVNDGRMKEDEARRYFQQLIHAVDYCHSRGVYHRDLKPENLLLDSYGNLKISDFGLSALSQQVRDDGLLHTSCGTPNYVAPEVLNDRGYDGATADMWSCGVVLYVLLAGYLPFDDSNLMNLYKKISSGEFNCPPWLSLGAMKLITRILDPNPMTRVTPQEVFEDEWFKKDYKPPVFEERDDSNMDDIDAVFKDSEEHLVTEKREEQPAAINAFEIISMSRGLNLENLFDPEQEFKRETRITLRGGANEIIEKIEEAAKPLGFDVQKKNYKMRLENVKAGRKGNLNVATEIFQVAPSLHMVQVSKSKGDTLEFHKFYKKLSNSLEQVVWTNNEVKKETAK

SEQ ID NO: 16641 - protein, 1543 aa, Filobasidiella neoformans
MSATGVPAELNNLGAPITATTQNPSGLANSQVTSGPASSATQHDEHRSSAGNTLADEENDKAVESEKAEVIDAAADGKQKRLAADSSENIVTELEPHHVSIHRGKEEFAALERRYSTLSQQSQHELHRPTTRHSVRSSFSRKDRVVSRLTQDDAEKAKEGEGEFNLVDVLRSGRENQDEAGIKRKAVGVIWEDLEVIGAGGMRINIRNFSSAIIEQFMMPAFKILSIFGVNPFAPKPKAILHPSSGLLKPGEMCLVLGRPGAGCTTFLKTITNQRAGFMEIKGNVEYAGVGWKEMRKRYGGEVVYNQEDDDHLPTLTVAQTIRFAPATKTPKKKIPGVSAKQFQDDMLDLLLSMLNIKHTANTIVGNAYVRGVSGGERKRVSIAEMFCSGATVCSWDNSTRGLDASTALDYAKSLRLLTDIMGQTTFVSLYQAGEGIYDQFDKVLVLNEGHVAYFGPAKEARQYMIGLGYRDLPRQTTADYLSGCTDVNERRFADGRDETNVPATPEEMDKAYKESEVCARMTREREEYKQLMAEDATAREDFRQAVLEQKHKGVSKKSPYTVSFLQQVFIIFKRQLRLKFQDHFGISTGYATAIISALIVGSVYFRLPETASGAFTRGGLLFLGLLFNALTSFSELPSQMLGRSVLYRQNEYRFYRPAAFALAAVLADVPYNASVIFLFSIVLYFMGGLYSSGGAFFMFFLFVFLTFMVMSAFFRTLGVATSDYNVAARLASVLISFMVTYTGYMIPVQRMKRWLFWIFYLNPLSYGYEAIFANEFSRINLTCDSSYTIPRNIPEAGITGYPDTLGPNQMCSIFGSTPGDPNVSGSDYMATGYSYYKAHIWRNFGILLGFFAFFMFLQMLFIEVLEQGAKHFSINVYKKEDKDLKAKNERLAERLEAFRAGELEQDLSELKMRPEPFTWEVLNYTVPVPGGHRQLLNDIYGYVKPGSLTALMGASGAGKTTVLDVRASRKNIGVIEGDVLMNGRPIGTGFQRGCGYAEQQDTHEWTTTVREALRYSAYLRQPQHVPKQEKDDYVEDIIELLELQELADAMIGFPGYGLSVEARKRVTIGVELAAKPELLLFLDEPTSGLDGQSAYNIVRFLKKLCAAGQKILCTIHQPNALLFQSFDRLLLLQRGGECVYFGDIGPDSKVLIDYLERNGAKVPHDANPAEFMLEAIGAGSRKRIGSDWGEKWRNSPEFAEVKREIQELKAEALAKPVEEKSNRTEYATSFFFQLKTVLRRTNVALWRNADYQWTRLFAHLAIGLIVTLTFLQLDNSVQSLQYRVFAIFFATVLPALILAQIEPQYIMSRMTFNREASSKMYSSTVFALTQLLSEMPYSLGCAVSFFLLLYYGVGFPYASSRAGYFFLMILVTEVYAVTLGQAVAALSPTILIAALFNPFLLVLFSIFCGVTAPPPTLPYFWRKWMWPLDPFTRLISGLVSTVLQDQEVVCKDGEYQVFPAPSGQTCQQWAGAFAEAIGGYINNPDSTGDCQFCQYRTGQAFFTPLEISFSTRWRDFGIFICYVVFNILVLLIAARFLKWQRR

SEQ ID NO: 16642 - protein, 187 aa, Arabidopsis thaliana
MALEAWFMDDSNEDQRLPHHRNPKELVSLDYLAELGVLYWKLNPENYENDSELSKIREDRGYDYMDLLDLCPEKVSNYEEKLKNFFTEHIHKDEEIRYCLAGSGYFDVRDKDDRWIRIWMQPGDLIVLPAGIYHRFTLDASNYIKLMRLFVGEPVWTPYNRPQEEHPVRKKYIHGLTYKFGETVKAH

SEQ ID NO: 16643 - protein, 459 aa, Arabidopsis thaliana
MAPTQNTICSKHVAVIGAGAAGLVTARELRREGHTVVVFDREKQVGGLWNYSSKADSDPLSLDTTRTIVHTSIYESLRTNLPRECMGFTDFPFVPRIHDISRDSRRYPSHREVLAYLQDFAREFKIEEMVRFETEVVCVEPVNGKWSVRSKNSVGFAAHEIFDAVVVCSGHFTEPNVAHIPGIKSWPGKQIHSHNYRVPGPFNNEVVVVIGNYASGADISRDIAKVAKEVHIASRASESDTYQKLPVPQNNLWVHSEIDFAHQDGSILFKNGKVVYADTIVHCTGYKYYFPFLETNGYININENRVEPLYKHVFLPALAPSLSFIGLPGMAIQFVMFEIQSKWVAAVLSGRVILPSQDKMMEDIIEWYATLDVLGIPKRHTHKLGKISCEYLNWIAEECHCSPVENWRIQEVERGFQRMVSHPEIYRDEWDDDDLMEEAYKDFARKKLISSHPSYFLES

SEQ ID NO: 16644 - protein, 234 aa, Schizosaccharomyces pombe
MDKESYDYLVKIVLAGPSGTGKSCLLQRFVKNQWDDQVSHTVGIDFASRIISVGMGNQQKRIKLQIWDTAGQEKFRSVARNYYRGAAGAVLVYDVTNKDSFEELSSWLSDIRAMAPSTICVVLAGSKSDLQNQRQVSTEEAAEFCSEKHISSAHETSSYTGSNVEECFLSVVSTIITRIELGEIDPQDQSLGIQYGDLSFRRPVHPSSTSNWWTSITNWDDLVRLERQTRSYCC

SEQ ID NO: 16645 - protein, 380 aa, Candida boidinii
MSTVGKTITCKAAVAWKPGEDLSIETIEVAPPKAHEVRIKIEYTGVCHTDAYTLSGADAEGEFPVVFGHEGAGIVESVGEGVTSVKVGDSVICLYTPECRECKFCKSGKTNLCGKIRATQGKGLMPDGTSRFTCKGQPLLHYMGCSTFSQYTVVADISVVAVNPEAPKDRTCLLGCGITTGYRAATNTVKMNEGDNIAVFGVGCIGLSVIQGAVAKKAGKIIAIDINDGKTEWAEKFGATDFVNPTKLAEGETIVSKLIDMTDGGCDFTFDCTGTVQVMRNALEACHKGWGESVIIGVAAAGKEISTRPFQLVTGRVWRGCAFGGVKGRTQMPGIVEDYLSGTLKVDEFITHRHKLDDINKAFHDMHAGDCIRAVITMEE

SEQ ID NO: 16646 - protein, 1473 aa, Schizosaccharomyces pombe
MSVKASINNSQEAVSRIAFRCSDALYVVHPNNSILNGALTESLKDLKKFETLNVSGKVPHVLPLKSHADPFAHIADAILAEEEVASTQPKQITSVVASADALFFATPHLYKLAHEPLVAHVAIESTEAFDFASVRDTGFVILFSGNRPGDSSEAALEDTLETASLAHRLALKLNTGVLHFYSPVYDTTAALENIETLPSKEDAQHARVAHIPIEEKQEDSEKEGNIKEAFVPPKFDQPERDAATSEYLESLSIKPFEYSGSDDATDVLLVFGSAASELAKAAVTSSVAVAIVRVLRPWLPSKLQEVLPTSTKRLTVLEPITSLPRKWDPLYLDVLSSFVASGSSIELFAVRYGLSSSEQATEIIKAVRDNLSGALKPSLVCDFTDGVSQVFVPTPPSIEEAYHKLLHRVFKSRLNIVNDPASSATKQNIPSRLIISPQFALGSVLEYENQRRAFCDEVATLLKEKNSSVSSESLEVLSNWIVSVDNLESPVDPELVISELKKDSSAPIKSLLDRSEFFTNVSHWIIGSDAWAYDLGNSALHQVLCLEKNVNLLIVDTQPYSTREAVRSSSRKKDIGLYAMNFGNAYVASTALYSSYTQLISALLEADKFKGPSVVLAYLPYHSADDDAITVLQETKKAVDIGYWPLYRWTPALEDGEYSDFKLDSERIRRELKTFLERDNYLTQLTLRVPSLARTLTQSFGAEVRHQQNVDSRNALNKLIEGLSGPPLTILFASDGGTAENVAKRLQNRASARGSKCKIMAMDDFPIEELGNEKNVVVLVSTAGQGEFPQNGREFWEAIKGADLNLSELKYGVFGFGDYEYWPRKEDKIYYNRPGKQLDARFVELGAAPLVTLGLGNDQDPDGWETAYNLWEPELWKALGLDNVEIDIDEPKPITNEDIKQASNFLRGTIFEGLADESTGALAESDCQLTKFHGIYMQDDRDIRDERKKQGLEPAYGFMIRARMPAGVCTPEQWIAMDDISTKWGNHTLKITTRQTFQWHGVLKKNLRNTIRNIVKVFLTTLGACGDVARNVTCSSTPNNETIHDQLFAVSKQISNELLPTTSSYHEIWIEDPETVEKRKVAGEAVQDVEPLYGPTYLPRKFKVGVAAPPYNDVDVYTNDVALIAIIENDKVLGFNVGIGGGMGTTHNNKKTYPRLATVVGYVLTDKIMEVVKAILIVQRDNGDRENRKHARLKYTVDTLGVSTFVEKVEEVLGYKFEEARDHPQFIKNHDDFEGWHKTEKNKYWRSIFVENGRIENNGILQFKTGLRELAERLYTEKSEAEFRLTANQHVILFNVAENELGWINEHMAKYKLDNNAFSGLRLSSAACVALPTCGLAMAESERYLPKLITKVEEIVYEAGLQKDSIVMRMTGCPNGCSRPWVAEIACVGKAPNTYNLMLGGGFYGQRLNKLYRSSVQEKEILNLLRPLIKRYALEREDGEHFGDWVIRAGIITAVENGGANGAVHEGVSPEAF

SEQ ID NO: 16647 - protein, 452 aa, Arabidopsis thaliana
MAPSLSPIRSHHVAVIGAGAAGLVAARELRREGHSVVVFERQKQVGGTWIYTDHIEPDPLSVDPTRSVVHSSVYGSLRTNLPRECMGYRDFPFVIRSDVSESRDPRRFPSHGEVLAYLQDFAKEFAIEEMIRFDTAVVKVAPAAEEGSGKWRIESTEKEKKVLRDEIYDAVVVCNGHYIEPRHAEIPGISSWPGKEMHSHNYRIPEPFRDQVVVLIGNSASADDISRDIARVAKEVHVACRSNAADTYIERPGYSNLWMHSMIESVHEDGSVVFQNGKTISVDVIMHCTGYKYHFPFLETNGNVTVDDNRVGPLYKDVFSPAFAPWLSFVGIPWKVVPFPMFELQSKWIAGVLSGRIPLPSKEDMMMEIKTLYSTLDAQGIAKRYTHQMGISQFEYNSWLASQCGCSETEEWRKEMYFATGVKKRAHPETYRDEWDDHHLVSQAYQDFSLYT

SEQ ID NO: 16648 - protein, 378 aa, Arabidopsis thaliana
MAVVDVHRFAESITCHAWSPDLSMVALCPNNTEVHIYKSLSQDHWERLHVLQKHDQIVSGIDWSSKSNKIVTVSHDRNSYVWSLEGAEWVPTLVILRLNRAALCVQWSPKENKFAVGSGAKTVCICYYEQENNWWVSKLIRKRHESSVTSVAWHPNNVLLATTSTDGKCRVFSTFIKGVDTKDSKAGSPAETKFGEQILQLDLSYSWAFGVKWSPSGNTLAYVGHSSMIYFVDDVGPSPLAQSVAFRDLPLRDVLFISEKMVIGVGYDSNPMVFAADDTGIWSFIRYIGEKKAASSGSSYSSQFSEAFGKFYGSQSKSTTANDASDSRGGVHDNSITSIVPLGKGGSPKVMRFSTSGLDGKIAIWDLENMQQELGNQF

SEQ ID NO: 16649 - protein, 421 aa, Schizosaccharomyces pombe
MAFRGIRPSNKVAASRPDVWTLVNQATAECKVPPVSLSQGFFNYNPPKFVLDAAKKSIDEVACNQYSHTRGRPSLRKALSEAYSPYFKRTLNPDTEIVVTAGANEGFFSVFAAFLNPGDEVIVMEPFFDQYISNITMNGGVPVYVPIIPPEEGSVKPVSAGAWKLDMNKLRNAITEKTKMIVINTPHNPLGKIFSEEELNEIADLVLKHNLLVVSDEVYDRLSFVPFVRLATLRPELFKHVVTVGSGGKTFGCTGWRVGWLIGDESLIKYSAAAHTRICFAVNSPCQEALAIAFGEAEKHNYYEEYKSSYKKRFEILAKAFDQLEIPYTIPDGSYYTMANFSKLKLPKDYPFPEEIANRPRDFKLCYWILKEIGVATIPPTEFYTDEDAPVAENYLRFAFCKTFETLEEAARRLQKLKDYF

SEQ ID NO: 16650 - protein, 416 aa, Arabidopsis thaliana
MSSTFRAPAGAATVFTADQKIRLGRLDALRSSHSVFLGRYGRGGVPVPPSASSSSSSPIQAVSTPAKPETATKRSKVEIIKEKSNFIRYPLNEELLTEAPNVNESAVQLIKFHGSYQQYNREERGGRSYSFMLRTKNPSGKVPNQLYLTMDDLADEFGIGTLRLTTRQTFQLHGVLKQNLKTVMSSIIKNMGSTLGACGDLNKNVLAPAAPYVKKDYLFAQETADNIAALLSPQSGFYYDMWVDGEQFMTAEPPEVVKARNDNSHGTNFVDSPEPIYGTQFLPRKFKVAVTVPTDNSVDLLTNDIGVVVVSDENGEPQGFNIYVGGGMGRTHRMESTFARLAEPIGYVPKEDILYAVKAIVVTQREHGRRDDRKYSRMKYLISSWGIEKFRDVVEQYYGKKFEPSRELPEWEFKSY

SEQ ID NO: 16651 - protein, 501 aa, Arabidopsis thaliana
MNGGDDAATSGPPPSLEWRFSQVFGERTAGEEVQEVDIISAIEFDKSGDHLATGDRGGRVVLFERTDTKDHGGSRKDLEQTDYPVRHPEFRYKTEFQSHEPEFDYLKSLEIEEKINKIRWCQPANGALFLLSTNDKTIKYWKVQEKKIKKISEMNIDPSESSNIPPQLVTNGLPADKGHDYLSKDFSFPPGGIPSLRLPVVVTSQETNLVARCRRVYAHAHDYHINSISNSSDGETFISADDLRVNLWNLEISNQSFNIVDVKPTNMEDLTEVITSAEFHPIHCNMLAYSSSKGSIRLIDMRQSALCDSHTKLFEEPEAPGSRSFFTEIIASISDIKFSKDGRYILSRDYMTLKLWDINMDSGPVASYQVHEHLRPRLCDLYENDSIFDKFECCLSGDGLRVATGSYSNLFRVFGASQGSTEAATLEASKNPMRRQIQTPARPSRSIGSMTRVVRRGSESPGTEANGNAYDFTTKLLHMAWHPTENSIACAAANSLYMYYA

SEQ ID NO: 16652 - protein, 201 aa, Brassica rapa subsp. pekinensis
PGTDTAAAVVVWAMTYLIKYPEAMKKAQDEVRNVVGDKGYVSEEDIPNLPYLKAVIKESLRLEPVIPILLHRETIADAKIGGYDIPAKTIIQVNAWAVSRDTAAWGDNPNEFIPERFMNEQKGVDFKGQDFELLPFGSGRRMCPAMHLGVAMVEIPFANLLYRFDWSLPKGIKPEDIKMDVMTGLAMHKKDHLVLAPRTHI

SEQ ID NO: 16653 - protein, 500 aa, Lycopersicon esculentum
MAIGSLARRKASTILSSRYLKYSFSLSRGFASGSDENDVVVIGGGPGGYVAAIKAAQLGLKTTCIEKRGTLGGTCLNVGCIPSKALLHSSHMYHEAQHSFASHGVKFSSVEVDLPAMMAQKDKAVAGLTRGIEGLFKKNKVNYVKGYGKFLSPSEVSVDTVEGGNTIVKGKNIIIATGSDVKSLPGLTIDEKRIVSSTGALALTEIPKKLVVIGAGYIGLEMGSVWGRLGSEVTVVEFASDIVPTMDGEVRKQFQRSLEKQKMKFMLKTKVVSVDTVGDSVKLTLEPAAGGEQTTLEADVVLVSAGRVPFTSGLGLDKIGVETDKAGRILVNERFASNVPGVYAIGDVIPGPMLAHKAEEDGVACVEFIAGKEGHVDYDLVPGVCYTHPEVASVGKTEEQVKALGVDYRVGKFPFLANSRAKAIDDAEGIVKVIAEKGTDKILGVHIMSSNAGELIHEAVLALNYGASSEDIARTCHAHPTMSEALKEAAMATYDKPIHM

SEQ ID NO: 16654 - protein, 228 aa, Gossypium marchantii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHBKPVQEVLAEMTNGGVDRSVE

SEQ ID NO: 16655 - protein, 425 aa, Rhodococcus rhodochrous
MDIMSEVDVAPRVAVVGAGPSGCFTAQQLRKQWPEVEVTVFDRLPTPFGLLRYGVAPDHQGTKNVIRQLSRVFDDRTRFVGNIELGRNLSIEDLRAAFDVVVLATGLSGDRRLGIPGDDLPGIVGSGRFTRCVNDHPAAGDLPTVGRRVVLVGGGNVAMDIIRLLSKQPDEFTGSDLHPDTLGRLRSEGPRRIDVVVRSTPTDAKFDPVMMRELAHLASTEFRLADAGVLATAESSDPRSAALAHVVERESPAAPATTVVFHFGSTPVEVIGTDRAEAVKVRTGVHTTTLACDTVITAIGFESAVNDDLDLTLYRDADPGEDFLAPGLYRTGWLHSSTGALPEMRARARALAARIRRDHAGHHPARPGLVAIPYEVIDRTVDFDGWMRIDEAEVASASPGRIRQKVREVDAMLALARTVPAESVC

SEQ ID NO: 16656 - protein, 222 aa, Bifidobacterium longum DJO10A
MSNIAIAPSILSADFCNLERDLKAIANADLVHVDVMDHHFVPNLTLGEPIVGRICQVTDLPVDVHLMIEDPDRWAPEYAKLGAASISFHMGATHAPVRLARQLREMGCKACFAVRPAEPVEPIFDILDEFDMVLIMTVEPGFGGQKFLDNQMAKVRRLRDEITRRGLKTRIQVDGGVSPKTAHIVAEAGADVLVAGSAVYGAENPAQAIDDIRAKAEAAFKA

SEQ ID NO: 16657 - protein, 381 aa, Bifidobacterium longum DJO10A
MADYYETLGVERGASDDEIKKAYRKLSRKYHPDIAGPEFEDKFKEVNNAYDVLSNPDKRRMYDSGVDPNNPNAGAGGFSGAGFGDMSDVFSTFFGSAFGGGSQGPVPRTQPGRDALASASIDLKTAVFGGTAHVKINTFSLCQECGGSGAQGGAQPVTCPDCHGQGFMQKVVRTMLGQMMTSAPCERCEGHGTIIQNPCPSCMGHGRVRTTRTVGVTVPAGINDNARLRLANQGEVGEGGGAAGDLYIDIRIKADKQFTRDGDDLHCWIQVPMSWAVLGHDLSIDTFDGEKTVSIPAGCQPEDTVTLKGLGVTNIRNKDERGNLIAHVNVLIPTKLNETERGLIEQFAASHDSGATHVSQASRPQAGQKKGFFSKLKDALS

SEQ ID NO: 16658 - protein, 478 aa, Bifidobacterium longum DJO10A
MTELKSKEDVEALINKEGIEYVSVRFTDLIGVQQHFTVPASEFLKDAFTDGMPFDGSSVQGFQAINESDMKLVPDVETSFVDPFRKHKTLDVAFSIVDPLTDEPYSRDPRQVAGKAEAYLKSTGIADTASFAPEAEFFIFDKVRFENSMQRSFYEVDSIEAPWNSGVDVEEDGTPNIGFKNRVKKGYFPVPPIDHTQDLRDDMVANLQKVGLILERSHHEVAGAGQQEINYRFNTLQHAGDDLMKYKYVVHETAALAGKAATFMPKPIADDNGTGMHCHQSLWKDGKPLFYDEKGYAGLSDLARWYIGGLIKHSSSVLAFTNPSLNSYHRLVPGFEAPVNLVYSARNRSAAIRIPLAGTSPAAKRIEFRAPDPSCNPFLAFSAQLMAGLDGILNHIEPPEPVDKDLYELPPEEHAGIKQVPSSLAEAMDALEEDHDFLTAGDVFTDDLIETWIGLKRDEIDQARLAPTPLEYELYFHI

SEQ ID NO: 16659 - protein, 251 aa, Bifidobacterium longum DJO10A
MIKVSVVGAKGRMGSHVVEAVNNAEDTQLALALDAGDDLTQITTDNTDVVIEFTVPSVSLNNVLTLIGQGVDVVVGTTGWTDEKLAQIKSAIANGPKPETQKVFIAPNFAISAVLADYFATKAAKYFESAEVIELHHPTKVDAPSGTAIHTAHGIAEARKAAGLAPVPDATETDGGSRGQVVDGIHVHAVRLRGLNAHEEVLFGNAGEQLTIRADSFDRTSFMPGVLLAVRKLAGDAPAGLTIGLDRFLDL

SEQ ID NO: 16660 - protein, 449 aa, Bifidobacterium longum DJO10A
MSTTTSAQPAQLTRNERLDRLPFNKAHRKLLVASGIGWAFDAMDVGLVSFVVAAIAADPHFNLTPTEKSWVLSIGFVGMAIGAAVGGFIADRVGRKTVFTATLIIFGIANGAMALSWSLGMLLGARLIIGLGLGAELPVASTLVSEFSPTKQRGRMTVLLESFWAVGWIVAAMIGYFVIPNTGDWGWRWALAIGALPLLYAIVTRVHIPESVRFLEAKGREDEAEKAVRYFEEAGGVAPVTSPKGKPLPKIKTRELFGSKYLARTIAIWATWFFVNFSYYGAFTWMPSLLADQFGSLTKSFGYTLAISIAQLPGYFLAAWLVEVWGRRKTLSIFLAVSAVAAFAFSQAGSVALVLVFGMLLSASNLGAWGVLYAVTPEIYPTRLRGAAAGAAAAVGRIAAIIAPLLMPWFLTLSGGNKAVAFIIFAAAFIIACVAALCLPERKGLDLED

SEQ ID NO: 16661 - protein, 298 aa, Bifidobacterium longum DJO10A
MTTPIVLSLGELLWDMLPSGKRAGGAPVNFAYHAMKNGTEGWAISAVGEDELGDELIAKANEAGINTVIQRNAWPTSTVEVALKNGIPEYTIVKGVAWDHILYTRQLIDVVSKADAVCFGTLALRSPESHATITELLKHTKPGAMKFFDINLRGDHYSKELIEELLKAATVFKINDEELLLLRDMFDIRGTSGEDASRWFIEEFGLDYVILTAGSAYSTIISRKGEVSTLDTPHVEVNDTVGAGDSFSGTFTARILLGDTLAEAHRKAVNTAAYVCTQAGAWPQYPAEMPDYLAEIGK

SEQ ID NO: 16662 - protein, 399 aa, Bifidobacterium longum DJO10A
MPKALLLENIHPDAAKSLRDRGFEVETMKGALSEDELIDALDGVDLVGVRSKTNVTARVLDARPTLSAIGCFCIGTNQVDLAHAGKRGIAVFNAPYSNTRSVVELVICDIICLMRRIPAHTHHIKHGLWDKSASGSHEVRGKTLGIIGYGNIGSQLSVLAEALGMRVVFYDIEEKLALGNAHRCDTLNELLEQSDAVTLHVDGRKSNTGFFGEDQFAHMKQDAIFINLSRGFVADLGALKQHLDSGHLSGAAVDVFPVEPKKSGDPFETSLANEDNMILTPHIGGSTLEAQESIGHFVSQRLEDYWFKGSTSLSVNLPQINLGECKGVCRIAHLHDNLPGVLAHVNHVLGEENINVSFQSLATEGELGYVVTDVAQKPSAATLEALRNIEGTIRMRVIS

SEQ ID NO: 16663 - protein, 261 aa, Bifidobacterium longum DJO10A
MSEMTNITTEASDSPVSNKTVLRLDDVRKSFGNTQVLRGISFDIHQHEVVALLGPSGSGKSTLMKCVNLLEQVDDGQIWLGNTDITDPRADQDKIRARIGVVFQQFNLFPHMSVLRNVTLAAIKVHHWSKDRAETRAMELLERIGMRDKASAYPDQLSGGQQQRVAIARVLMTDPELLLLDEITSALDPMLVGEVLNMVAELKAQGTTILMATHEMSFAHEAADRIVLLRHGVIAENGTPAEVMDESQDPETIEFFSHFRH

SEQ ID NO: 16664 - protein, 486 aa, Bifidobacterium longum DJO10A
MDLFRKKSVDQLVAESTPLKRTMRTFDLTMLGIGAIIGTGIFVLTGKGALTAGPALSVSFLLAAVCCGFAGLCYAEFAAMAPVSGSAYSYAYLAFGELIAFVIGWDLILEYALQAATVSAGWSGYFNKLLEGFGLHLPVELTAAYGTNPDVTTYFNLPGFVIVLIITWVLSIGINQTKRTNDVMVLIKLAIIVLFIVCAVWYVKPSNWQPFSPYGVYTFQPGSTQPYGIVPAASIVFFSFIGFDAVSSSAEETINPNKTLPRGILLSLAVSTVLYVIMTLIMTGVVPYKEFAKYIDAPVAGVILETGMNWLAVIVNLGALIGMTTVMLVQLYGQSRICYAMSRDGLFPKFFGHVHEKYRTPFKGTWFFGLLTAFAGGFININVLFELVNIGTLSAFIIVSAGILWMRKTQPNAPRGFRAPGVPVTPILAIVFCFVLIAGLNWETWVRFAVWFGLGLIVYFGYSRKRSKLGLEQKAGADAKVAATED

SEQ ID NO: 16665 - protein, 355 aa, Bifidobacterium longum DJO10A
MTIHNSLAELIGNTPLVKLNHIPQAAGVKATIAVKVEYFNPGGSSKDRIAERIIDAAEQSGQLKPGGVIVEPTSGNTGVGLALVAQQRGYRTIFTLPDKVSESKRAVLRAYGAEVIVTPTDAGPDDPRSYYQVAERLANTIPGGFRPNQYDNPNGPLSHYYTTGPEIWEATDHKVTHFVAGIGTGGTISGTGKYLKEASNGAVKVIGSDPEGSIYSASSRDEVHQYDIEGVGEDFYPKAFDRNITDDIVRVSDAEAFEMTRRLAGEEALLVGGSSGMAVASAIKYALANDLDENQIVVVLAPDSGRSYLEKIFNDDWMRANGYGDIVERTSKPSLAEQYLNGAPSDEGAGDGLHN

SEQ ID NO: 16666 - protein, 238 aa, Bifidobacterium longum DJO10A
  misc_feature (221)..(237): Xaa can be any naturally occurring amino acid
MAINPPVDATQTPEWAALQKHYDELQVEGVSLKKWFAEDAERVEKLSFDAGDLHFDLSKNLIKPETLQLFANLAKAVKLDERTKAMYTGVHINNTEDRAVLHTALRRPVEDEGKYIVDGQDTVKDVRETLDKIYAFADDVRSGKWTGVTGRKIETVVNIGIGGSDLGPVMVYEALKPYADAGISARYISNIDPNDLAEKTKGLDPETTLFIIVSKTFTTLXXXXXXXXXXXXXXXXXP

SEQ ID NO: 16667 - protein, 265 aa, Bifidobacterium longum DJO10A
MIFGPARFEEFLHGFHEIDEYFANTPFEKNVVVLLGMLNVWYRNFFKVASHAVLPYDQYLHRFPAYLQQLTMESNGKSVRWDGTPVTSETGEIFWGEPGTNGQHAFYQLIHQGTQLIPADFIAFVNTPNPTKDGDQDVHELFLGNYFAQTKALAFGKTADEVRAEGTPEEIVPARVFSGNRPTTSIFGVALTPFALGELIALYEHITFVEGTVWGLDSYDQWGVELGKQLAKQITPAISQDDDALAAQDASTQSLIKFYRANREF

SEQ ID NO: 16668 - protein, 441 aa, Bifidobacterium longum DJO10A
MGHDLSQDAEIWDDAYKLDRAHVFHSWHAQRNLDPTEVVTGHGVWLKYGDGREMLDFTSQQVNVNIGYQHPKVIEGIKKQAELLCTVGPDYANLARGRAASLVARRAPEGFDKVFFTNAGADANENAMRAARLFTGRDKILSSYRCYHGNTGAAISATGDWRRKPNDYSRGHVHFFTPYLYRSEFSATTQEEECERALAHLEHVIQFEGPDTIAAVLLESVPGTAGIIIPPKDYFKGVREITKKYSILMITDEVMAGFGRTGFWFALDDYDYTPDIISFAKGCNSGYVPAGGVIMSDPVAHRFDDIVFPGGLTYSGHPLAMGAIVATQEAMEEEHIVDNAYTIGKDVLGPQLTALYDKHPKIGEVRGKGVFWAVEMVADRTTKEPLDDATMKQIVAEGDKRGLILGVHNNRIHVTPPCVISADEATQGVEILDQVLTAAGC

SEQ ID NO: 16669 - protein, 263 aa, Bifidobacterium longum DJO10A
MTEPETTCKGFEVNHLVKQYANADKPVLDDISFKVEHGSVLVVLGPSGSGKSTLLRTIAGLEPIQGGTISINDQVIDAGKPGTERAGRSDRSSELRTRIGMVFQSYDLFPNKTVLGNITMAPVLVQKRDKSEVEAEAIRLLGRVGLADRKDSWPHELSGGQRQRVAICRALILHPEVLLLDEITAALDPEMVREVLDVVLELAKSGQTMLIVTHEMQFARAIADHIILLDGGRIVEESYDAQAFFEHPQTERAQQFLHTFEFE

SEQ ID NO: 16670 - protein, 491 aa, Bifidobacterium longum DJO10A
MSTTDAPKKPRETDDVPVPATLRKSLKNRHIQLIALGGAIGTGLFYGSSESIALAGPSILLAYLVGGFAIFMIVRALSEMSVEDPKAGAFSYYATRYWSKRAGFISGWNYWFNYILVSMVELSVVGSFVNYWFPAIPTWVSAAVFLVIICAANLLGVSKFGEFEFWFAIIKIVAVIAMIIGGLAVIIFVLPTASGVRASFANWFTVGNGFFPNGLMGQNSDGSWTGLLMALVVVMFSFGGTELIGITAGETEDPKTTIPRATNDIIWRILVFYIGALGVIMAVVPWNTIDGKSSPFVQIFDSVGIHAAAGILNFVCLTAVMSVYNSGLYANSRMLYSLAKQGNAPAYLGKLNSRGVPVAGVLTSAAITAIAVVVVFVWPEFAFNYLMSIATIAGIINWTMIMLTEMKFRKVVAAGGAPEDSELAGLSGQEALDAIHFKLPFAKVTPWVVLAFLALVVVLMCFSTSYRIAVIAGVIWLAILFAAYQLTQAKK

SEQ ID NO: 16671 - protein, 341 aa, Bifidobacterium longum DJO10A
MAENEWLSKDFYKVLGVSKDASDDDIKKAYRKLARKYHPDVNKTKEAEEKFKDISEAYDVLSKKEDRQKYDAIRQFGMGGARFAGGSGTGGFDASGFSDIFGSMFGQGAGGNGSRIRFSTSGGGPNNINDIFSMFGGAAGQGGQPYGGYGQSPYGNAGGYGYEEAPRPENGEDRNSKISLTLRQAVKGATVSLSVDGKKFKAHVPAGVKDGQKIKLAGKGKPGINGGKAGDLYLHVTVKPDATFSMRGHDIVMDLPVTVGQAVAGGKVEAKDIDGNPVTFKVPAGSSSGAEVKLTGLGVQRSNQPGDLIGRVQIMVPAKPGLAVKHAAKEFDEKAGDYLSL

SEQ ID NO: 16672 - protein, 483 aa, Bifidobacterium longum DJO10A
MTESVNTELRIAVIGAGPAGVYSSDIFLRQLKKLGEELGLGTEARIDLFEKLPVPFGLVRYGVAPDHPSIKFIASALEKTLDNPNIHLYCDVEFGKDVTLDDLLARYDAVLFATGAVKDKPLNLPGADLEGVYGAAKFVEWYDGYPTGAREWPLTAENVAVIGGGNVAMDVARELMRNADDLKAKTDIPDNVYEGIGQNKAKVLHLFIRRGVAQAKFSVQELREMEKLPGVQLIINEDDFDLDDETIEVAGKDKLTRQMVEELFAIREMAEDMEDDGDVDFEGNPADRKYYVHFNSAPTEILGEDGKVKAIRVERTETGADGKMHRTGEFTDYPVEAVYHAIGYKPAEAPGITYDEHGAHLANANGDGRITTEADGGEVRDRLYATGWAKRGPVGLIGSTKSDALAIVTNMLEDLAKAAEGGRVAADRAPESIDRLLAERGIRPIDFAGWKKVDAFERAEGAKEGREHKKVIEPDQMRELALA

SEQ ID NO: 16673 - protein, 328 aa, Bifidobacterium longum DJO10A
MGIENTHKLIVNCLPLNEGERRAFAKAARDVPQEFVGDEAHRGDMVWSAAVPEELRSRATAVIGNFPVSQASQYTRLEWLQTFSAGVDAYICPGVLPRGTMVTNASGAYGQSVSEHMFATMWALMKNLNRYASNQRDHQWQDEGPVLSPEGGIALIIGVGDIGSHFAQLAQSVGMRTFGVRRHADVPAKGIEKMYGFERLETLLPLADVVAMAVPRSPQTHHLLNADRLGRLKSTAIVINAGRGDAIDPEALADALHNGRLHGAGLDVTEPEPLPAESPLWDEPHCLITPHVAGGNHLEKTSEHIIRIALTNVSRYAKQQELLNLVRY

SEQ ID NO: 16674 - protein, 246 aa, Bifidobacterium longum DJO10A
MTYKLVLLRHGQSAWNKTNQFTGWVDVPLTEQGEAEAKRGGELLKEKNVLPDIVFTSLLRRAINTANIALDAADRLWIPVQRDWRLNERHYGALQGKNKTEIREEYGDEKFMLWRRSYATPPPEIDPNDQYAQNNDPRYAGDPVPEAECLANVVERVKPYFESAIEPELKAGKTVLIAAHGNSLRAIVKMLDNLSEEEIAKVNIPTAIPLLYELDENFKPIKPRGEYLDPEAAAAGAAAVAAQGQK

SEQ ID NO: 16675 - protein, 279 aa, Bifidobacterium longum DJO10A
MAAGVGFLGDAWQRASALMEAGVDVLVVDTANGEARLALDMISRLKHDSAFDGVQIIGGNVGTRSGAQAMIEAGADAVKVGIGPGSICTTRIVAGVGVPQLTAVYEAAQACRAAGVPCIADGGIHYSGDIAKALVAGASSVMLGGTLAGCEEAPGEKVLLHGKQYKLYRGMGSLGAMAPRGKKSYSKDRYFQADVTSSDKVVPEGVEGEVPYRGPLNAVLYQMLGGLHQSMFYIGAHNIAEMPERGKFIRITDAGLRESHPHDIVMTTEAPNYSGFHNN

SEQ ID NO: 16676 - protein, 173 aa, Xenorhabdus nematophila
MDYFTLFGLPARYALDRELLATRYQELQRQFHPDRFANQPEREKTLALQQATTINTGYQTLKHPLKRAEYMLSQQGFDLSNEQHTMQDTAFLMQQLELREELDAIEHSSDTEAVLSGFSSRLNKMIKTRREQMEQQLDAAEWLIAADTVRKLRFLDKLQQQVEQLEERLLGDF

SEQ ID NO: 16677 - protein, 170 aa, Musa acuminata
CGPGHGISIGSLGMHNSEACVSNVSVKNAVIRNSDNGVRIKTWQGGMGSVSDISFDTVYMENVRNPIIIDQYYCLSESCLNQTSAVYVSDVSYTGIRGTYDVRDVRPSTWHAATLFPLHPTSLYPEVGAASCPRRLSSPIHFCWNAYGATETLTIPSGVVLVGGLTSIDY

SEQ ID NO: 16678 - protein, 308 aa, Brucella suis 1330
MILCCGEALIDMLPRETTGGETAFQPFAGGSVFNTAIALGRLGVPTGFFSGISSDFFGDVLRDTLARSNVDYSFAAISNRPTTLAFVRLVDGQARYAFYDENTAGRMLSRNDMPYVDETISAMLFGCISLISEPCGSVYETLLAREAPNRVMFLDPNIRANLITVRETHLTRMKRMIALADIVKLSDEDLDWFGEKGSHDEIAAEWLKLGPKLVVITKGAHGAVVYTNHATVPVPGVKVDVVDTVGAGDTVNAGILASLHSQGLLTKDALANLSEDQIHSAVALGVRAAAVTVSRAGANPPWAHEMRD

SEQ ID NO: 16679 - protein, 456 aa, Brucella suis 1330
MTAQPNSLEARDIRYHLHSYTDAVRLEAEGPLVIERGDGIYVEDIAGKRYIEAMSGLWSVGVGFSEQRLAEAAARQMKKLPFYHTFSYRSHGPVIDLAEKLVAMAPVPMNKAYFTNSGSEANDTVVKLIWYRSNALGEPERKKIISRKRGYHGVTIASASLTGLPNNHRSFDLPIDRILHTGCPHHYHDALPGESEEQFATRLANELEQLILAEGPHTIAAFIGEPVMGAGGVVVPPKTYWEKVQAVLGRYNILLVADEVICGFGRTGNLFGCQTFDIKPDILVMSKQLSSSYLPISAFLINERVYAPIAEESHKIGTLGTGFTASGHPVAAAVALENLAIIEERDLVANARERGARMQKRLRELQDHPLVGEVRGVGLIAGVELVIDKEAKTGLEQPGALGARANAALQERGVISRAMGDTLAFCPPLIINDQQVDTMVSALEAALNDVQASLGK

SEQ ID NO: 16680 - protein, 505 aa, Brucella suis 1330
MNKVEFSRTVKPAFAKRYGNFIGGKWVEPRSGRYFENTSPVNGQVLCEVARSDAADVEAALDAAHAARELWGRTSVAERALILNRIADRIEENLPALAAAETWDNGKPIRETTNADLPLAVDHFRYFAGVIRAQEGGISEIDHDTVAYHFHEPLGVVGQIIPWNFPLLMATWKLAPALAAGNCVVLKPAEQTPASILVLMELIADILPPGVVNIVNGFGLEAGKPLASSPRIAKIAFTGETTTGRLIMQYASQNLIPVTLELGGKSPNIFFKDVAAEDDDFLDKAIEGFVMFALNQGEVCTCPSRALIQESIYDRFMKKALKRVEAIVQGDPLDPATMIGAQASSEQLEKILSYLDIGRQEGAEVLAGGERNMLPGDLAGGYYVKPTVFKGHNKMRIFQEEIFGPVVSVATFKDDAEALSIANDTLYGLGAGIWTRDGTRAYRFGRAIKAGRVWTNCYHAYPAHAAFGGYKQSGIGRENYLKMLDHYQNTKNMLVSYSPKKLGFF

SEQ ID NO: 16681 - protein, 477 aa, Brucella suis 1330
MTFHQNLIAGEWVGGDDIANINPSDTNDVVGTYARATAEDTKAAIAAAKAAFPAWSRSGILERHAILRKTADEILARKEELGRLLSREEGKTLVEGIGETIRASQIFDFFAGECLRLAGEVLPSARPGIGVEVTREPVGVVGIITPWNFPIAIPAWKIAPALCYGNTIVFKPAELVPGCSWAIADILHRAGLPKGVLNLVMGKGSVVGQTILDSADVNAVTFTGSTGTGKRVAAASIEHNRRFQLEMGGKNPVVVLDDADLNVAVESVVNSAFFSTGQRCTASSRIIVTEGIHDKFVAAAIEKLKTVVVDNALKPGTHIGPVVDETQLQQDMDYIELGRKEGAKLAFGGERLNRETPGFYLQPALFTEATNQMRISREEIFGPVASVIRVKDYEEALATANDTSFGLSSGICTTSLKYATHFKRNSEAGMVMVNLPTAGVDFHVPFGGRKGSSFGPREQGRYAAEFYTTVKTAYTLA

SEQ ID NO: 16682 - protein, 363 aa, Brucella suis 1330
MAQLSIKNLVKRYGSIEVVHGINLEIADKEFVALVGPSGCGKSTTLRMIAGLESISGGTLEIGGKVVNDLPPRDRNISMVFQSYALYPHMSVRENMGFSLKIAKQPQAEIDRRVNEAAAVLGLEALMDRRPAQLSGGQRQRVAMGRAIVRNPEVFLFDEPLSNLDAKLRTQMRTEIKKLHAKVQSTVVYVTHDQVEAMTLADRIVIMRDGHIEQAGTPDEVFKRPATQFVAGFIGSPPMNMAEATVKGDELLFANGDRLPLPARFKARVGEGAKVTFGLRPDDIFPKGHGLSTGDGVHEKELRVVITEPLGNETLVFAEFAGREWVARMLNPRPVQPGESIAMQFDLAQAHLFDAATGKSLAV

SEQ ID NO: 16683 - protein, 501 aa, Brucella suis 1330
MRSMKHTGSAGSSSIDAGSPDIRGARLPAGDYAHVFDDLHPPLSPHEAIVESDRCYFCYDAPCMNACPTGIDIPLFIRQINAGNPAGAARTILAENILGGMCARVCPTETLCEEVCVREVAEGKPVKIGHLQRYATDMLMATGNHPFTRAAETGRHIAVVGAGPAGISAAHRLAMHGHQVTIFEARPKGGGLNEYGIAAYKTVNNFAQRELDFVLQIGGIHIEYNQTLGQDITVEALKAGYDAVFLAMGLPGVNDLGLAGEDAPNVLDAVDYIANLRQARNLSTLPVGRDIVVIGGGMTAIDVAIQTKKLGANNVTIVYRRGQESMNASAYEQELAQIHGVVIRHWLQPHALERSEDGIVHAITFEYTANRDGKLVGTGEYLTLEADQVFKAIGQTFDPEPLRGSGIALAKGRISVDAEGRTSVEGIWAGGDCVAGGKDLTVASVEDGKVAALSIHAALTSRPEAVEGFAEAVLSGAAHYAPAAPSRHATVQPGSEQGLGD

SEQ ID NO: 16684 - protein, 471 aa, Brucella suis 1330
MDGTFDAGFREPTISKANRWGREMVVALKLGWPLIFTNLSQAALTATDVIFIGRLGADTLASALLATSFYHTLMIFSMGLVSAVMPMIAIALGKNRHSVRDVRRTVRQGFWSAIMIVIPLWVVLWHCEEIFLFLGQRPDIAARSTDFMHTLQWALLPYLFYIVLRSFFAAMEKPMWTLLVAALAIGFNALAGWTLIFGHFGFAPMGLHGAGMATTASSTMMFLGLAFITLRHPRFRRYHLFGRFWRPDWPRLIELWRIGLPMALTFVFETSIFYAAVVMMGRIGPTAMAAHAVAIQIASLSFMVPLGFGQVATVRVGRAYGRGDPKAIAYAGWSAYALGVGFMALMGILMVLMPRVFIGIFLNLNDPQNLPVMELAVTFLALAALFQIVDGAQAVAAGMLRGLRDTRIPMLLALFGYWGVGLPLGAVLAFQFGMGGVGIWLGLAAGLGMVAVLMTIRWRRHLAHVSAVAAA

SEQ ID NO: 16685 - protein, 481 aa, Brucella suis 1330
MPAIGFIIDGKESGGASGKTFERKDPITGKVATVAAAASLADVDTVAEAAAKAFESWSETGPNARRALLNKAADLMDSRTAEFTRLMLEETGATAPWAGFNVHLGANILREAAALTTQITGEIIPSDKPGIMSMAVRQPVGVVLGMAPWNAPVILGVRAVAAALACGNTVILRSSETCPGVHHLIIKILNDAGFPAGVANVISNAPDDAPEIVAALIAHPAIRRINFTGSTQVGRIIARRAAGHLKPVLLELGGKAPFIVLEDADLDQAVDAAAFGAFMNQGQICMSTERFIVHEKVADAFAEKLAAKARSLPAGDPRGNVVLGSLVDLKSAQRMDALIADAVAKGGRVLAGGKRDGAVVEATIIDGVTPQMDIYTQESFGPVKPIIRVKSAEEAIRVANDTEYGLSSAIFSQNVKRALALSRKLETGICHINGPTVADEAQVPFGGVKSSDYGRFGGKAAINEFTELRWITIEGPQHYPF

SEQ ID NO: 16686 - protein, 467 aa, Brucella suis 1330
MAKTRVQFICQNCGAVHSRWAGKCDSCGEWNTLIEEGTNSGIGSGPGAMLSKRKGRTVALTSLSGEIEDAPRIISGISELDRVTGGGFVRGSALLIGGDPGIGKSTLLTQAAAALSNRGHRIVYVSGEEAVAQIRLRAQRLGVAASAVELAAETNVEDIIATISSDNSGSKRPDLVIIDSIQTLWTDMADSAPGTVTQVRSSAQAMIRYAKQTGAAVVLVGHVTKDGQIAGPRVVEHMVDGVLYFEGEGGHHYRILRTVKNRFGPTDEIGVFEMSDGGLREVSNPSELFLGERNEKSPGAAVFAGMEGTRPVLVEIQALVAPSSLGTPRRAVVGWDGGRLAMILAVLESHCGVRFGQHDVYLNVAGGYRISEPAADIAVAAALVSSMAGIALPPDCVYFGEISLSGAVRAVSHAVQRLKEAEKLGFRQAEVPNGSGELWKDRNFRLMETAALADLVARIAASGAGKK

SEQ ID NO: 16687 - protein, 487 aa, Brucella suis 1330
MKAQPKASHFIGGAFVEDKAGKPLPVIYPATDEEIASLYSATPGIIEAAYAAALKAQGEWAALKPVERGRILRRTAEILREKNRKLSKLETLDTGKALQETLVADAASAADALEFFGGIISGFNGEFVELGGSFAYTRREALGICVGIGAWNYPIQIAAWKSAPALAMGNAFIFKPSENTPLSALALAEAYKEAGLPDGLFNVVQGYGDVGAALVNHRLTAKVSLTGSVPTGRRIMAQAGEQLKHVTMELGGKSPLIVFDDADLESAIGGAMLGNFYSTGQVCSNGTRVFVHKNIRERFIERLVERTRKIRIGDPFDEATQMGPLISAAQRDKVLSYIKKGKAEGATLACGGGVPKLQGFDKGFFIEPTVFADVTDTMTIAREEIFGPVMSVLEFSDEDEVIARANDSEFGLAAGVFTADLSRGHHVIGQIKAGTCWINAYNLTPVEVPFGGYKQSGIGRENGIAALAHYSQIKTVYVEMGKVDSPY

SEQ ID NO: 16688 - protein, 389 aa, Brucella suis 1330
MAKQQLKTEKLGINTRLAHDGYCPGDYHGFVNPPVVRASTVLFPDAETMASNGQKYTYGTRGTPTSEALCKAIDALEGSAGTVCVPSGLAAITVPLLGFLSPGDHALLVDSIYYPTRHFANTILKRMGVDVEYYDPEIGADIAKLMRPNTKVVFTESPASNTFEIQDIPAIAEAAHKGNAIVMMDNTWATPLYFRALDFGVDISIHAATKYPSGHSDILFGTISTNEKCWPQLLETHGTMGLCAGPDDTYQILRGLRTMGIRLEHHRKSALEIARWLENHPMVERVLHPALESHPGHEIWKRDFSGSSGIFSFVLAKGGHAQASAFLNALEIFGLGYSWGGYQSLALEVKLGDRTVSKNDYAGPVIRLQIGLEDVLDLIADLERGFAAI

SEQ ID NO: 16689 - protein, 249 aa, Brucella suis 1330
MQVSKTEVAIEITNMHKWYGEFHVLRDINLKVMRGERIVVAGPSGSGKSTMIRCINRLEEHQKGKIVVDGIELTNDLKKIDEVRREVGMVFQHFNLFPHLTILENCTLAPIWVRKMPKKQAEEIAMHYLERVKIPEQANKYPGQLSGGQQQRVAIARALCMNPKVMLFDEPTSALDPEMVKEVLDTMVSLAAEGMTMICVTHEMGFARQVANRVIFMDQGQIVEQNSPDEFFDNPLHERTRLFLSQILH

SEQ ID NO: 16690 - protein, 316 aa, Brucella suis 1330
MPSKTIDHAITARSLTSAATDPTHAGVLSFMRRTYSKSLKGAEAVVWGIPFDAAVSNRPGARFGPQAIRRASAIFDNDPQYPFERDLFENLAVIDYGDCLLDYGNHTKTPSTIEREAAKILKSDAFLLTLGGDHFITWPLLKAHAAKYGPLALVQFDAHQDTWFNDGRRIDHGSFVARAVRDGIIDPDLSIQIGIRTHAPEDCGIRIIYGHEVEDMPAAAIADAILKRTNGRKAYLTFDIDCLDPAFAPGTGTPVAGGPSSAKMLSVLRKLTALDFVGADVVEVAPAYDHADITAIAGATIAMYYLGLLGERKERR

SEQ ID NO: 16691 - protein, 427 aa, Brucella suis 1330
MSKRSPGIETLAVHAGVKPDPATGARATPIYQTTSFVFEDADHAAALFGLQAFGNIYTRITNPTTAVLEERIAALEGGTAAVATASGHAAQFLAFHTLLQPGDNFIAARQLYGGSINQFGQSFKSFDWQVRWADATNPADFAKQIDERTRAIFIESFANPGGIVVDIEAIAEIAHRNGLPLIVDNTLASPYLVRPIEHGADIVVHSLTKFIGGHGNSMGGILVDGGTFDWAKSGNYPLLTEPRPDYAGLELHKTFGNISFAIAARVLGLRDFGPAISPFNAFQILTGVETLALRMQRHSDNALKVATWLHGHEKVSWVNYAGLPHDKYHALQQKYAPKGAGSVFTFGIKGGYEAGVKFVDSLELFSLLANLGDTRSLVIHPASTTHRQLSDEQKVAAGAGPDVVRLSIGIEDADDIIADLEQALAKA

SEQ ID NO: 16692 - protein, 225 aa, Brucella suis 1330
MRPIAIAPSILSADFARLGEEVDAVLEAGADWVHIDVMDGHFVPNITFGPQVVKAIRPRTKAFFDAHLMIAPCDPYLEPFAEAGCDLITVHAEAGPHTHRSLQSIRALGKKAGLALNPATPAEALTNVLDDLDLILVMTVNPGFGGQKFIAPMLDKIRRVREMVGDRPIDIEVDGGITPETAGSVVAAGANILVAGSAVYKGNSVESYRANIDAIRAAAEAARNR

SEQ ID NO: 16693 - protein, 277 aa, Brucella suis 1330
MNQNETHCLALLREADRDRYLSVLYAPQEKRGALAALYAFNAEIARIRDLVHEPLPGEVRLQWWRDLINGEARGSAEAHPVAAALIETIEKYELPRIAFDNYCEARVFDLYDDPMPSRNDLEGYCGETASALIQLAGFILDRDAAQAHAETAGHAGVAQAVAGLLRLLPIHRRRGQVYVPADMLKAIGVTRDMLLSSEDKSATERAVTIMLALAREHLAIFDKAKAGLPQTLHPAFLPMALVPAYLNAVERLGAQAAQKVADISAIRKQWLMFRANF

SEQ ID NO: 16694 - protein, 291 aa, Brucella suis 1330
MTNVKVAFLGLGVMGYPMAGHLKAKGGHDVTVYNRTAAKAAKWAEQFGGNYAATPADAVKDADFVFACVGNDDDLRSVTIGADGAFSTMKKDAIFIDNTTASAEVARELDKEAQKRGFHFMDAPVSGGQAGAENGVLTVMVGASEPVFERAKPVIEAYARSVGLMGPVGSGQLAKMVNQICIAGLVQGLAEGIHFGKKAGLDIEKLIAVISKGAAGSWQMENRSSTMNQGKYDFGFAVDWMRKDLGICLDEANRNGALLPVTALVDQFYKEVQKIGGGRWDTSSLLARLEQ

SEQ ID NO: 16695 - protein, 469 aa, Brucella suis 1330
MTTANDILKQIKDNDVKFVDLRFTDPKGKLHHVTMDIGLVDEDMFVDGVMFDGSSIAGWKAINESDMVLMPDPETAHIDPFFAQSTLVILCDILEPLSGESYSRDPRTTAKKAEAYLKSLGIGDTVYVGPEAEFFVFDDVKFKADPFNTGFKLDSAELPSNDDTDYETGNLGHRPRVKGGYFPVPPIDSLQDMRSEMLTVLSEMGVTVEKHHHEVASAQHELGTKFDTLVRNADKMQIQKYVVHQVANAYGKTATFMPKPVFGDNGSGMHVHFSIWKDGKPTFAGNEYAGLSENCLYFIGGVIKHAKAVNAFTNPSTNSYKRLVPGYEAPVLLAYSARNRSASCRIPFGSSPKSKRLEVRFPDPSANPYLCFSALLMAGLDGIKNKIHPGQAMDKDLYDLPPKELKQIPTVCGSLREALQSLDKDREFLKAGGVFSDDQIDSFIELKMAEVMRFEMTPHPVEFDMYYSV

SEQ ID NO: 16696 - protein, 501 aa, Brucella suis 1330
MFELLTPEEMARADRLTMEGGIKDGFALMLAAGRAVADIAQHMFPQKQPVAVLCGPGNNGGDGYVAAQYLLEAGYEAVCFAAAPPRQGTDAMRASIFYKGQVRDLNEFSPASFGGIIDALYGAGLARAVEGAQATVIDAVNASGLPVVAVDLPSGISGATGMALGAAMRAKATVTFFRKKPGHLLQPGRAHCGIIHIADIGIPDRILGEINPRVFENSPELWADSLPSPAVDAHKYSRGHAAVFSGAMHSTGAARLSAMAAARSGAGAVTLLSPPDALAVNAAHLTSIMVRETRSQQDAAQFITDRKVTAAVLGPGYGNPAFARDYTKMLLSAASGKAGQFRGLVLDADGITAFENKPDELFDTHRSSATALVLTPHEGEFKRLFPDIAEDNTSKIDKARKAAMRANAVVIYKGPDTVIAEPGGLAVINSNGTPFLATAGSGDVLTGIVCGLLAQGMAPFAAACASVWVHADAARRFGHGLIAEDLPAQLPAVWSSLSRFG

SEQ ID NO: 16697 - protein, 464 aa, Brucella suis 1330
MTGFDYDLFVIGGGSGGVRAGRLAGAIGKKVGLAEEYRMGGTCVIRGCVPKKLFVYASQFPEHFEDSAGYGWSMGEAAFDWKKLIAAKDKEISRLEGLYRKGLENSHVDIFASRAELIDEHTIELKADGRRVTADKILIATGGRPNTHESLPGHEYCISSNEAFHLEELPKSIVIAGGGYIAVEFANIFHGLGVETTLVYRGKEILSRFDHDIRSLLHETMEAKGIRILCGAIFEKVEKKADGKLSVELSNGETLETDQAMLALGRIPNTDGLGLEKAGVKIDKSGAIEVDDYSRTNVENIWAVGDVTNRVQLTPVAIHEAMCFLETAFKDNPTKPDHELIATAVFSQPEIGTVGLSEDEAAKKYPELEIYRALFRPMKNTLSGRSEKTLMKLVVESKSRKVLGAHIMGPDAGEMAQLLGISLKAGATKDDFDRTMAVHPTATEELVTMYKPTYRVVDGKKIEG

SEQ ID NO: 16698 - protein, 342 aa, Brucella suis 1330
MFNSVLDTIGNTPLIRLSKASELTGCDIYGKAEFLNPGQSVKDRAALYIIRDAEKRGLLRPGGVIVEGTAGNTGIGLTMVAKALGYRTAIVIPETQSQEKKDALRLLGAELIEVPAAPYRNPNNYVRLSGRLAEQLAKTEPNGAIWANQFDNTVNRQAHIETTAQEIWRDTNDQIDGFVAAVGSGGTLAGTAIGLKERNHNIKIALADPHGAALHAFYTTGELKAEGDSITEGIGQGRITANLEGFTPDFSYQIPDAEALDILFALVEEEGLCLGGSSGINIAGAIRLAKDLGPGHTIVTVLCDYGNRYQSKLFNPAFLRGKSLPVPRWLEKKTEIDIPFEG

SEQ ID NO: 16699 - protein, 327 aa, Brucella suis 1330
MKAMVLEKPGQPLVLVERPDPLPGPGQIRLKVEACAVCRTDLHVVDGELERPKLPLVPGHEIVGVIDAVGTGVDPSRTGRRVGVPWLGHTCGACDYCRSGAENLCDAPLFTGYTRDGGFATHVVADADFAFDLDEAADPVALAPLLCAGLIGWRSLKKAGEGKRIGLYGFGAAAHIIAQVCRWQDREVYAFTKPGDTEAKDFARSLGAVWAGDSDILPPSPLDAAIIFAPAGELVPAALRAVRKGGRVVCGGIHMSDIPSMPYSILWEERALVSVANLTRNDAEEFFPLARAAGVRTHTTIYPLESANEALADLRSGRLSGAAVLVP

SEQ ID NO: 16700 - protein, 119 aa, Brucella suis 1330
MPRFDASGLITAIVTDARDGELLMVAHMNEEALRLTLETGIAHYWSRSRKTLWKKGETSGNLQSVVELRTDCDQDALWLKVHVAGDGPTCHTGRRSCFYRQVVSSGGKVALTMVSDHDQ

SEQ ID NO: 16701 - protein, 394 aa, Brucella suis 1330
MSRAAFAWEDPFLLEEQLTEDERMIRDSAKAFASDVLLPRVEKAYLEETTDPELFHLMGQAGLLGVTLPEDYGAANASYVAYGLVAREVERIDSGYRSMMSVQSSLVMYPIYAYGSDEQRKKYLPGLVSGELIGCFGLTEPDAGSDPAGMKTRAEKIDGGYRLSGSKMWISNSPIADVFVVWAKSAAHDNAIRGFILEKGMKGLSAPKIGGKLSLRASITGEIVMDGVEVSEDAILPNVSGLKGPFGCLNRARYGISWGVLGAAEDCWFRARQYGLDRKQFNKPLAGTQLYQKKLADMQTEIALGLQASLRVGRLFDEGKMAPEMISIVKRNNCGKALDIARQARDMHGGNGIQIEYHVMRHAQNLETVNTYEGTHDVHALILGRAQTGIQAFF

SEQ ID NO: 16702 - protein, 196 aa, Brucella suis 1330
MSFIRSALAAAAFVALSIGAVQTASAADPENTVILKLKDGDVALELRPDLAPKHVAQIKKLVREGAYNGVAFHRVIPGFMAQTGDVKFGNMDKGFDAARVGTGGSNYPDLPAEFSKEPFVRGTVGMARSQNPNSANSQFFIMFDDGPFLNGQYTVVGKVVSGMDAVDKIKKGSEAENGAVKNPDKIIKATIEADTK

SEQ ID NO: 16703 - protein, 487 aa, Brucella suis 1330
MADIYDVIVIGSGPGGYVTAIRAAQLGLKTAIVEREHLGGICLNWGCIPTKALLRSAEILHFGEHAKDYGLKLDGTITPDVKAVVQRSRGVSARLNGGVAFLMKKNKIDVIWGEAKLVKAASGSNPAEISVGKTSKQPMQPQNPVPKGVLGEGSYKAKHIIVATGARPRALPGIEPDGKLIWTYFEAMVPQALPKSMLVMGSGAIGIEFASFYHDMGVDVTVVEVMSQIMPVEDAEISAIARKQLEKRGLKIITDAKVAKVEKGANSVTAHVETKDGKTQTLTVDRMISAVGVQGNIENLGLEALGVKTDRGCIVIDGYGKTNVAGIYAIGDVAGPPMLAHKAEHEGVICVEKIAGLPNVHPLDKGKIPGCTYCNPQVASVGLTEAKAKEQGYDIRVGRYSFSANGKAIALGEDQGLVKTIFDRKTGQLLGAHMVGAEVTELIQGFVIAMNLETTEEELMHSVFPHPTLSETMKESVLDAYGRVLNA

SEQ ID NO: 16704 - protein, 194 aa, Brucella suis 1330
MRLILLGPPGAGKGTQAGLLTKKHGIPQLSTGDMLRAAVAQQSEIGKRAKAVMDAGQLVSDEIVNQIVSERIDAPDCANGFILDGYPRTVPQAQALSQMLSGKGLKLDAVIELKVDENALVKRMESRVAETIAKGGQVRSDDNPEAFRKRLVEYREKTAPLSSYYAGTGELRVINGMAPVEEVTAEIERILVPA

SEQ ID NO: 16705 - protein, 406 aa, Brucella suis 1330
MSEEFHKIRRLPPYVFEQVNRLKASARAAGADIIDLGMGNPDLPTPQNIVDKLCEAVQDPRAHRYSASKGIPGLRRAQAQYYARRFGVKLNPDTQVVATLGSKEGFANMAQAITAPGDVVLCPDPTYPIHSFGFIMSGGVIRSVQAKPDDNFIPTLERGVKHSIPKPIALILNFPSNPTAYVATLDFYKDVVAFARKHDIVILSDLAYSEIYFDGNPPPSVLEVPGAMDVTVEFTSMSKTFSMPGWRMGFAVGNERLIAALTRVKSYLDYGAFTPIQVAATAALNGDGSDIAYVRNVYKQRRDVLVESFGRAGWDVPPPAATMFAWVPIPERFRSLGSLEFSKLLVEQADVAVAPGVGFGEHGDDYVRIALVENEHRIRQAARNIKRFFSAKDENLQNVIPLEGHR

SEQ ID NO: 16706 - protein, 296 aa, Brucella suis 1330
MATIAFIGLGNMGGPMAANLVKAGHTVRGFDLLPQHLEEAKANGLEIAASAAEAVSDVDAVITMLPAGKHVISVYEDIAPKARKDSLFVDCSTIDVDSARKAHELAATHGHLSIDAPVSGGTGGAAAGTLTFMAGGSEEAFKRGEPILQPMAGKIVHCGGDGAGQAAKICNNMILGISMIGVGEAFVLAEKLGLSHQALFDVASTSSGQCWSLTTYCPVPGPVPASPANNDYKPGFAAALMLKDLKLSQEAAKSAGAETPLGAHARELYSRFDDEGHGGEDFSGIINFLRDRTDRA

SEQ ID NO: 16707 - protein, 395 aa, Brucella suis 1330
MFRTLDDANVQSKRVLVRIDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAVVGWHFAADTPHQTYGVDSVPGDAMILDAGELSTDLIASAIDDAATLVWNGPLGAFELRPFDTATVKVARHVAKRTKEGKLVSVGGGGDTVAALNHAGVVDDFTYISTAGGAFLEWMEGKPLPSVDVLKK

SEQ ID NO: 16708 - protein, 326 aa, Brucella suis 1330
MTAIEITEPGGAYMLRPAQRAVPEPKEGEILVRVRAAGVNRPDVLQRQGQYAPPPGASDIPGLEIAGDIVALGHGVKRFRKGDQVVALLAGGGYAEYAVVHESNALPLPSGFGYIEAAAIPETFFTVWHNVFERGGLKEGEVFLVHGGSSGIGTTAIQLAKAFGATVITTAGSKEKCDACVKLGADRAINYHEEDFVAVVKEMTGGKGVDVILDMVGGDYVERNYKAAAEDGRIVQIAFLNGAKATANFAILMTKRLTHTGSTLRPRPVAFKAGIARELEAKVWPLLAQRRVAPVMDMIFSLKDAWRAHERMEEGRHIGKIVLDIA

SEQ ID NO: 16709 - protein, 478 aa, Brucella suis 1330
MKRNRKVKILATLGPASGEEAVIRKLFEAGADVFRINMSHADHDLMRTLVKRIRNVEKELGRPIGILADLQGPKLRVGKFKDGKVDLVPGQTFTLDNNEALGDETRVFLPHPEILEAVEPGHRLLIDDGKLHLVAEACDGKSIRCKVVSGTRISDRKGVSLPDTTLGVGALTEKDRCDLDAVLKEEIDWVALSFIQRPEDLAEVRKVSRGKVGLMSKIEKPQAVTRLDEIIELSDALMVARGDLGVEVPLENVPGIQKQITRKARRAGKPVVVATQMLESMITAPVPTRAEVSDVATAVFEGADAIMLSAESASGQYPVEAVATMNRIAEQVEREPTYSTIIDAQRAMPEPTGADAISLAARQIAETLKLSAIVTYTASGTTGLRAARERPRTPIIALSPVVDTARKLSLVWGLHCVVTDDAHDLEDMVNHACEIVFHEEFGKAGDRVIITAGVPFGTPGATNMLRIAYIGADGKSGI

SEQ ID NO: 16710 - protein, 182 aa, Brucella suis 1330
MESGMSKHKGPTGAMVDPESLPYRPCVGLMVLNKAGLVWAGRRIVIPGDEMDGATQLWQMPQGGIDKGEDPAQAALRELYEETGMTSVSLLEEASDWINYDLPPHLVGLALKGKYRGQTQKWFAYRFEGDESEIAINPPPGGHTAEFDCWEWKPMADLPNLIVPFKRKVYEQVVATFRHLAA

SEQ ID NO: 16711 - protein, 467 aa, Brucella suis 1330
MSYDVVVIGTGPGGYVAAIKAAQLGLKVAVVEKRKTFGGTCLNIGCIPSKALLHASEVFAEAGHSFDTLGVEVTPKLNLTKMLAHKDTTVKANVSGVEFLFKKNKITPYIGTGKIVGKGKVSVTSEDGKVEEIEAKNIIIATGSDVAGIPGVKVDIDEKVIVSSTGALSFDKVPGSLIVVGGGVIGLELGSVWARLGAKVTVVEYLDKVLGPMDGEVSKQFQRLLEKQGIAFKLGAKVTGVEKVGKGAKVTFEPVKGGDAETLEADAVLIATGRRPYTDGLGLQEAGVAVDERGRVAIDDHWRTNVEGIYAIGDVVQGPMLAHKAEDEGIAVAEIIAGQAGHVNFDVIPSVVYTQPEVASVGKTEEELKAAGIDYKVGKFPFTANGRARAMLHTDGFVKILADKATDRVLGAHILGYNAGEMIHELAVLMEFGGSSEDLARTCHAHPTMSETVRESALATFAKPIHM

SEQ ID NO: 16712 - protein, 271 aa, Brucella suis 1330
MTSPLLRISNLAKSFGNVTALRDISFDVSAGEVVCIIGPSGCGKSTLLRCINHLTAPDGGFVEVGGEYIGRERKPDGTVRMQSHHEIDLMRPKMGFVFQQFNLWPHLSVLENIVKGPIKVQKRPRAEAEAQALALLQRFGLRDKAHMFPAGLSGGQKQRVAIARALAMGPELMLFDEPTSALDPEIVKEVLLFLRELADSGVTMVIVTHEIGFARHVADRIVFLDKGVVAETGPSEDVLSNPANPRLREFLSQISSNHSHAGGAFSPAATH

SEQ ID NO: 16713 - protein, 337 aa, Brucella suis 1330
MTDKLTSAPKHGHTSMLYSKVHTDLDTLDAHIAFLGIPYGSAYTIDEVTNDQTRAPTAVRQATDRAVRNLDRYDFDVDGPLYDGRAIKAVDCGDVVGDPKDPGAHYRNAEAAVRKILAAGALPLIIGGDHGIPIPVLRAYDDQGPITLIQIDAHLDWRDHINGVHDGLSSPIRRASEMAHVKDIFQIGIRAQGTARPEEYEAARAYGSNIITAYELHDVGMDAILDRIPDGGRYYITIDADGIDPSVMPAVAGPAFGGVTYAQTRKLLHGLVKKGRVVGMDIVEITPSKDVNQLTAIAAGRFFVNLIGAAVRADYFGTKAELETAAGKTMKPAHAAA

SEQ ID NO: 16714 - protein, 427 aa, Brucella suis 1330
MTAPRPSKIRLGNHLLHPETQMLNYGYDPELSEGAVKPPVFLTSTFVFKTAEDGRDFFDFVSGRKEPPAGVGAGLVYSRFNHPNSEIVEDRLAVYEGAESAALFSSGMSAIATTLFAFVRPGDVILHSQPLYGGTETLLAKTFFNFGVEAVAFADGVHEATIEKAAEEALAKGRVSVILIETPANPTNSIVDVAAVRRVAEKIEARQGSRPVIACDNTLLGPVFQKPLDHGADLSVYSLTKYVGGHSDLIAGAVLGAKSVVRQVKALRGAIGTQLDPHSCWMLGRSLETLGLRMERADSNARAIAEFLRNHPKVEKLHYLPFADERSDIAALFKRQCTGAGSTFSFDIKGGQAAAFRFLNALQILKLAVSLGGTESLASHPAAMTHSGVPVDVRERIGVLESTIRLSIGIEHPGDLIADLAQALDAA

SEQ ID NO: 16715 - protein, 228 aa, Brucella suis 1330
MLNKLSAEFFGTFWLVFGGCGSAILAAAFPELGIGFLGVALAFGLTVLTMAYAVGGISGGHFNPAVSLSLTVAGRLPAKDLIPYWVAQVLGAIATAAILYVIASGKDGFSAGGLASNGYGELSPGGYSMMAGLLIEIILTAFFIIIILGSTSSLAPAGFAPIAIGFGLTLIHLVSIPVTNTSVNPARSTGVALFADTAALSQLWLFWVAPLVGAVIGAIIWKGLLGRD

SEQ ID NO: 16716 - protein, 506 aa, Brucella suis 1330
MVMSTIVKPQPLTGLEVREFSMLIDGKWVGSDSGKSIERVAPGHGVTVSRYPAGNKADVERAVSAARKAFDDGRWSSTTASQRSLVLLKAADLIEARAEELAYLDAIEAGKPISQVRGEISGSVDIWRYAAALARDLHGESYNTLGDGTLGVVLREAIGVVSIITPWNFPFLIVGQKLPFALAAGCTAVVKPSELTSGSTLLLGEILAEAGVPDGVVNIVTGTGADVGQHMSTHPHVDMVSFTGSTGVGKLTMANAAQTLKKVSLELGGKNPQILFPDADMDAFIDAAVFGAWFNAGECCNAGSRLIVHRSVVDAIVGRVADLSKKVIVGDPLDASTQVGAIITPQHLTKVGAYVDQARKAGAAIAHGGEVLDLGLGQYMGPTILAGVKADMAVAREEVFGPVLSVLSFDTVEEAISIANAVDYGLSAGVWSRDFDTCMTIGRKVRAGTVWMNTFMDGTPELPFGGYRQSGLGRELGRHAVEDYTETKTLNMHIGARTGWWMPQAK

SEQ ID NO: 16717 - protein, 301 aa, Brucella suis 1330
MNWITNYVRPKINSMLGRREMPENLWIKDPSTGEMVFHKDLESNQFVIPSSGHHMRIKAKDRLRFFFDNGEYTTLEAPKVPLDPLKFRDEKKYIDRLKDYRSRTGMDDAIVNGLGTIEGLPIVATVQDFSFMGGSLGMGAGEAIIQGFEKAIELKRPLVLFASSGGARMQEGILSLMQLPRTTVAVEMLKEAGLPYIVVLTNPTTGGVTASYAMLGDIHIAEPGALIGFAGPRVIEQTIREKLPEGFQSSEYLMEHGMVDMVVSRLELKATIARLLKIMTKQPANSDAPAPQKPDADSKAA

SEQ ID NO: 16718 - protein, 279 aa, Brucella suis 1330
MTTRIDTKFAELKAEGRPALVTYFMGGDPDLETALKVMKALPKAGADVIELGMPFSDPMADGPAIQAAGLRALNAGQTLAKTLYMAAEFRKEDDTTPIVMMGYYNPIYVYGVERFLTDAKASGVDGLIVVDLPSEMDAELCIPAMKAGINFIRLTTPTTDDKRLPKVLHNSSGFVYYVSMNGITGAAIADTAKVGEAVRHIKKSTDLPICVGFGVKTPEQAAAIATHADGVVVGTAIVNAIAGELDEKGKVKGDPVAAATRLVHALAESVRATRLEAAQ

SEQ ID NO: 16719 - protein, 362 aa, Vibrio cholerae
FTDTKGKEQHISIPAHQIDADFFEDGKMFDGSSVAGWKGINESDMVMMPDPSSAVLDPFTEDATLNIRCDILEPATMQGYDRDPRSIAKRAEEYMRSTGIADTVLVGPEPEFFLFDDVKFATNMSGSFFKIDDVEAAWNTGTEYEDGNKGHRPGVKGGYFPVAPVDSSQDIRSAMCLIMEEMGLVVEAHHHEVATAGQNEIATRFNTLTTKADEIQIYKYVVHNVAHAFGKTTTFMPKPLVGDNGSGMHVHQSLAKDGVNLFAGDKYGGLSETALYYIGGIIKHARALNAITNPSTNSYKRLVPHYEAPVMLAYSARNRSASIRIPVVPSPKARRIEVRFPDPAANPYLAFAAMLMAGYDGI

SEQ ID NO: 16720 - protein, 362 aa, Phytophthora infestans
MPRIETEVRLDFKDVLIRPKRSTLKSRSQVDVQREFRFLNSKRTWSGVPVIAANMDTVGTFEMAVELAKLEFITCVHKHYTPQDWATFAAKHPDVLPTVAVSGGSSAADVEKITAILKSHPDIRFICLDVANGYSEVFVQAVRNVRSAFPEHTIIAGNVVTGEMVEELLLSGADIIKVGIGPGSVCTTRKQTGVGYPQLSAVLECADAAHGLNGHVISDGGCTCPGDVAKAFGAGADFVMLGGMLAGHDESGGDKIEINGKLLKKFYGMSSSEAMKKHNGGVAEYRASEGKSVTVPYRGPVSGTCKEILGGVRSTCTYVGASKLKEISKRTTFIRVSQQLNEVFGRAPNEQEEQVSKKQKTG

SEQ ID NO: 16721 - protein, 414 aa, Phytophthora infestans
MAKLSIKNVDVKGKRVLIRVDFNVPFAQDGSISNTQRIDAALPTVQYVLDQGAKAVVLMSHLGRPEGKPKAKDSLAPVAVAVEQKLGRKVTFLKDCVGPEVEAACANPTEGSIILLENLRFHVEEEGKGKDAEGNKTKASSEAVAAFRASLSKLGDVYVNDAFGTAHRAHSSMVGVDLPIKAAGFLLDKELVYFAKALDAPQRPFVSILGGAKVADKIQLIMNMLDKVDEMVIGGGMAYTFKKVINNMEIGGSLYDEEGAKIVPQIVEKAKAKGVTLHLPVDFVIADKFAADAATKISTEEEGIPAGWMGLDVGPKSQEAFSAAVAKAKTVVWNGPMGVFEFDAFADGTKVVMDAVVKATESGATTIIGGGDTATCCVKFNTEDKVSHVSTGGGASLELLEGKILPGVDALSSA

SEQ ID NO: 16722 - protein, 454 aa, Phytophthora infestans
MVSIVSIKARQIFDSRGNPTVEVDLVTELGEYRAAVPSGASTGEFEALEMRDGGKDYMGKGVLNAVKNVNEIIAPALIGKDVTKQAEIDRFMVEKLDGTQNEWGWYKKKLGANAILGVSLALCRAGAAAKKQPLWQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSERLAKYNQLLRIEEELGNKARYAGEDFRDVEKLGKYSTF

SEQ ID NO: 16723 - protein, 489 aa, Phytophthora infestans
MSSPASLESSLPPAALEVLPDIMAAIGQTPMVCINSIGKKAHLQCELLAKCEFFNAGGSVKDRIGKRMVEDAEAAGRIKPGDTLIEPTSGNTGIGLALASAIKGYRCIITLPEKMSLEKVNVLKALGAEIIRTPTEAAWDSPESHIGIARRLQAELPNAHILDQYANPSNPLAHYDGTAEEILEQCDGKVDMVVMGVGTGGTISGIAKKLKEKCPSVIVVGVDPEGSILALPDSLNDKNRLQSYKVEGIGYDFIPDVLDRSLVDQWEKTNDQESFIMSRRLIREEGLLCGGSSGSAMAAAVRAASVLKPGQRCVVVLPDSTRNYMSKFLNDAWMYENKYVENTVHTRENYSKYRKETATWWSQQRVSVLELPHPSTVSPQLSCAAAIETMERHGYDQLPVVKEDGTVQGVVTIGNLLSRLSSGRVMRTDPVATVTFGNFSRVTHESSLAELAAIFDKDYFAVVTSTDGKIAGLATRIDLLNYITSAREE

SEQ ID NO: 16724 - protein, 387 aa, Arabidopsis thaliana
MDGGAEGSQQPHLILANKLFLLTHPDVPDIEKVQLKSEVLDFIRSHGMAPLYETLIASSVLDLDQSLLESMRAANEEELKKLDEKIADAEENLGESEVREAHLAKALYFIRISDKEKALEQLKLTEGKTVAVGQKMDVVFYTLQLAFFYMDFDLVSKSIDKAKKLFEEGGDWERKNRLKVYEGLYCMSTRNFKKAASLFLDSISTFTTYEIFPYETFIFYTVLTSIITLDRVSLKQKVVDAPEILTVLGKIPFLSEFLNSLYECQYKAFFSAFAGMAVQIKYDRYLYPHFRFYMREVRTVVYSQFLESYKSVTVEAMAKAFGVSVDFIDQELSRFIAAGKLHCKIDKVAGVLETNRPDAKNALYQATIKQGDFLLNRIQKLSRVIDL

SEQ ID NO: 16725 - protein, 227 aa, Arabidopsis thaliana
TNEGEREFMFYRNPSADMLLEESELDFDLIKKAKIFHYGSISLITEPCKSAHISAAKAAKEAGVILSYDPNLRLPLWPSADNAREEILSIWETADIIKISEEEIVFLTKGEDPYDDNVVRKLFHPKLKLLLVTEGPEGCRYYTKDFSGRVHGLKVDVVDTTGAGDAFVAGILSQLANDLSLLQDEERLREALMFANACGALTVKVRGAIPALPTKEAVHEALLKAVV

SEQ ID NO: 16726 - protein, 234 aa, Rhizobium leguminosarum
MAKADFYETLGVAKSADEKELKSAFRKLAMKFHPDKNPDDKDAERKFKEINEAYEMLKDPQKRAAYDRYGHAAFEHGGMGGGGGGFAGGGFSDIFEDIFGEMMGGGAARQRSSGGRERGADLRYNMEITLEESFSGKTAQIRVPTSITCDVCTGSGAKPGTQPKNCGTCQGTGRVRAAQGFFSIERTCPTCHGRGQIIPDPCPKCHGQGRVTEERSLSVNIPAGIEDGTRIRLQ

SEQ ID NO: 16727 - protein, 453 aa, Persea americana
MDNKGGILMQRFELGRLLGQGTFAKVYHARNLKSSQSVAIKVIDKEKVLKVGMIDQIKREISTMRLASHPNVVQLYEVMATKTKIYFVLEYVKGGELFNKVAKGKLKEDVAWKYFQQLVSAVDFCHSRGVYHRDLKPENLLVDENENLKVTDFGLGALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIAKIKDNSWFKRGFEAKFAKGETKSKELAPLDTDAAFASSDTGVAARKPELVKPQHLNAFDIISLSAGFDLSGLFEDTNCRKEARFASKQPASAIISKLEDIAKRLRLKVKKKDEGILKLEGSKEGRKGVLSIDAEIFVVNPSFHLVEVKKSSGDTLEYQKLWNQDMRPALTDIVWAWQGDQQQQQESLVCSLGQSL

SEQ ID NO: 16728 - protein, 477 aa, Angylocalyx braunii
VGFKAGVKDYKLTYYTPDYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHVHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAVDTCNPVITVRSINCN

SEQ ID NO: 16729 - protein, 465 aa, Adesmia exilis
VGFKAGVKDYKLTYYTPEYETKDTDILAAFRVTPQPGVPPEEAGAAVAAESSTGTWTTVWTDGLTSLDRYKGRCYNIEPVAGEESQFIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFPAMDTL

SEQ ID NO: 16730 - protein, 467 aa, Ateleia herbert-smithii
  misc_feature (1)..(2): Xaa can be any naturally occurring amino acid
XXVGFKAGVKDYKLTYYTPDYQTKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16731 - protein, 465 aa, Arachis hypogaea
VGFKAGVKDYKLTYYTPEYETKDTDILAAFRVTPQPGVPPEEAGAAVAAESSTGTWTTVWTDGLTSLDRYKGRCYNIEPVAGEENQYIAYVAYPLDLFEEGSVTNMFTSIVGNVFGFKALRALRLEDLRIPISYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKAIKFEFPAMDTL

SEQ ID NO: 16732 - protein, 465 aa, Apuleia leiocarpa
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFCFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 16733 - protein, 467 aa, Brongniartia pacifica
  misc_feature (1)..(2): Xaa can be any naturally occurring amino acid
XXVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFIQKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16734 - protein, 465 aa, Brownea sp. JJ Doyle 1538
VGFKAGVKDYKLTYYTPDYETKDTDILAAFRVTPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIIMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16735 - protein, 467 aa, Bolusanthus speciosus
  misc_feature (1)..(2): Xaa can be any naturally occurring amino acid
XXVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPNSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16736 - protein, 468 aa, Castanospermum australe
  misc_feature (1)..(3): Xaa can be any naturally occurring amino acid
XXXVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIIMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16737 - protein, 467 aa, Canavalia ensiformis
  misc_feature (1)..(2): Xaa can be any naturally occurring amino acid
XXVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPISYIKTFQGPPHGIQVERDKLNKYGRPLLGCTIKPKLGLSAKNYGRAVYECLRGGLDFTKDDENVNSQPFMRWRDRFCFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16738 - protein, 465 aa, Cassia fistula
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPISYIKTFQGPPHGIQVERDKLNKYGRPLLGCTIKPKLGLSAKNYGRAVYECLRGGLDFTKDDENVNSQPFMRWRDRFCFCAEALYKAQAETGEIKGHYLNATAGTCEEMIKRAVFARELGVPIVMHDYLTGGFTANTTLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16739 - protein, 467 aa, Cladrastis sikokiana
  misc_feature (1)..(2): Xaa can be any naturally occurring amino acid
XXVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16740 - protein, 465 aa, Securigera varia
VGFKAGVKDYKLTYYTPEYETKDTDILAAFRVTPQPGVPPEEAGAAVAAESSTGTWTTVWTDGLTSLDRYKGRCYHIEPVPGEESQFIAYVAYPLDLFEEGSVTNMFTSIVGNVFGFKALRALRLEDLRIPNAYVKTFQGPPHGIQVERDKLNKYGRPLLGCTIKPKLGLSAKNYGRAVYECLRGGLDFTKDDENVNSQPFMRWRDRFLFCAEAIFKAQDETGEIKGHYLNATAGTCEEMIKRAVFARELGAPIVMHDYLTGGFTANTTLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFPAMDTI

SEQ ID NO: 16741 - protein, 465 aa, Dalbergia hupeana
VGFKAGVKDYKLNYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGAPIVMHDYLTGGFTANTTLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16742 - protein, 465 aa, Dipteryx odorata
VGFKAGVKDYKLTYYTPQYQTKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRVPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMLKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16743 - protein, 465 aa, Dussia tessmannii
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16744 - protein, 467 aa, Erythrophleum ivorense
  misc_feature (1)..(2): Xaa can be any naturally occurring amino acid
XXVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16745 - protein, 465 aa, Holocalyx balansae
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16746 - protein, 465 aa, Hedysarum vicioides
VGFKAGVKDYRLTYYTPEYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNDIIREACKWSPELAAACEVWKEIKFEFQAMDTL

SEQ ID NO: 16747 - protein, 465 aa, Lotus corniculatus
VGFKAGVKDYKLTYYTPDYETKDTDILAAFRVTPQPGVPPEEAGAAVAAESSTGTWTTVWTDGLTSLDRYKGRCYHIEPVPGEESQFIAYVAYPLDLFEEGSVTNMFTSIVGNVFGFKALRALRLEDLRIPNAYVKTFQGPPHGIQVERDKLNKYGRPLLGCTIKPKLGLSAKNYGRAVYECLRGGLDFTKDDENVNSQPFMRWRDRFLFCAEALFKAQEETGEIKGHYLNATAGTCEEMIKRAVFARELGAPIVMHDYLTGGFTANTTLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 16748 - protein, 465 aa, Lespedeza cuneata
VGFKAGVKDYKLTYYTPQYQTKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNDIIRAAAKWSPELAAACEVWKEIKFEFEAMDTI

SEQ ID NO: 16749 - protein, 465 aa, Myroxylon balsamum
VGFKAGVKDYKLNYYTPDYETKDTDILAAFRVTPQPGVPPEEAGAAVAAESSTGTWTTVWTDGLTSLDRYKGRCYQIEPVAGEENQFIAYVAYPLDLFEEGSVTNMFTSIVGNVFGFKALRALRLEDLRIPTSYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHVHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFEAVDTL

SEQ ID NO: 16750 - protein, 467 aa, Maackia floribunda
GFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPISYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDKLDKL

SEQ ID NO: 16751 - protein, 465 aa, Machaerium lunatum
VGFKAGVKDYKLTYYTPDYETKDTDILAAFRVTPQPGVPPEEAGAAVAAESSTGTWTTVWTDGLTSLDRYKGRCYNIEPVAGEDNQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16752 - protein, 467 aa, Myrospermum sousanum
  misc_feature (1)..(2): Xaa can be any naturally occurring amino acid
XXVGFKAGVKDYKLNYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIIMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16753 - protein, 465 aa, Otholobium sericeum
VGFKAGVKDYKLTYYTPDYETKDTDILAAFRVTPQPGVPPEEAGARVAAESSTGTWTTVWTDGLTSLDRYKGRCYHLEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREATKWSPELAAACEVWKEIKFEFEAMDTL

SEQ ID NO: 16754 - protein, 467 aa, Podalyria calyptrata
  misc_feature (1)..(1): Xaa can be any naturally occurring amino acid
  misc_feature (3)..(3): Xaa can be any naturally occurring amino acid
XTXGFKAGVKDYRLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNQIIREASKWSPELAAACEVWKEIKFEFQAMDTL

SEQ ID NO: 16755 - protein, 467 aa, Phylloxylon perrieri
  misc_feature (1)..(2): Xaa can be any naturally occurring amino acid
XXVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGSKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIIMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16756 - protein, 465 aa, Senna alata
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIFKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16757 - protein, 467 aa, Sophora bhutanica
GFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYVKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDKLDKL

SEQ ID NO: 16758 - protein, 468 aa, Sophora japonica
  misc_feature (1)..(3): Xaa can be any naturally occurring amino acid
XXXVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTPNTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 16759 - protein, 465 aa, Swartzia sp. Henderson 695
VGFKAGVKDYKLTYYTPEYQTKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIFKAQAETGEIKGHYLNATAGTCEEMIKRAVFARELGAPIIMHDYLTGGFTANTSLAHYCRDNGLLLHIHRAMHAVIDRQKNHGMHFRVLAKGLRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16760 - protein, 467 aa, Tachigali paniculata
  misc_feature (1)..(2): Xaa can be any naturally occurring amino acid
XXVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPTYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 16761 - protein, 468 aa, Xanthocercis zambesiaca
  misc_feature (1)..(3): Xaa can be any naturally occurring amino acid
XXXVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFCFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16762 - protein, 465 aa, Zornia cantoniensis
  misc_feature (307)..(307): Xaa can be any naturally occurring amino acid
VGFKAGVKDYKLTYYTPEYETKDTDILAAFRVTPQPGVPPEEAGAAVAAESSTGTWTTVWTDGLTSLDRYKGRCYGLEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMIKRAVFARELGVPIVMHDYLTGGFTANTSLAHYCRDNGLLLHIHRAMHAVIDRQKNHGMHFRVLAKXLRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 16763 - protein, 181 aa, Mycobacterium leprae
MRVVLLGPPGAGKGTQAQRLAEKLGIPQISTGELFRRNIEKDTKLGHEAKKYLDAGDLVPADLTNQLVDDRLNKSDTVDGFILDGYPRSLEQAKALHEMLERRGTDIDAVLEFRVSQAVVLERLKGRGRADDTDDVVINRMNIYRDETRSLLEYYSSELKTIDAIGTMDEVFARALHALGK

SEQ ID NO: 16764 - protein, 295 aa, Medicago sativa
MGNTNSSHNLLITVTVFAVTVTVFFILYFILRRRRFSPSSSSTVRVSPVTPTSSTSSSVVDSLPIFTFSSIKRRSSTVVSGDCAVCLSKFEQNDLLRLLPLCCHAFHTECIDAWLASNQTCPLCRSSVFVSESEIMKIFRSSSTSSGNNSFRLEIGNISHRREATATDNNNNNNNVAGETDRRTYSVGAFDYFVDEEAEIPVGNTNRRIFSGEKDDAAVLSVEVETPVDSQASLIGEGNWLKDYVDGLTRVMSFRGSGSSRRNDVVAGVGDFDVEANGNGFGEEISEMFRWISGV

SEQ ID NO: 16765 - protein, 339 aa, Colletotrichum gloeosporioides f. sp. malvae
MVVSQPEVDFAREKDRLAEAQPQGQRAASSHDDAAPPPIGMTEPDERRGTRSRHDHSGKRDKVVRFGDYILGNTIGEGEFGKVKLGRKQDGGVQVIPVAVKLIKRDSVGNNPSRLAKIYREIAILRGISHPNIVRLHEMVETERHIGIILEYASGGELFDYILNHRYLKDNAARRLFAQLVSGVGYLHKKGIVHRDLKLENLLLDRNRNIIITDFGFANTFDGTRKGDLMQTSCGSPCYAAPELVVSDSLYTGRKVDVWSCGVILVSTAARYAMLAGYLPFDDDPANPEGDNINLLYKIVNTPLTFPEYVTPTPVTYSAASRSQSPQASGSLRGGRTAG

SEQ ID NO: 16766 - protein, 473 aa, Neotyphodium uncinatum
MTVDTITSTSNGNQDVPKEFFPKEFETQLLHVGRFPDILGSCAVPVYSSAAFEFNSVAHGARLLNLTQFGNIYSRFTNPTVNVLQNRLAGLEGGVAACAVASGSAAVVVTVMALAGVGDNFVSSFHVHAGTFHQFESLAKQMGIECRFVKSRDPADFAAAIDDKTKFVWLETISNPGNVILDLEAVSMVCHTKGIPLICDNTFGCAGYFCRPINHGVDIVVHSATKWIGGHGTTVGGVIVDGGTFDWGQHPDRFPQFHDPRTRLWERFSRRAFAVRCQFEILRDTGSTLSAPAAQQLLVGLESLAVRCERHAQNAAKIADWLREHPLVAWVSYVGHPNHPDHQGALKYLKRGFGSVICFGLRGGFEAGALFCDALKMVITTTNLGDAKTLILHPASTTHEHFSSEHRAEAGVTDDMIRLSVGIEQIKDIKADFEQAFEQVLRGKKSLRKPCIGKILLQDEINEDLFGPSACRT

SEQ ID NO: 16767 - protein, 316 aa, Colletotrichum gloeosporioides f. sp. malvae
MPAPFSARPCLAPFPPKQLFGVSQVLLQIRHPGCRGPGRLWTGLIRTHRISPGPATRILMASMSSAIRIHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYIRNLPFMPKKPFPQLFAQANPDALDLLDRMLAFDPSSRFSVEQALEHPYLHIWHNASDEPDCPTTFNFDFEVVEDVGDMRKMILEEVYRFRQLVRPSRQHPTGAQAAGQAGAGQVPFLWKPRLDSSDPD

SEQ ID NO: 16768 - protein, 467 aa, Brucella suis 1330
MNTISKPSVDLHREEEPHLARNLSNRHLQLIAIGGTIGTGLFMGSGKAVSLAGPSILLIYAITGFMLFFVMRALGEILLSNLQYRSFADFAGDYLGPCAQFFTGWTYWLCWIVTAVAEVVAVSGYVSFWFPHLAPWIPALGLITILLILNLPTVRNFGEIEFWFALIKIITIIGLIITGIYMLMTGFVLPNGTQASIAHLWNHGGFFPNGSLGFIAGFQISVFAFVGIELVGTAAAEAENPMRNLPKAINNIPIRIVLFYIGALFVIITVTPWNQVDPNSSPFVAMFSLAGIGIAAHFINFVVLTSASSSSNSGIYSTSRMVYGLATVGLAPKAFSKLSNRKVPVHALIFSCIFLLSSVVLLYAGQSMIQVFTLVTTISALLFIFIWSIILVSYLQYRRKHPERHEKSTFKMPGRRASVVMVFIFFAFVLWALTQEPDTLAAMKVTPLWFVLLGIAYRVMKLKQKQS

SEQ ID NO: 16769 - protein, 353 aa, Brucella suis 1330
MAFLNIKNLKKSFGTNTVVHDFNLAVEKGEFVSFLGPSGCGKTTVLRMIAGFETPDNGSIEIDGKDVVNLRPNQRNIGMVFQAYALFPNMTVAQNVSFGLRVSGKSRSEIDATVKEMLSLIRLDHLADRYPYQMSGGQQQRVALARALATKPQVLLLDEPLSALDAKIRISLREEIRAIQQKLGITTVFVTHDQEEALSISDRIVVMHEGRADQIGSPFDIYNRPASRFVASFVGTLNMLEASVSEPAQNSIDLDGRQITVQETLAHHPKGKPLTLALRPEAVSLEARKSHDTSLEATIDDVHFLGSVIRTRVILGKNRLSFDTFNDPTHPPPQRGYKVTVHFASHDLLVLAD

SEQ ID NO: 16770 - protein, 427 aa, Brucella suis 1330
MRTINENTATKTSRAAVRPEHNRIWILVFIFSFLGLMIDGADLMLLSYSLTSIKAEFGLTSVEAGSLGSITLAGMAIGGIYGGWACDRFGRVKTVSWTIVLFSIGTAVLGLTHSYFQFAVARFVSSLGLGALYVACNTLMAEYVPTKYRTTALGTLQAGWSVGYIVATVLAGAILPVYGWRYLFFVAIVPVIIALLMHKGVPEPESWVRAKAERESGGSKFTTAKRESAFKAIFGNPRVRTLFIFWALTAGFLQFGYYGVNNWLPSYLETEMGMNFKSMTAYMIGSYTAMILGKVLAGVAADWLGRRAVFALGALGTAAFLPIIVLYHSPNTILWMLVVFGFLYGVPYGVNATYMAESFEAKYRGTAVGGAYNIGRAGAALAPVAIGFFASQISIGFGFLVMGGAYFICGVIPALFIREKQFDPEKQ

SEQ ID NO: 16771 - protein, 355 aa, Brucella suis 1330
MTDYRIRFENISKSYGDFKVIDGLNLDIERGEFVSLLGPSGSGKTTLLMMLAGFENPSSGTIHVDGKSINSVPSYKRNMGVVFQNYALFPHMTVAENIAFPLQMRGVGKAQAAEKVARVLDMVQLSAMSERKPSQLSGGQQQRVALARALVFEPHVVLMDEPLGALDKQLREQMQLDIRALHNRLGLTIVFVTHDQSEALTMSDRIAVFNKGKIEQIGSPRAIYDEPQTRFVAEFIGETNLAEGTVESVEGSRILIRLKDGAAIAASSASRPISGQNVLLSIRPERIELGEADGAENRLAARVMDSVYQGDHLRIQLEAKAHNFVVRLDRKAREWQPGADVAASFKAADCWTILV

SEQ ID NO: 16772 - protein, 317 aa, Brucella suis 1330
MSSSSDAIKAALEKGRAAGLSATGGKNADYIPFLASVPSDLFGLAVVTADGQTFKTGDADFAFAIESISKVFTLALVMEEIGPDSVREKVGADPTGLPFNSVIALELHNGKSLSPLVNAGAIATASLVPGDTADARWNNILECQCGFAGRRLKLSNEVNQSEQTTNFHNRAIAWLLYSAGTCYSDPMEAVDIYTRQCSTLVTATDLATMGATLAAGGVNPISGKRMVSAGNVAPILAEMTMEGLYTASGDWAYTVGLPGKSGVGGGIMAVVPGELAIAAFSPPLDPAGNSVKAMAAVAAVADSLGHNLYTTRGKVSS

SEQ ID NO: 16773 - protein, 471 aa, Brucella suis 1330
MSFIPVIISGGSGSRLWPLSRDAHPKPFIKLPDGETLIGKTYARASRLVNAEQILTVTNRDFLFLTLDAYAAAGAAQMENTFLLEPLGRDTAPAVALAALHAAEAYGPDATLLVMPADHLIEDEQAFAEAVAKARALAEAGRIVTFGIVPDRPETGFGYIEVQGTDVQRFVEKPDEATAQTYVESGRYFWNSGMFCFKALSMIDAMQRYAPQVLAGARAALAQARRGNNGETKTLEIARDEFAATPAISIDYAVMEKADNMACVPVSCGWSDIGSWAAMADLVTPDENGNRLRGETILEDTTNSFVLSETRLVSLVGVHDLLVVDTPDALLVAHRDKAQEVRSVFNKLRKQGHEAAKLHRTAHRPWGTYTVLEEGDGFKIKRIEVKPGRRLSLQAHHHRSEHWIVVSGTAKVTNGDREILLTTNQSTYIPCGFRHRLENPGILPLVLIEVQSGEYLGEDDIVRYDDVYGRV

SEQ ID NO: 16774 - protein, 497 aa, Brucella suis 1330
MAKIVESPTGALALTFDDVLLQPGHSEVMPGQVDLRTRIAKDIELNLPLLSAAMDTVTESRLAIAMAQAGGIGVIHRNLSPERQAEEVRQVKKFESGMVVNPVTIGPDATLADAQALMKAHGISGIPVVENATKGPGRLVGILTNRDVRFASDPKQKIYELMTRENLITVHENVNQDEAKRLLHSHRIEKLLVVDDKGRCVGLVTVKDIEKSQLNPNAAKDAQGRLRAAAATSVGADGFERAERLIDAGVDLLVVDTAHGHSQRVLDAVARIKKAYPNVAVLAGNVATTAGTQALIDVGADAVKVGIGPGSICTTRIVAGVGVPQLSAIMSAVEAAQKQNIPVIADGGIKFSGDFAKALAAGAVAAMAGSLLAGTEESPGEVYLHQGRSFKAYRGMGSVGAMARGSADRYFQAEVRDELKLVPEGIEGQVAYKGPISAVLHQLAGGLRASMGYVGAKTLEEFRETATFVRISNAGLRESHSHGVAITRESPNYPGGM

SEQ ID NO: 16775 - protein, 335 aa, Brucella suis 1330
MPKAVLSVIATRPGGPEVLELVPRELPALKRGEMRVRVHAAGVNRPDAMQRAGQYPPPPGVTDVLGLELSGVVLEIAEDVTRFGPGDRIMALVAGGAYSEEAIVQADVCIPVPAGLSMVEAAGIPETYFTVWSNLFQHAGLQPGETVLLHGGTSGIGVTATLLAKAIGARMITTCGSDDKCRASEALGAIASINYRTTDFVEAGRALTEGRGPEVVIDMVGGSYMQRNLQLVAEDGRIAQIAFQQGSEAQMDMGPLLFKRLTLTGSTLRARPLVMKAALARSVEAEVLPLVLNKGARPVIDSVFDLADVQAAHAHLEASAHTGKIILKTAACDAA

SEQ ID NO: 16776 - protein, 476 aa, Brucella suis 1330
MYPNLTLIVGGEERNKGSAGTLCLTDPADGRELTIAPRAGRAEALQAAAAEKGFAEWSALSALERSKIMRRAADIMRERADAAARIMSMEQGKPLAEARGEWLGSADLLDWFAEEGRRVYGRIVPSRAPNIQIQVLKHPIGPVAAFTPWNFPAWNTMQKVAPALGAGCSVVIKPASDTPGTAWLIGKCLLEAGLPPKAVSVIWGTTSELSDALIKAPEFRKVSLTGSTRVGRIVAAQAGEYLKKVTMELGGHGPVIVAADADLDHLIPLAVQWKFRNCGQVCVSPTRFIVEASIHDEFIRRFSEKARELKVGKGVEEGTQMGPLTSQNQLETVLSMVEDALTKGAKIETGGNRIGDTGNFYEPTILSGMTAEMLAMNEEPFGPLALVMRVHSLDEAIAESNRLPVGLGAYLFTSSMTTAHRVQNHLQAGMLGVNHFALALPETPFGGVRDSGFGSEGGLEGIEAYLTTMTVTTMMV

SEQ ID NO: 16777 - protein, 375 aa, Brucella suis 1330
MKFKAAVLDRHGVERPYNQTKPLVIREIELREPKADEVLVKLAASGLCHSDLSVINGDRSRQIPMVLGHEAAGVVEKIGEGVTDLVPGDHVVCVFVPNCGHCQPCAEGRPALCEPGAAANGKGEMLSGGLRLFCDDGDVYHHCGVSAYAEYAVMSRYSIIRIEKDIPLHIAALMGCAVLTGTGSIFNTGLVKPGSRVAIAGLGGVGLAAVMGAVAAGATEIIALDMFDDKLALAEQLGATKTFNVQSEGVVEAVKEYTKGGVDAAFEYAGSGAALAMCYALTKRGGEVVTAGLPNPKNMLSIPAVSLVAEEKSIRGSYLGSGVPTRDIPLFLDLYRKGKLPVEKLLTHRIKLEEINEGFERLAAGKAIRQVVEFN

SEQ ID NO: 16778 - protein, 453 aa, Brucella suis 1330
MNLFTSQFRNSQLLASKAHALIPGGCHTYAKGDDQYPVLAPGFIQRGSGAHVFDVDGHEYIEYGMGNRAVGLGHAYPPVVRAVREALQDGCNFTRPSAIELDCAESFLELIEGAEMVKFCKDGSDATSGALRLARAYTGRDMVACCADHPFFSTDDWFIGTTKMSAGIPASVSALTATFRYNDIASVEALFEDYPGRIAAIIMEPARADEPQDNFLHEAMRIAHENGALFILDEMITGFRWHMRGAQKLYGIVPDLSCFGKALGNGFAISALAGKAEYMRLGGLHHTDFPRVFLLSTTHGAETHAMAAAIATMAIYRDEPVIERLYEQGAKLAAGINEAIAGHRLQDHVRLSGRPCCLTYSTLDGNGMPSQAFRILFLQETIRRGVLMPSLVVSYTHSDADIARTIDAVHGALGIYVRALNDGVESCLVGRPSQVVYRRFNEDPASSCPPPRL

SEQ ID NO: 16779 - protein, 424 aa, Brucella suis 1330
MNPNTSPVWHPFTQHRLEPRPDRIVRTEGAYLFREDGSAVLDMISSWWVITHGHRHPAIMDAIRQASADLDQIIFADFSHQPAEELAKGLIALAPDGLSHVFYSDSGSTAVEVAIKMALGYFYNRGEPRSRIAVLQHSYHGDTIGTMSAGERGVFNAAYGALLFNVETLPFPSPGHEQPMLDRLEDVCRGGDLAALLVEPLVLGAGGMKMYPAHILAAMREITERHGVLLAVDEVMTGWGRTGTLFACEQAGITPDILCTSKGLTGGSLPLAATLCTAAIFDAHYSDDRSKTFFHSSSYTANPIACAAALANLQVWLSEPVTERISALTRMQTERLHRFKDDSRFAGLRQTGTITALELDVPAGGYLSDAGPKLRTFFKQNGVLLRPLGNVIYVMPPYCVTAEELDRTYDVITQGVDMIAGQTR

SEQ ID NO: 16780 - protein, 464 aa, Brucella suis 1330
MSEISCKLLIIGGGPGGYVCGIRAGQLGIDTVLVEKTRLGGTCLNVGCIPSKALIHAADEFHRLTTFAAKSPLGITTQNPAIDFARTLEWKDGIVHRLNSGVAGLLKRSRVRMFQGQARFQDGKTVLVDTDTGRQTIHAENIVIATGSVPVEIQALPFGGNIISSTEALSLEKIPERLAVVGGGYIGLEIGTAFAKLGSRVTVVEATDRILPQYDAELTRPVMARLKTLGVEVLTGTSAKGLSADGKALEIRTQDGAVKAIEADKILVTVGRKPQTDGWGLSEIRLDMDGRFIRIDDRCRTSMRGIYAIGDVTGEPMLTHRAMAQGEMVAEIIAGGKHAWDKRCIPAVCFTDPEIVTVGLSPDEARKAGHNIQTGLFPFQANGRAMTMERDDGIVRVVARADNHVILGIQAVGAGISELSAAFAQAVEMGARLEDIAATIHAHPTLGEGFAEASMKALGHALHV

SEQ ID NO: 16781 - protein, 436 aa, Brucella suis 1330
MNITIEETLDQAGTGSFQRGLLGIFGLVWAADAMQVLAVGFTGAAIAKTFGLTVPQALQTGTLFFLGMLVGAALFGRLADKYGRRRILLITVACDALFGLLSAFAPDFGSLLALRFLTGLAVGGTLPVDYAMMAEFLPAKNRGRWLVMLEGFWAVGTVVIAIAAWATSVAGVEDAWRYIFIVTAAPALIGIWLRFRVPESPMHLLKSGRVEEAKAVINLVLSRNGKPELPPGAKLLAPRLVTNERLLSPNLRQRTLTSLAIWFLVSVSYYGIFTWIPAKLASDGFGFVRGYGFLVVVALAQLPGYALAAYGVEAWGRRKTLIGFLFVSAAACALFTVATSSSVVGASILIMSFALLGTWGALYAFTPELYPTALRASGMGAAGAMARLGGLLAPSAMAVVINQSFYTAVAMFAGLLALAGIIAFFINVETRQRALN

SEQ ID NO: 16782 - protein, 235 aa, Brucella suis 1330
MDKTIGSAAEAVAEIGDGATVMIGGFGGSGAPIELIHALIDKGSKGLTVINNNAGNGRIGIAAMIDAGMVRKMICSFPRSSDPRAFTDRYLAGEIELELVPQSTLAERIRAGGAGIPAFYTPTAYGTELADGKVIAEFDGRPYVQERWLKADFALVKAHLGDSHGNLTYRMAARNFNPLMCMAAAKTIVQVSRIVPLGGIEPENVITPGIFVDRVVEIANPQQEEELIRAGVAYI

SEQ ID NO: 16783 - protein, 430 aa, Brucella suis 1330
MFEKLFKLQEHGTSARTEIIAGVTTFLTMSYIIFVNPDILSTTGMDRNAVFVATCLAAALGSIIMALVANWPIGMAPGMGLNAFFAFTVVGAMGFSWQQALGAVFISGVIFLLLTVTGVRRWLVDGIPHSLRSAIAAGIGMFLALIGLKSAGVVVGNQATLVGMGDLTQSGPLLAIAGFFIIAILDALKVRGAILIGILVITVASIALGISQFGGIFSAPPSLAPTFLQLDIMGALHTGILHVILVFVLVEVFDATGTLIGVAKRGGLIETGKPNNLGRALFADSGAILAGSLIGTSSTTAYVESAAGVQAGGRTGLTALVVGILFLAALFISPLAGSVPAYATAPALVYVACLMMRELTEIEWHEVTEAAPAALTALAIPFTYSIANGLAFGFISYVVMKTFTGKVREIHAATWLVAALFVIRFVFFAE

SEQ ID NO: 16784 - protein, 452 aa, Brucella suis 1330
MNPADEKPYAVISAGSAADIDLAVAAARRAFPAWSETPAEERIAYIRRIAEIYESRLDEMAKTISMEMGAPIKLARESQAAAGLSHTKAFIAACENFEVEEVLSPKYPNQTAVHEPIGVCGLITPWNWPMNQITLKVIPAIAVGCTVVLKPSEIAPMSAMLFAEFVDQAGLPKGVFNLVNGEGPVVGEALSQHPEVDMMSFTGSTRAGTAVSRAAAATVKRVSLELGGKSPNIVFADSDLEKAISRSLAHCFENTSQSCNAPTRMLVERSVYDKAVELAKKAAESTKVGDPAQEGDHIGPLSSSIQFEKVQALIQKGIDEGARLVAGGTGRPEGFTEGDYVKPTVFADVNNNMTIAREEIFGPVLAMIPFDTEEEAIAIANDTPYGLAAYIQTGSPERAKRVARKLRAGMIQINGTSRAPGSPFGGYKQSGNGREGGKWGLEDFMEVKLISG

SEQ ID NO: 16785 - protein, 353 aa, Brucella suis 1330
MTAIRPGSVTFENVTKKFGNFTALPNLSLTVEPGTLVTLLGPSGCGKTTTLRLLAGLEHPTSGRILVGGKDVTNLPANERDVSMVFQSYALFPHMTSLENVAYGLESSGFKKNEARERAEEGLKLVGLGGMGHRLPAELSGGQQQRVAVARALVLEPQVLLLDEPLSNLDARLRRRVRTEIRELQQRLGFTADYVTHDQDEALAVSDTIIVMKEGGIAQKGSPRDLYEAPASAFIADFMGEANVVPCEVISAENGEAVIRVAGLTHRVPARNAQPRPAQLAIRPNAVTLQPQAGGGFSGTVAHSAYLGDHIEYEIETEHGKLFIVDPAVEQSLPLQTDVSIQFKTRGLAIINQ

SEQ ID NO: 16786 - protein, 409 aa, Brucella suis 1330
MDDRCIIIGAGHAGSQAAVSLRQEGYAGEIILINDETDIPYHKPPLSKSYLKAPEKGSLVLRPESAYRDNNIEMLFGAHVDAVSIAERTVTLGDGRVLPWSELVFATGARARIPDVPGVALEGVVTLRRMEDARRIAAMMPDVRNVVIIGGGFIGLEMAHSAIALGKKTVLIEAAPRVLGRSVAAPVSAHVEARSRAADITLLTGLGIASIEGENGRAIGVTAGDGTFFPADLVVIGTGAVPNVELAAKAGLSIDNGIRVDEHMRTSAPHVYAIGDCASYAHFHAGRHVRLESVQNATDQAKHVARTIVGRETPYREVAWFWSDQGDMKLQTAGLSFDADRHVLSGEPEENAFSVFHFKGDRLVAVDSINRPADHMIARRLLAAGISPSEADIMAGMPRLKELLAVVAR

SEQ ID NO: 16787 - protein, 455 aa, Brucella suis 1330
MAGQLTFDELKKAVAEGRIDTVLACIVDMQGRLIGKRFYGQFFVESGYDETHGCNYLLADDIDMEPVPGYEAAGWDKGYGDFVMKPDLSTLRLAPWLEKTAIVLCDVLDHHHDDLSHSPRAVLKKQVQRLHERGYRAYFASELEFYIFDETYKSARAKRWHEMETASPYVQDYVIHLTTREEPVLRAMRNHLADAGIPVENSKGEWGPGQQELNVRYCKALEMADRHVIMKNAMKEIAEAHGKCITFMAKYDYARAGSSSHVHNSIWSADGKEPLFFDPKAPYTMTPLMRSWVAGQIKYATDYTYFLAPYINSYKRFQAGTFAPTKIMWSQDNRTAGFRLCGEGTKGIRIECRIGGADINPYLAFAALIAAGLKGVDEKLELDEPFVGDAYSAVRLKEIPYTLREAAAALKGSAFLKEAFGEDVVNHYTHTAHWEQIEYDRRVTDWELYRGFERY

SEQ ID NO: 16788 - protein, 350 aa, Brucella suis 1330
MPFNEIRLERMSRAFGSHNALKSITLSISKGEFIALLGPSGCGKSTALNCIAGLLATTGGGIYIDEKRIDTLKPEDRGFGMVFQNYALFPHMSVRENVGFGLKMRGTPKSEIRKRVDEAIGMVRLNGQEEKLPGQLSGGQQQRVAIARAIVIEPPLVLMDEPLSNLDAKLRLEMRAEIRRIHNQLGSTTIYVTHDQDEALSLADRIVVLRDGEIRQVGVPSDLYERPDHLDVAEFMGYRNRLSGKVTAIDGERATISIGGSLIAGIARVPLAVGQDVVLAARPDDVATGPASPAALQAKVETIEYRGRDFVGTANMSDGHNLVFHASAHAELGSAVSLTVDPNRALIFPA

SEQ ID NO: 16789 - protein, 484 aa, Brucella suis 1330
MKSTIHSEGAAVSASVANHTPKPPLLSVDDAKALDLPRMTELFTAHLNPGQLHFMKLLGFHKVKVERAEGMYYYDQNGRRILDFFGGFGSLAFGHNHPRIIAARRKFQEELRHEIAIAFMSQYAAALAYDLAACSPGDLDMVFLGSSGSEAMEAAIKVAERAAGPKKPKIVYAENSFHGKTKGVLSITDGGLYRGEFKLVDNTVRVPFGDITAIENAFRSDPEIGTIVLETVQGGGGIIQADAEFWQKLRQLCDRYGVIWVADEVQCGFGRTGKFYAFEHYGVIPDVTALAKSLGGGKAAMAAMIARRDIYMKAYGTPKTAMIHAMATFGGIGEACITAIEAVNILYDEQLIDNSAEVGDYLLERLKELQVRYPGLLKDVRGKGMMVGLEFHDFSQAMPMVLRPMLAMLDDKLKGSLPGFIGSHLLRGHGVLVAFTEYNRNVIRLEPPLICQRAHVDEFIKALDEVLSRGIVKIVKDFIKAQIK

SEQ ID NO: 16790 - protein, 442 aa, Brucella suis 1330
MLTKTNAPSLDNFWMPFTANRQFKAAPRLLASASGMYYTDVDGNQVLDGTAGLWCCNAGHGRKRITEAVERQISTMDFAPIFQMGHNVAFDFAEKLAAIAPGGAEAKLDRVFFTNSGSESVDTALKIAIAYQRAIGQGTRTMVLGREKGYHGVGFGGISVGGLVNNRRVFPQIPADHLRHTLDIEKNAFSKGLPANGIELANDLERLVQLHGAEKIAAVIVEPMSGSAGVILPPKGYLERIRATADKYGILLIFDEVITGFGRLGTPFAVDYFGVVPDLVTTAKGLTNGAIPMGAVFAARKVYDGLMTGPENAIELFHGYTYSGHPVASAAGLATLEIYAEEGLLTRGAGLADYWQEALHSLKGAPNVIDIRNLGLVGAVELASRKDAPGARAYDIFVECFKKGLLIRVTGDVIALSPPLIIEKEQIDTIISVLGDAIKRAA

SEQ ID NO: 16791 - protein, 1023 aa, Brucella suis 1330
MTDLSHPAPEFTTKDAERLAECHFGVSASASPLDSERDCNFRLKVANGSVNGSAGSADWILKIVNASEPRVESEFQTALLQHLVDTNPAAAVPHLKPSLSGDVLASAQGPDGKPHALRMASWLPGTPLAEGKRTKTLLKNLGRALGELDRALQGFIHPGALRDFDWDLRHAGRARERLHFIDKPEDRAVIEHFLARFERNVAPQLPFLRAQVIHNDANDWNVLVDDDDGERIAGLIDFGDAVHTVLIAEVAIACAYSILDMDDPIGAAGALAAGFHEKFPLQAQEIDILFDLIAMRLVTSVTLSASRREKTGDNPYLAISEAPAWRLLHRLDALNPRFATAILRKACGFDAVEGAGAVRTWLDANRGAFAPIVKPHLATLTKALVPYGDAAHVMTVDSAGRRPETATAWWDDFCARNHIQLGLGPWGEKRTVYTDEAFRSRFVEGERRVHHLGLDLFMPAGTPVYTPLAATVRSVEIEAVPLGYGGLIALEHEPEGCPPFITLWGHMAHEAVSRLKPGDRLAAGELVGHMGDMHENGGWTPHLHFQISTDTSLSATEILGVGESAYLDVWADIFPDAAPLAGIPAEAFQQSGRTRAEIISVRKEMLLPNLSISYSDPIKFVRGDGVWLIDNRGRAYLDCFNNVCHLGHAHPEVVEAIARQAAILNTNTRYLHDTIVSYAERLAATLPEGLTVASFACSGSEANSLALRMARTHSGQRDALVLDWAYHGTTQELIDLSPYKYKRKGGKGRPDHVFEATIPDSYRAPESWPLAEHGRRFAESIAEQIEKMKAQGRAPAFFIAESIPSVAGQVFLPEGYLREVYAMVRAAGGVCIADEVQVGFGRVGSHWWAFEMQGVVPDIVTMGKPIGNGYPMSAVVTTREVADSFNNGMEYFNTFGGNPVSCAAGLAVLDVIEHNDLRRNALEIGNYLIAGFRSMQDRFDIIGDVRGQGLFLGIELVMDRKTKEPATAIARKINDGARERGILMGTEGPFDNVLKMRPPMIFTRANADHLLSVLEDSFAAALK

SEQ ID NO: 16792 - protein, 497 aa, Brucella suis 1330
MTQENKMGKHENKAGGASLLHYGNFIAGQWQDAVGGEHITLKNPSDGSDLAPIARGAKADIDLAVVAARSALSGDWGKLTATERGRILHRISEEVLKNIDLLTDLESKDVGKPVTQARADVVALARYLEFYGASADKVHGDTLPYQNGFTVLSIYEPHGVTGHIIPWNYPMQILGRSLGAALAMGNAAVVKPAEEACLTILEFARIAEKAGLPKGALNVVTGFGAEAGAALCEHPDVNHISFTGSVRTGEVVQAAAAKNTVPVTLELGGKSPQIVFADADLDRALPFLVNAGIQNAGQTCSASSRILVERSIYEEVIARMSERYRALKVGPASADLSVGPVVSQRQKAIVDGYLDLAKESGLAIAAQGVLAEGAPEGGAYVLPTLIRDVPADHRLAQEEIFGPVQVILPFDTEEEAIAIANGTHYGLVCGIWTNDGGRQFRLAHAIHSGQVFINNYGAGGGIELPFGGVKKSGHGREKGFEALYGFASLKTISVYHG

SEQ ID NO: 16793 - protein, 466 aa, Brucella suis 1330
MPIEAKPEVRTTFERLRQAWLENRPAYEQRMDDLKRLREAFTMRLDEMAKAISADFGNRSQHETLLAEANIVFAEIDDALHHLKRWMKPKRRKAGWKMWPAKAEIRYVPLGVIGVIAPWNYPVNLALAPLVAAIAAGNHVFLKPSEHTPRTAAFLKSLLADVFPEDRVAVALGDAALSAQFSALPFDHLFFTGSTAVGRKVMAAAAQNLTPVTLELGGKSPAIISENANLKRAARAIATGKFFNAGQTCIAPDYVLVHHSKRDEFVALLRAEMEARYSSPSAEKDRTTIINEAQEMRLAGLLADAGEKSEAIIELLPLTERTRLMPPALVMEPTPDSAIMREEIFGPLLPVISYRLLDDAIAHVLKHDRPLALYCFSDNTAEIDMMLGRIIAGGVCVNDTLYHFSCSDLPFGGVGASGMGQYHGYDGFLTFSKAMPVLTKYAPTASDLIKPPYTGLTERLIRFIVR

SEQ ID NO: 16794 - protein, 480 aa, Brucella suis 1330
MQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDATIMNEEPFGPVALLNRFDALDEALSEANRLNYGLAAYAFTGSSAKAARISSTVRSGMITINHYGLALPEVPFGGINDSGYGTEGGADALEAYQNTKFVSFLQA

SEQ ID NO: 16795 - protein, 401 aa, Brucella suis 1330
MDAQLRERAERVIPNGMWGHQRASSLPQGYPQYFASGKDACVTDVDGNSYIDFMCAWGPIILGHRNPLVDAAALSQIELGDSLNGPTAHAVELAELLVATIPHADWALFQKNGTDATTSCVTIARGTTKRRKVLVAKGAYHGAAPWCTPSLVGVTAEDRVHLIHYVYNDVESLTAAAREAGDDLAAILVSAFKHDLAIPQESPTKEFAQAARALCDAAGAALILDDVRGGFRIDLGGSWRGTGIEPDMAAYSKAIANGYALAAVAGSDRFREAARQAYMTGSFWYGGASMAAAVATIKELRRIDGPALMKHAGERLRSGLDAQAARYGFDLLQTGPAVMPLVQFAGDSDAALGARFCQEALKRGVYLHHKHNMFISCAHTDDVINDALSRTEDAFKAISTK

SEQ ID NO: 16796 - protein, 468 aa, Brucella suis 1330
MKQYTLLIGGEHVATPNHAEVRNPSTGEVVGLMPLASEADLDRAVAAAANAFQTWSRTGDAERAAACRAIANKLSEDAEELARLLTLEQGKTFNGLGSRFELGGAMAWTRHTAELGLPVEVVQDDNEGRVEIHRKPIGVTGSITPWNWPVMIACWHIIPAVRTGNTVVIKPSPLTPLSTIRLVEIINEVLPAGVVNVVTGENSIGAALSAHPGIAKMTFTGSTETGRKIMASAAATLKRLTLELGGNDAGIVLPDADPARIAEGLFWGAFINSGQTCAALKRLYVHDHIYDDVCRHLTEYAANIIIGDGLDEKSVLGPVQNAMQFNKVRELVDDARAKGARIPIGGEAAEGPGYFYPITLVADIDNGTRLVDEEQFGPVLPIIRYSDIDEVIRRANDNPSGLGGSVWSSDVEKARAVALQLECGSVWINKHGAIQPNAPFGGVKQSGIGVEFGTDGLKEFTTIQTVLS

SEQ ID NO: 16797 - protein, 504 aa, Brucella suis 1330
MSKLDDNVAKAKTYLARFEKGVLNRIGGEDVAAADGATFETISPVDLKPLATVALGKAADIDRAARAAKAAFPEWAAMSGDARKKLLHKIADAIVARAEEIAFVECMDTGQSLKFMAKAALRGAENFRFFADRAPEARDGKTLRGPGQVNMTTRVPIGPVGVITPWNTPFMLSTWKIAPALAAGCTVVHKPAEFSPLTARLLVEIAEEAGLPKGVWNLVNGFGEDAGKALTEHPDIKAIGFVGESRTGSLIMKQGADTLKRVHFELGGKNPVVVFADADLERAVDAAVFMIYSLNGERCTSSSRLLVEASIYEKFTALVAEKAKRIKVGHPLDPETVVGPLIHPVHEKKVLEYIEIGRSEGATVAAGGAKFAGPGGGCYVSPTLFTAAHNGMRIAQEEIFGPVLTAIPFKDEAEALALANDVKYGLTGYLWTNDVTRAFRFTDALEAGMIWVNSENVRHLPTPFGGVKNSGIGRDGGDWSFDFYMETKNIAFANAAHAIAKLGG

SEQ ID NO: 16798 - protein, 427 aa, Brucella suis 1330
MSGNQELIARRERLLGRNMSLFYQDPVHLVKGEGVWLWDADGRKYLDCYNNVPHVGHCHPRAVEAICRQASTLNTHTRYLHEGILDYVERLTATFDKSLDAAILTCTGSEANDVALRMAQAVTGKTGIIATDFTYHGNTTAVSQLSTRMPPVGGYGGHVRHVPAPDSYRPLGGKGGEAFAQAWAAEVEKAIASLQESPFGFSGLIIDPFFANEGFPDLPENFLAPAVAAVRKAGGVVIADEVQPGFGRTGGHMWGHQKAGIVPDIVTLGKPMGNGHPVGAVVAGADTLNAFRKAFRYFNTFGGNPVSCAAAMAVLDVLEEEKLQANALEVGAYARQGLEKLAQKHGMIGNVRGSGLFFGAELVLDRAEKTPAAEMATRVVNEMRERGVLMNKLGIHQNATKIRPPMPFSRENADLMLSTLDDVLGGL

SEQ ID NO: 16799 - protein, 452 aa, Brucella suis 1330
MRDSNFLIENNARHLWHPMAHPAEMQANPPRIVNGGEGVEVIDIHGKKVLDAVGGLWNVNLGYSCEPVKKAIRDQLDSLPYYSTFRGTTNSPLIELSYELAEFFKEDGLTRAFFTSGGSDSVETALRLARQFHKINGQPERTKFVSLKKGYHGTHFGGASVNGNANFRRNYEPLLPGVFHLAAPYPYRNPFNMDDPAAIAAAIARQFEDEIAFQGADTIAAFIMEPVLGAGGVIVPHESFMLLMREICDRHGILLIADEVITAFGRTGAWTGSRGWGVKPDMMTTAKAITNGYFPFGAVMISDKVASVFEANKNSLGAIGHGYTYSGHPVGAAAALATLKETARANTAANAGARGVELMAGLNQLKEKHELVGDVRGKGLMAALELVSDREKKSAAAKTVVQKVYDVAYEEGVMVRTSGANVIISPPLVITSADVNRIVSALDAGLSAAKGQ

SEQ ID NO: 16800 - protein, 492 aa, Brucella suis 1330
MQDKIDRLRQQAVPPQSLFINGRWQPAADGNVMAVISPIDGTQLTTIAAATAIDVDRAAAAARHSFEKGTWAKAAPAERRKVLLKIAELIERNALELAVLGVRDNGTEISMALKAEPGSAANSFRYYAEAIDKVYGEIAPTAENILGLVHRAPVGVVGAIVPWNFPMMIGAWKIAPALAAGNSIVLKPAEGASLSLLRLAELCAEAGLPEGVLNVVTGAGPVTGEALGLHPDIDVLAFTGSGFVGRKLLEYSARSNLKRVHLELGGKSPNIVFADAPDLAQAAKVSAYGIFRNSGQVCVAGSRLLVERSIAGEVAEKVSTIAAAIKGGDPLGLTTEAGAISSEAQLRKNLDFAEQALSEGAGLRTGGKRILEETGGFYMQPTVFNVEPGMTLAREEVFGPILSIIPFDNEEDALKIANDSDYGFASAVWTSNLSRAHRMVRGIRAGVVHVNTYGGADNTVPLGGVKQSGNGHDKSLHALDKYIDLKTAWIQL

SEQ ID NO: 16801 - protein, 271 aa, Bifidobacterium longum NCC2705
MRSRTTSTTSPSKAKLTPLVPGKEDPNRPLVELTHVEKHFGALHVLKDINLTVAKGEVLVVVGPSGSGKSTMCRTINRLETIDSGDIRIDGKPLPQEGKELANLRAEVGMVFQSFNLFANKTILENVTLALIKVRHMDKKEAEQLAMDLLARVGVDSQASKMPSQLSGGQQQRVAIARALAMRPKVMLFDEPTSALDPEMVNEVLDVMVELAHEGMTMICVTHEMGFARKAADRIVFMADGQILEENTPDEFFEHPQTDRAKDFLSKILTH

SEQ ID NO: 16802 - protein, 298 aa, Bifidobacterium longum NCC2705
MPQEFVGDEAHRGDMVWSAAVPEELRSQATAVIGNFPVSQASQYTRLEWLQTFSAGVDAYICPGVLPRGTMVTNASGAYGQSVSEHMFATMWALMKNLNRYASNQRDHQWQDEGPVLSPEGGIALIIGVGDIGSHFAQLAQSVGMRTFGVRRHADVPAKGIEKMYGFERLETLLPLADVVAMAVPRSPQTHHLLNADRLGRLKSTAIVINAGRGDAIDPEALADALHNGRLHGAGLDVTEPEPLPAESPLWDEPHCLITPHVAGGNHLEKTSEHIIRIALTNVSRYAKQQELLNLVRY

SEQ ID NO: 16803 - protein, 263 aa, Bifidobacterium longum NCC2705
MTEPETTCKGFEVNHLVKQYANADKPVLDDISFKVEHGSVLVVLGPSGSGKSTLLRTIAGLEPIQGGTISINNQVIDAGKPGTERAGRSDRSSELRTRIGMVFQSYDLFPNKTVLGNITMAPVLVQKRDKSEVEAEAIRLLGRVGLADRKDSWPHELSGGQRQRVAICRALILHPEVLLLDEITAALDPEMVREVLDVVLELAKSGQTMLIVTHEMQFARAIADHIILLDGGRIVEESYDAQAFFEHPQTERAQQFLHTFEFE

SEQ ID NO: 16804 - protein, 491 aa, Bifidobacterium longum NCC2705
MSTTDAPKKPRETDDVPVPATLRKSLKNRHIQLIALGGAIGTGLFYGSSESIALAGPSILLAYLVGGLAIFAIVRALSEMSVEDPKAGAFSYYATRYWSKRAGFISGWNYWFNYILVSMVELSVVGSFVNYWFPAIPTWVSAAVFLVIICAANLLGVSKFGEFEFWFAIIKIVAVIAMIIGGLAVIIFVLPTASGVRASFANWFTVGNGFFPNGLMGQNSDGSWTGLLMALVVVMFSFGGTELIGITAGETEDPKTTIPRATNDIIWRILVFYIGALGVIMAVVPWNTIDGKSSPFVQIFDSVGIHAAAGILNFVCLTAVMSVYNSGLYANSRMLYSLAKQGNAPAYLGKLNSRGVPVAGVLTSAAITAIAVVVVFVWPEFAFNYLMSIATIAGIINWTMIMLTEMKFRKVVAAGGAPEDSELAGLSGQEALDAIHFKLPFAKVTPWVVLAFLALVVVLMCFSTSYRIAVIAGVIWLAILFAAYQLTQAKK

SEQ ID NO: 16805 - protein, 508 aa, Bifidobacterium longum NCC2705
MADTNVNGGTQQATGKLKSVESLDQANEMERGLSNRHVQFIAIGGTIGTGLFLGSGKSISLTGPSIIFVYILVGIIMFFLMRAIGEMMYRDPSQHTFINFITRYLGNGWGHFAGWTYWAALVLLGMTEITAVSTYFITFFDTFGIDLTHWKWLIELCFLVVLVSINLIAVKVFGEVEFWFSMIKITLICAMIATAVVMIVIGYHYPAVQIHGVDHVSPAGHAGFDNLFANFSFAPNGWMAFLMSFQMVFFAYEMIEFVGVTVSETKNPRKVLPKAINEIIVRVLIFYVGALMAIMCIVPWTSFKPNKDGSFASPFIMVFQYAGLNWASALVFFVVITAASSALNSLLYSAGRHLYQLAGESPNPTLNKIGQVSDRKVPARAILVSAVLILLSPIVNAIPGVSGAFVLFSSASSAVFLFIYILTLMAHRKYRRSADFIPDGFVMPAWKVLNTVAIAFFVFIYLTLFLADDTRNSAIAGLVWLVGFGGFSMLRERYRSRDLKVALEHKEI

SEQ ID NO: 16806 - protein, 452 aa, Bifidobacterium longum NCC2705
MQLHHLCRKGLAMVDYSPALMTDMYEYTMLDAALKDGTADRKCVFEVFTRHLPEGRRYGVVAGTGRILDALEHFHLDEADLKFLADRHVVSPETIKWLENFHFSGTIRGYREGEMFFPNSPILQVEGTFGECTLLETLILSVLNYDSAVASAASRMASAAKDRPCMDMGGRRTNEWAAVAAARAAVVGGFKGTANLLAAQLYGLKAIGTAAHCFTLVHDSERDAFESQIEALGKNTTLLVDTYNIEEAVKTAVEVAGPELGGVRIDSGDLAAMAQRVRNQLDALGATNTTITVTNDLDEYALAALQTAPVDSYGVGTMLVTGSGAPTCAMVYKLTEREGADGTMVPVMKKSKDKATVPGRKLAFRSYEYALAEAEHVISGSEEKLAGFTPEPTWKNLLVDFVDHGHIDAQWQGHDAIMAAHDYHAKALSELPITAQSLMKGEPVIPTETQVL

SEQ ID NO: 16807 - protein, 329 aa, Bifidobacterium longum NCC2705
MRKSVKSMLSPLGKAVALACSLAMCVSLAACSSSSSDSKSSSSDSSSSSDSSDKKGQIAGVTAKGKLGEKPTISFNTPMTVSDGSYVVLQKGDGDVIEEGDRVCAQGIALNVKDGTELMDTWTKNTPDCSLKVDSKTLSSTYYNQIKGAKINTTIGFGVNAQDSSGYSYILAMTFVSKSKDLEKATGEEVKDVPANLPKVTRAKNGEPSIDMNGQGSVDSLISQTLIKGNGAKLTDKNTVVVKYTGWLTDGKQFDSSWDRDSTIDADLFSDSSGQHQVIEGWQKGLVGQTVGSQVLLVIPPDQAYGDKEQGPIPANSTLVFVIDILAAY

SEQ ID NO: 16808 - protein, 244 aa, Bifidobacterium longum NCC2705
MDYPLFTKLAAEFFGTAILMIFGNGSVANVELKNTKGHHAGWLNIAMGYGFGVMFPVLMFGSVSGAHINPAMTIAQAVNGLFPWSDVLPYIVAQLLGALLGQLIVYITYYPHYKETEDAEAILGTFCTTDADNQKVNYFLNEMFGTLVLVFGALCCLSLAWGKQDYAAASIVVGFIVWGLVTSMGGPTGPGLNPARDLMPRLLHAILPIPHKGSSRWGEAWIPVVAPIVGAIIGAWLFVFFFAS

SEQ ID NO: 16809 - protein, 484 aa, Bifidobacterium longum NCC2705
MAEATANIGVIGLATMGSNLARNLAHHGNTVALFNRHYSRTEKLMNEHGTEGNFVPAETLEEFAASLKRPRTAIIMVKAGAPTDATIAQLEEVFEPGDIIVDGGNSFFKDTIKREKEVRAKGFHFVGCGVSGGEEGALNGPSLMPGGTAESWKTLGPILQSIAAKVNGEPCVTHIGTDGAGHFVKMVHNGIEYADMQVIGEAYDILRRGLGMDAEEIGDVFAEWNKGDLDSYLIEITAEILHHKDAETGKPFVDVVVDHAGMKGTGTWTVQTGLECGSPVAAIGEAVFARALSSHGELREDAQKEGLAGPNKTIDLAGEDKAAFVEDVRKALFASKVVAYAQGLNEIQDGAKEYGWDINLSEVARIWRGGCIIRAQFLLDRITEAFRGDNPPASLLFDPYFEKIIGESQDAWRRVIVRAVEAGIPTPVFSSSLAYYDGLRSKRLPTALTQSQRDFFGAHTYGRVDKPGVFHTLWAEEGKPEIEA

SEQ ID NO: 16810 - protein, 339 aa, Bifidobacterium longum NCC2705
MAENEWLSKDFYKVLGVSKDASDDDIKKAYRKLARKYHPDVNKTKEAEEKFKDISEAYDVLSKKEDRQKYDAIRQFGMGGARFAGGSGGFDASGFSDIFGSMFGQGAGGNGSRIRFSTSGGGPNNINDIFSMFGGAAGQGGQPYGGYGQSPYGNAGGYGYEEAPRPENGEDRNSKISLTLRQAVKGATVSLSVDGKKFKAHVPAGVKDGQKIKLAGKGKLGINGGKAGDLYLHVTVKPDATFSMRGHDIVMDLPVTVGQAVAGGKVEAKDIDGNPVTFKVPAGSSSGAEVKLTGLGVQRSNQPGDLIGRVQIMVPAKPGLAVKHAAKEFDEKAGDYLSL

SEQ ID NO: 16811 - protein, 483 aa, Bifidobacterium longum NCC2705
MTESVNTELRIAVIGAGPAGVYSSDIFLRQLKKLGEELGLGTEARIDLFEKLPVPFGLVRYGVAPDHPSIKFIASALEKTLDNPNIHLYCDVEFGKDVTLDDLLARYDAVLFATGAVKDKPLNLPGADLEGVYGAAKFVEWYDGYPTGAREWPLTAENVAVIGGGNVAMDVARELMRNADDLKVKTDIPDNVYEGIGQNKAKVLHLFIRRGVAQAKFSVQELREMEKLPGVQLIINEDDFDLDDETIEVAGKDKLTRQMVEELFAIREMAEDMEDDGDVDFEGNPADRKYYVHFNSAPTEILGEDGKVKAIRVERTETGADGKMHRTGEFTDYPVEAVYHAIGYKPAEAPGITYDEHGAHLANANGDGRITTEADGGKVRDRLYATGWAKRGPVGLIGSTKSDALAIVTNMLEDLAKAAEGGRVAADRDPESIDRLLAERGIRPIDFAGWKKVDAFERAEGAKEGREHKKVIEPDQMRELAHA

SEQ ID NO: 16812 - protein, 441 aa, Bifidobacterium longum NCC2705
MTKHRIQSVDECGVLFRNACNMQSGKIGHFDVRFVKERIFMKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAVGAFTIVGGGDSASAVRNLGFPEDGFSHISTGGGASLEFLEGKELPGLKVLE

SEQ ID NO: 16813 - protein, 267 aa, Bifidobacterium longum NCC2705
MASKRIPLVAGNWKMNFDHLEATYFVQKLVWLLRDAHFDFKRCEVALFPSFTSLRSVQVLVEADKLHVAYGAQSVSVTTQGAFTGDVSADMIAHLGCSYVIVGHSERRKYHPEDDANIVDQVRAVLAAGMQPILCVGESFEERRQGIELDFAVGQVRDVTRDLNEEQAAKLIVAYEPVWAIGTGMVATPQSAQDAANAIRNDLKTTFGTKVSDSVRILYGGSVTSKNAAELISQPDVDGFLIGGAALDVEELAKIARLALKSTKSRN

SEQ ID NO: 16814 - protein, 381 aa, Bifidobacterium longum NCC2705
MADYYETLGVERGASDDEIKKAYRKLSRKYHPDIAGPEFEDKFKEVNNAYDVLSNPDKRRMYDSGVDPNNPNAGAGGFSGAGFGDMSDVFSTFFGSAFGGGSQGPVPRTQPGRDALASASIDLKTAVFGGTAHVKINTFSLCQECGGSGAQGGAQPVTCPDCHGQGFMQKVVRTMLGQMMTSAPCERCEGHGTIIQNPCPSCMGHGRVRTTRTVGVTVPAGINDNARLRLANQGEVGEGGGAAGDLYIDIRIKADKQFTRDGDDLHCWIQVPMSWAVLGHDLSIDTFDGEKTVSIPAGCQTEDTVTLKGLGVTNIRNKDERGNLIAHVNVLIPTKLNETERGLIEQFAASHDSGATHVSQASRPQAGQKKGFFSKLKDALS

SEQ ID NO: 16815 - protein, 222 aa, Bifidobacterium longum NCC2705
MSNIAIAPSILSADFCNLERDLKAIANADLVHVDVMDHHFVPNLTLGEPIVGRICQVTDLPVDVHLMIEDPDRWAPEYAKLGAASVSFHMGATHAPVRLARQLREMGCKACFAVRPAEPVEPIFDILDEFDMVLIMTVEPGFGGQKFLDNQMSKVRRLRDEITRRGLKTRIQVDGGVSPKTAHIVAEAGADVLVAGSAVYGAENPAQAIDDIRTKAEAAFKA

SEQ ID NO: 16816 - protein, 291 aa, Bifidobacterium longum NCC2705
MIMTNEATTPSGQPLGISHKPSKSGAMFTKFKAENKPAFIGYLPYGFPNPDVSLDAFKTMVEHGVDAVEIGLPYSDPVMDGPVIQAAASIALNNGETIKRVFEAVETVANAGGVPLIMSYWNLVYHYGVERFARDFENAGGAGLITPDLIPDEAGEWIEASDRHGLDRIFLVSPDSSTERLETVARNARGFVYAAARMGVTGERATIDASPELLVERTRQAGAENVCVGIGVSTAEQGAKVGSYADGVIVGSALVHTLLADDNKTARDPKEGLKLLAAKSEELAEGIHNAR

SEQ ID NO: 16817 - protein, 466 aa, Bifidobacterium longum NCC2705
MAAAGTPKDDTGLERKMESRHLTMISLGGVIGTGLFVSSGYAIHQAGPLGAILAYAAGSLLVYCVMVSLGELSVAMPYAGSFHMYAKRFIGPGTAFTIAILYWLNWAVALASEFTAAGLLMQRWFPHSPSWVWSAVFIVVVFALNIMSVRLYGEAEFWFASIKVFAIIAFIVIGLLAIFGAIPIAGHDSAPLLGNFVAGGWFPSGIAPIFSTLLTVVFAFSGTEVVGVAAGETKDPSRAIPKAVHTTVLRLAIFFIGSILVMAALIPWHQAGVDTSPFVLVFQSIGMPFAGDIMNFVVLTAVLSAANSGLYVCSRMVWSLAKERLIPERFARTNFRGVPVWAVLFSMAGSLLALLSSVIAASTVYLVLVAVSGLATLVVWFSVCVCHIRFRREWARDGHSADELGYRAPGFPVLPWLAIVMCIGALVLVVLDDTQRSTLYCMIPFVACCYAAYYALERQRKRENNA

SEQ ID NO: 16818 - protein, 511 aa, Bifidobacterium longum NCC2705
MGDPRGFLKVRTRRELAERPVEERIKDWFDVHAETGLQPWTQAQAARCMDCGTPFCMTGCPLGNLIPEWNDLVRQGKWEDAYNRLSMTNNFPEVTGRICPALCEQACVLGIHQPPTMIKLDEQTIIDQAWDLDYVKPLPPQRLTDQTVAVVGSGPAGLAAAQQLTRAGHTVVVYEKDDAIGGLMRYGIPNFKLEKGLLDRRVKQMEAEGTRFRTNVEIGKDITWDDLRDRYDAVVVAIGSRVPRDMKIPGRELDGIHFALDFLPDATRRIFGVKPVHDITAKDKHVIVIGGGDTGSDCLGTSIRQGAKDVTVLQIMPKEPSSRPDNSPWPTFARTYQKTSSMEEGGEYIYSTDSVNFEGTEEEKAKVTIDNSTTAEGFVADERGHVTGLKVVSVAPGENGPFTRQPGTERVLPADLVLISVGFLHPDTETILDQLPVELDKRGNIARNDKFATSQDGVFVCGDAGRGQSLVVWAIAEGRSCAAAVDEYLSKEKSELPAPIKASQRPMMLPR

SEQ ID NO: 16819 - protein, 465 aa, Bifidobacterium longum NCC2705
MSLATCSRTAFHADYPGFAPRCAKMDTVSIRRCTVVVSTDSSRTMPDWVKYGVFWHVYPLGFCGADIRPAGPRRFHGRGLDAIIPWLEYVRDLGASGLLLGPVFESATHGYDTLDHMHIDVRLGGDAAFDQLVAACRDMGLQVMLDGVFNHVSRNHPAVQAALDETAGRLNPADNPWHGLVRAHVGDNGEPALDVFEGHGDLVALDHSADETVDYVVHVMSHWLDRGAAGWRLDAAYAVPSPFWARVLPQVKAAHPYSWIFGEVIHGDYPRIIEESTMDSITQYELWKSIQHALETENFFELDWNLKRHNAFLDSFVPQTFIGNHDVTRIASQIGPAKAALALAVLMTVGGVPSIYYGDEQGYVGVKQERFGGDDDVRPKFPGSPAELSTLGEPTYRLHQALIALRRRNPWLLDARTEAVKLENKHFVYRSTSADAQHSLTVDLNIEQSPTFTIRNADGSTAYQW

SEQ ID NO: 16820 - protein, 509 aa, Bifidobacterium longum NCC2705
MSRLALVDWVSANGAIAPRTKLNKNRQAFMRKAKIVDTIGPSTEDYDNLLKLVEAGMDVARLNRSHGTPEDHLKVYNNVRKASEATGRNVAALVDLQGPKIRCGWFKKNADGEDKVQLQLGQEFVITTDDVEGDEHITSTTFKGLPGDCHPGDPILIDDGKVRLEVTKVEGNNVYTKVVVAGPVSSHKGINLPGVAVSLPALTEKDEADLRWAIRTGADIIAMSFVRFATDIDRAHEIMDEEGRRIPIIAKIEKPQALENLEEIVKTFDGVMAARGDMAVECPLEEVPLATKRIIELARQYAKPVIVATEVLGSMVNSPVPTRAEASDCANAILDGSDATMTSNETAVGKYPDVTVATMARISGYATDHGFDRIPELKNLDMSSTGAVSSAAVDLADKLNAKAIVAYTQTGATVHRVSRERPAAPIYGLTSNEHTYHWLALSWGTEAFLLKEDYHDKSRKDLMVYTDKVLKDAGKVADGDKIVILSSAQGDHQPGRTDSIYVHTVGACD

SEQ ID NO: 16821 - protein, 135 aa, Bifidobacterium longum NCC2705
MTDQMPQVNAEFGTTPVIEFPTPEAPKGLKVVELTEGDGPIVRRGDTVTVNYHGVVWGKDTPFDSSFDRHQPASFGIGVGQVIKGWDQTVPGHNVGSRLVVSIPPEYGYGSRGIPQAGIGGEDTLVFVIDIISTR

SEQ ID NO: 16822 - protein, 432 aa, Bifidobacterium longum NCC2705 [sequence omitted]

SEQ ID NO: 16823 - protein, 431 aa, Bifidobacterium longum NCC2705
MATEHEEKLGTEDSKWLGEYSQVHMNVFGTPLRVMDHGQGAHIWDVDGNEYLDFLAGIAVNSLGYAHPKWVKAVADQAAKVAHISNYFASEPQIELASKLVKLAGAPEGSKVYFGNSGAEGNEAALKLAKLYGRTLPGALPSIGGKPARILAMTHGFHGRTMGALSATWKPGIRKPYDPLVPNIEFVRAGDKVALHDAFAQTGLGRYGKGPVAAVILELIQGEAGVQPLGADYVKFVRELCDINHALLIIDEVQTGIGRTGKWFAFQRDDLSGGVTPDMVTFAKGVAGGFPMGGMIAFGEKLAALFTPGSHGSTFAGNPLGAAAGLATLDVIEDENLVANAEARGEQLRDGIMATGNPLFVSVRGRGLLDAVELKHPCSHAVMNYCLEHGLIVNAVAPNALRFAPPLIVTAQDVDQALAILKDVPTDLPDD

SEQ ID NO: 16824 - protein, 496 aa, Bifidobacterium longum NCC2705
MSEQFDLVIIGAGPGGYSTALRAAELGMKVALVERDATVGGTCLNRGCIPSKALITATHTIDTVHRAAELGVNASVNGIDFGTLRDYRLRVVKTMVGGLAGLLAHRGITVFRANAAFHADETAPATSNHIVHLVPSPDQSDILTYHKADVPEPSGPTMDLTATNIVIATGAKPRPLPGNPFAGALIDSTQALEVNEFPSSAVIIGAGAIALEFASMWNAAGSKVTLLIRKDRVLSAWDRRAGTTLTRELKRHGVNIITRASVTHVDTGANLGATVHYTCEGQDGEQSVWGEIALVAIGRDPITDPAWGVTIDDHGHVATDAYGRTDKPGVWAVGDVTAGHALAHRAFEQGIVIAETIAGLNPKPVDEATVPQIVFSFPEAASVGLTVEQAQAREDLIEIKETNYPMLANARMLMSGTAGSLTIVSGCDAANPDTPRVLGVHMVSQMASDIIAEAEQLVGNHVPLADAARLVHPHPTFSETLGEALLKADGRPLHTR

SEQ ID NO: 16825 - protein, 478 aa, Bifidobacterium longum NCC2705
MTELKSKEDVEALINKEGIEYVSVRFTDLIGVQQHFTVPASEFLKDAFTDGMPFDGSSVQGFQAINESDMKLVPDVETSFVDPFRKHKTLDVAFSIVDPLTDEPYSRDPRQVAGKAEAYLKSTGIADTASFAPEAEFFIFDKVRFENGMNRSFYEVDSIEAPWNSGVDVEEDGTPNIGFKNRVKKGYFPVPPIDHTQDLRDDMVANLQKVGLILERSHHEVAGAGQQEINYRFNTLQHAGDDLMKYKYVVHETAALAGKAATFMPKPIADDNGTGMHCHQSLWKDGKPLFYDEKGYAGLSDLARWYIGGLIKHSSSVLAFTNPSLNSYHRLVPGFEAPVNLVYSARNRSAAIRIPLAGTSPAAKRIEFRAPDPSCNPFLAFSAQLMAGLDGILNHIEPPEPVDKDLYELPPEEHAGIKQVPSSLAEAMDALEEDHDFLTAGDVFTDDLIETWIGLKRDEIDQARLSPTPLEYELYFHI

SEQ ID NO: 16826 - protein, 353 aa, Bifidobacterium longum NCC2705
MEKVKAFADWLTKWFTVIVIVWAVFNYFVPAASLWGKAYTGYMLGIVLFGMGLTLTLDDFKRILTQPLMVIVGTVAHFIIMPLIAVALCAIFHLSGPLAVGVILVGCCPSGTSSNVMSYLSRGDVALDVSIGILSTLCAPFMIPLLMQLLASQYVSVPTQSLFLNAVKVVLFPIALGVICHMIFGKKIEKVTVALPIVSQVAILLIIGVVVAANGPKLFVASSLVAIPVVILHNLCGYSLGFGFSKLMYKIYPKGFRYAQQKAITFEVGMQDSALGATLALTSFATNPLAAVPSTFFSVWHNISGSILSSWWRNHDDKHEIHWDSDNGEKGSAKSTVSAAHPFDADKAAKVAA

SEQ ID NO: 16827 - protein, 261 aa, Bifidobacterium longum NCC2705
MSEMTNITTEASDSPVSNKTVLRLDDVRKSFGNTQVLRGISFDIHQHEVVALLGPSGSGKSTLMKCVNLLEQVDDGQIWLGNTDITDPRADQDKIRARIGVVFQQFNLFPHMSVLRNVTLAAIKVHHWSKDRAETRAMELLERIGMRDKASAYPDQLSGGQQQRVAIARALMTDPELLLLDEITSALDPMLVGEVLNMVAELKAQGTTILMATHEMSFAHEAADRIVLLRHGVIAENGTPAEVMDESQDPETIEFFSHFRH

SEQ ID NO: 16828 - protein, 330 aa, Bifidobacterium longum NCC2705
MKAVYASTVNHADPLAALAVGEQPEPQARPFWSTVSVRAVTVNHHDVWSLQGVGLAAEQTPMILGTDAVGILDEDIPGKHGLKAGSEVVLYTFVGTDGAGVAPGERRTILSEKYPGTMAEKTSVPSANVFAKPASLTTAEAAALGTSWLTAYSLLFDAAGIKPGDSVLIQGAGGGVSTAAIQLAHAAGLEVFVTSRDADKRSKALKLGASAALEIGARLPRKVDAVIESVGAATWSHSMKSVRPGGTIAICGATTGDQPGAELTRLFFQDIRVQGCTMGSREDFARLLRFVEHANLHPAIDSVVSGLDAAPEAFAKMIAGDVFGKIVIEL

SEQ ID NO: 16829 - protein, 478 aa, Bifidobacterium longum NCC2705
MDQLVAESTPLKRTMRTFDLTMLGIGAIIGTGIFVLTGKGALTAGPALSVSFLLAAVCCGFAGLCYAEFAAMAPVSGSAYSYAYLAFGELIAFVIGWDLILEYALQAATVSAGWSGYFNKLLEGFGLHLPVELTAAYGTNPDVTTYFNLPGFVIVLIITWVLSIGINQTKRTNDVMVLIKLAIIVLFIACAVWYVKPSNWQPFSPYGVYTFQPGSTQPYGIVPAASIVFFSFIGFDAVSSSAEETINPNKTLPRGILLSLAVSTVLYIVMTMIMTGVVPYQDFAKYIDAPVAGVILETGMNWLAVIVNLGALIGMTTVMLVQLYGQSRICYAMSRDGLFPKFFGHVHEKYRTPFKGTWFFGLLTAFAGGFININVLFELVNIGTLSAFIIVSAGILWMRKTQPNAPRGFRAPGVPVTPILAIVFCFVLIAGLNWETWVRFAIWFGLGLIVYFGYSRKRSKLGLEQKAGADTKVAATED

SEQ ID NO: 16830 - protein, 408 aa, Bifidobacterium longum NCC2705
MVNMKNRFTFRIHRTVSGNTRFSNQSHSPFVWERRFTNATQQNPHNPSNEGLHMTIHNSLAELIGNTPLVKLNHIPQAAGVKATIAVKVEYFNPGGSSKDRIAERIIDAAEQSGQLKPGGVIVEPTSGNTGVGLALVAQQRGYRTIFTLPDKVSESKRAVLRAYGAEVIVTPTDAGPDDPRSYYQVAERLANTIPGGFRPNQYDNPNGPLSHYYTTGPEIWEATDHKVTHFVAGIGTGGTISGTGKYLKEASNGAVKVIGSDPEGSIYSASSRDEVHQYDIEGVGEDFYPKAFDRNITDDIVRVSDAEAFEMTRRLAGEEALLVGGSSGMAVASAIKYALANDLDENQIVVVLAPDSGRSYLEKIFNDDWMRANGYGDIVERTSKPSLAEQYLNGAPSDEGAGDGLHN

SEQ ID NO: 16831 - protein, 371 aa, Bifidobacterium longum NCC2705
MSKADKKVSKDRPGLFAPMTLREVTVRNRIWLPPMCTYSSFARDGRPTPFHYQHYVSRAFGGFGMVIVESTAVAPEGRITPCDLGLWEDGQIDAWRWIVDGIREAGAVPAIQLNHAGRKASTGCFAVGYDGQSVPEEAGGWPTMAPSEIAFGGLRTPRALSVDEIHGLVGAFAAAAGRAVAAGFQAIQIHAAHGYLISQFLDPLSNERDDEYGGDLTGRSRFLVEVVDAVRGAVPEGVPVLVRISATDWAAGGWDLDQTIALSKVLKEHGVDVMDVSTGGIMSGVSIPVKPNYQVPFSEQVKAKADIPVTAVGLITKPKQAAKILAHGEADAVEIGRAALRDPYWPLRAANKLGIPSTEIPYAPQYVAGAY

SEQ ID NO: 16832 - protein, 448 aa, Bifidobacterium longum NCC2705
MTTVAVIGCTHAGTFATTSILAEHPDWTVHVFERNGTLSFLSCGIALWVGGHVSDPKKMFYSSPAALAEAGATMHMRTDVTSVDLDARTLTYRALDEAGDPAEQTLAFDKLVVTTGSRPVIPPIPGIDSPHVLLCKNWDHAIAIKEKAKTAKSAVVIGSGYIGAEIAEQFSVTGVKTTLVDGLDRPLANNFDKTITDQVAAAFEEHGVTLALGQKVVEFRDNDDDTVTVVTEKGEYTAEMAILAVGFLPNTDLLKGKVDMLPNGAIVVDDYMQASAPGVYAAGDSATVFYNPTGQHDYIPLATNAVRQGLLVGRNIETPTVKYMGTQATSAVQLYDLSLAASGLTRAGAERRGLTVRETSLTEDYRPDFMLTTTPVTSILTWDPETRKVKGGQFCSKADISGAANVISMAIQAGFTIDQLANVDFLFQPNFDKPVYYVGAVAMKAAAE

SEQ ID NO: 16833 - protein, 445 aa, Bifidobacterium longum NCC2705
MDKQQEFALRTVEERDVRFIRLWFTDVLGTLKSVAIAPAELEAAFEEGLGFDGSAIEGMTRVSEDDMIVQPDPSTFQILPWRGGPQGTARMFCDILTPDGEPSLGDPRHVLKRTLAKAKDKGFTFYVHPEIEFYLFESQDDWSKAPTPIDEGGYFDHVPRSPGMDFRRATVNMLEQMGISVEYSHHEAGPGQNEIDLRYADALTMADNIMTFRTVVKEISLERGIHASFMPKPLADAPGSGMHTHLSLFEGDSNAFYEAGQEFNMSLTARQFAAGILYHAAEICAVTDQYVNSYKRLWGGNEAPSYICWGHNNRSALLRIPQYKPGKGNSARMEFRALDPVANPYLAYSVLLAAGLDGIDKQMQLGEPTSDDVWELTDGERQAMGIQPLPRSLDEALKIMEKSDFVADVLGEHAFGYFLDNKHQEWEEYNQQVTPYELKKYLPKL

SEQ ID NO: 16834 - protein, 399 aa, Bifidobacterium longum NCC2705
MPKALLLENIHPDAAKSLRDHGFEVETMKGALSEDELIDALDGVDLVGVRSKTNVTARVLDARPTLSAIGCFCIGTNQVDLAHAGKRGIAVFNAPYSNTRSVVELVICDIICLMRRIPAHTHHIKHGLWDKSASGSHEVRGKTLGIIGYGNIGSQLSVLAEALGMRVVFYDIEEKLALGNAHRCDTLNELLEQSDAVTLHVDGRKSNTGFFGEDQFAHMKQDAIFINLSRGFVADLGALKQHLDSGHLSGAAVDVFPVEPKKSGDPFETSLANEDNMILTPHIGGSTLEAQESIGHFVSQRLEDYWFKGSTSLSVNLPQINLGECKGVCRIAHLHDNLPGVLAHVNHVLGEENINVSFQSLATEGELGYVVTDVAQTPSAATLEALRNIEGTIRMRVIS

SEQ ID NO: 16835 - protein, 298 aa, Bifidobacterium longum NCC2705
MTTPIVLSLGELLWDMLPSGKRAGGAPVNFAYHAMKNGTEGWAISAVGEDELGDELIAKANEAGINTVIQRNAWPTSTVEVALKNGIPEYTIVKGVAWDHILYTRQLIDVVSKADAVCFGTLALRSPESHATITELLKHTKPGAMKFFDINLRGDHYSKDLIEELLKAATVFKINDEELLLLRDMFDIRGTSGEDASRWFIEEFGLDYVILTAGSAYSTIISRKGEVSTLDTPHVEVNDTVGAGDSFSGTFTARILLGDTLAEAHRKAVNTAAYVCTQAGAWPQYPAEMPDYLAEIGK

SEQ ID NO: 16836 - protein, 449 aa, Bifidobacterium longum NCC2705
MSTTTPAQPAQLTRNERLDRLPFNKAHRKLLVASGIGWAFDAMDVGLVSFVVAAIAADPHFNLTPTEKSWVLSIGFVGMAIGAAVGGFIADRVGRKTVFTATLIIFGIANGAMALSWSLGMLLGARLIIGLGLGAELPVASTLVSEFSPTKQRGRMTVLLESFWAVGWIVAAMIGYFVIPNTGDWGWRWALAIGALPLLYAIVTRVHIPESVRFLEAKGREDEAEKAVRYFEEAGGVAPVTSPKGKPLPKIKTRELFGSKYLARTIAIWATWFFVNFSYYGAFTWMPSLLADQFGSLTKSFGYTLAISIAQLPGYFLAAWLVEVWGRRKTLSIFLAVSAVAAFAFSQAGSVALVLVFGMLLSASNLGAWGVLYAVTPEIYPTRLRGAAAGAAAAVGRIAAIIAPLLMPWFLTLSGGNKAVAFIIFAAAFIIACVAALCLPERKGLDLED

SEQ ID NO: 16837 - protein, 374 aa, Bifidobacterium longum NCC2705
MSQEIEIGLGKKGRLGYALDDVAIVPSRRTRDPEDVSTSWQIDAYEFDVPVIGAPMDSVTSPATAIAMGKMGALGVLDLEGLWTRYEDPTPLLDEIAGLPADQATERIQQIYAEPVKPELITQRLHEIRAAGVTVAGALSPQRTQQFYSTVVDAGVDLFVIRGTVVSAEHVSSGQEPLNLKKFIYDLDVPVIVGGASNYTAALHLMRTGAAGVLVGFGGGAVSATRQTIGVQAPMATAIADVAEARRDYMDESGGRYVQVIADGGMGDSGSFVKALALGADAVMLGAPLARATEAPGKGTHWGSEARHQTLPRGYRTTVGTVGPLEQVLFGPSHQADGKTNFIGALKRAMASTGYVDVKNFQRCGMVVNPYSAR

SEQ ID NO: 16838 - protein, 464 aa, Bifidobacterium longum NCC2705
MEKFFHLKENGTTVSTEILAGLTTFFAMAYIIVVNPQILSQTGMPWGGVFLATIIAAIIGTLVMGLFANVPYAQAAGMGLNAFFTYTVCFGLGFSWQQTMCMVFLCGLINILITVTKIRKMIILAIPESLQHAIGGGIGLFVAYVGMLNVGLIKFTPGDPKAAAKGGAVAATPGLANFNDKVLWVFLIGLVLAIVFTVMKVKGGMLLAIAITTVIGIPFGVTTWSNSQSISETFSQLPQTFGAIFSAEGFPALFSDPTKLPLVIVTIFAFSMSDTFDTLGTFIGTGRRTGIFSAEDEKALENGHGFSSKMDKALFADSIATSIGAICGTSNTTTYVESSAGIAAGGRTGLTSVVVAICFALSAFLAPVVSAVPSAATAGVLVIVGCMMAASLKEVKWDDIAEAIPAFFAAVFMAFSYSISYGIAGGFIMYCIVKTCKGKAKEVHPIIWTVAALFILDFVCMAIL

SEQ ID NO: 16839 - protein, 508 aa, Bifidobacterium longum NCC2705
MQLFRTKSVEQTIAETGEEGRKLKRNLTWWDLSIMGVAVAVGAGIFSVGAQAAAFHAGPAVIISFLIAGIVCGAAVMCYAEFASMIPVAGSAYTFTYTTVGEIMAWIIGWDLILEMLMAGSVISKYWGVYLNDFMRLMGWNANTNLTFGSFHIDIAPIIIVAFFTTLLVFGTKIGARVDGAMTVLKIAIVFFVVIVGFFYVKASNFTPFIPPSQPASTVEGSSAVTGVMTQPLWQFATGMTPSVYGVPGILSGAALVFFAFIGFDVVATASEETKNPHKNVPLGIGVGMLLIIVMYMLVAVVTTGMVSYADLAKQDSPSLATAFELVGADWAAKIISFGIVLGLATVVMVLLLGLTRIVFAMSRDGLLPRGLSKTGKHGTPAALQIVVGAVVALVAAFFDIGVLSDMVNIGTLSAFTLVAISIPIMRKKRPDLPRAFKMPGSPWIPILIAVANFWLMLNLSVLTWIRFVVWLVVGFAIYFGYGYWHARLGKGDLTETLSAETDKAVNG

SEQ ID NO: 16840 - protein, 186 aa, Bifidobacterium longum NCC2705 [sequence omitted]

SEQ ID NO: 16841 - protein, 512 aa, Bifidobacterium longum NCC2705
MAKSSVQYVCSECGWNGPKWYGRCPECGQWGTVEEFHEARPAAGSRTAAPGRTSRTQSVTVANNARSAARPITEVGTESVERLGTGFSEFDRVLGGGVVPGSVTLIAGEPGIGKSTLLLQTAGNIARVVAGDSTFRGAGQRSAQQSGRAQGNASNTVPMRGNASSTHANTVLYISGEESQAQVRLRASRINAVEPNLLLASTTDLSTVLGLIEQNKPALAIVDSAQTIVSQEVDGISGGSTQVREVASALIDTAKTLDIPVFLVGHVTKDGSIAGPRTLEHLVDVVCQFEGDSETALRMLRAVKNRFGPTDEVGCFDMSGEGIEEVTDPAGLFLSGDGPDAANAAPVEGTCVTFTLDGHRSLPIEVQALVTTSVLPTPRRAVNGVDPSRIAMLVAVLYRHSKLNLLSNDLYISTIAGGQAKEPGSDLAIVAALASAATSKPIARATCAIGEISLTGQVRPVPRMEYRLREAARLGFTTAVIPPLRKPVHVEGLQLVESNTLSDALDALGVRK

SEQ ID NO: 16842 - protein, 256 aa, Bifidobacterium longum NCC2705
MGARGCRLNRMTYKLVLLRHGQSAWNKTNQFTGWVDVPLTEQGEAEAKRGGELLKEKNVLPDIVFTSLLRRAINTANIALDAADRLWIPVQRDWRLNERHYGALQGKNKTEIREEYGDEKFMLWRRSYATPPPEIDPNDQYAQNNDPRYAGDPVPEAECLANVVERVKPYFESAIEPELKAGKTVLIAAHGNSLRAIVKMLDNLSEEEIAKVNIPTAIPLLYELDENFKPIKPRGEYLDPEAAAAGAAAVAAQGQK

SEQ ID NO: 16843 - protein, 187 aa, Bifidobacterium longum NCC2705
MRIADVEEDIDHELVSKEQIDAKIHEMAALASEDYRDKNPLLVAVLKGAVNTLVAFTEAMSIPVQIDFMSLSSYGSGTVSSGEVTVRQDLSADVRGRHILIVEDIVDSGRTLAWLVAELKRRGAASVEVFALLSKPSRREVDVDVKYAGYEIPDEFVVGFGLDFDERYRNLDSIAVLKPSVYQGVQA

SEQ ID NO: 16844 - protein, 400 aa, Haemophilus somnus 129PT
MDISMSNTTSFTTSTIHAGRNKRVCKNAVNPVIQRASSLVFDTLADKKQATINRAKGGLFYGRRGTLTHFALQELMCELEGGEGCYLYPCGAAAVSNAILAFVKTGDHVLMSGAAYEPTQEFCHIILKKMSITTTFYDPLIGEKIADLVQPNTTVLFLEAPSSLTMEMPDIVSIVQAARQINPKIVVMIDNTWSAGVFFKALDFGVDISIQAGTKYLIGHSDAMIGTAVANARCWEQLRENSYLMGQMVDADTAYMTARGIRTLLVRLKQHQENGIKVAKWLLEQPEVKTVYHPALPSCPGHQYFKRYFTGFSGLFSFELNKKLSQQALENFMDHFKIFTMAYSWGGFESLILCTQPEEIARIRPNIERKLTGTLIRLHIGLEDVDDLIADLKAGFERLK

SEQ ID NO: 16845 - protein, 472 aa, Haemophilus somnus 129PT
MSNTTAITNVFKLIEENDIKFVLLRFTDVKGKEHGVSLPVSLVDEDLFEDGKMFDGSSVEGWKAINKADMLLMPIAETAVVDPFAQIPTLSIRCSIFEPTTMQSYDRDPRSIAMRAENYMRSTGVADDVFFGPEPEFFLFDDVRFDVSMNGNSYTVDDIEAAWNTNKHYEGGNKAYRPLKKGGYCAVAPNDVAHDIRSEMCLLMEEMGLVIEAHHHEVATAGQNEIATKFNTLTLKADETQIYKYIVQNVAYEHGKTACFMPKPIINDNGSGMHCNMSLSKDGKNIFQGDKYAGLSETALYFIGGIIKHAKALNAFTNPSTNSYKRLVPGFEAPVLLAYSASNRSASIRIPAVTNPKAIRIEARFPDPLANPYLAFSALLMAGLDGIQNKLYPGDAMDKNLYDLPPEELKDIPAVASSLSEALDNLEKDYEFLTHGKVFSKEFIDTFIAMKRKEVERLNMTPHPVEFEMYYA

SEQ ID NO: 16846 - protein, 481 aa, Haemophilus somnus 129PT
MNIQHLLKTQAYINGEFISAKNHRTFPVINPANQQVICEIACCGKEETELAIKSAKQAQVHWKKYTAKERSKILKKWFELIMQHQESLAYLLSLEQGKPLSESRAEIAYGASFVEWFAEEAKRAYGEIIPQVREDHRLLVIKQPVGVVAAITPWNFPNAMITRKAAPALAAGCAIIIKPAPETPLSALALAALAEQAGIPKGIFNVLPTVYAEEVGSVLTRSTDVRKLTFTGSTKIGKILMQQCADTVKKISLELGGNAPSLIFNDADLDRTVDSVIASKFRNSGQTCICTNRIYVQSEIYRAFADKLKQKVRSFIVGDFQQEAVNIGPLINESAVRKIERHIEDALSKGAILTLGGQRHSLGGTFFEPTILENVSQDMLVCHEETFSPLAALIPFDTEEQAISMANDSEFGLAAYVYTQDFSRIWRLSEELECGLVGVNEGIISNEVSPFGGVKQSGLGREGSRHGLDEFLEMKYLCMKV

SEQ ID NO: 16847 - protein, 316 aa, Haemophilus somnus 129PT
MTIYADNSYSIGNTPLVRLKNFGNNGNIIAKIEGRNPSFSVKCRIGANMVWQAEKDGILTKDKEIIDATSGNTGIALAYVAAARGYKITLTMPETMSSERKRLLRGLGVNLVLTEGVNGMKGAIAKAEEIVASNPNHYVMLKQFENPANPAIHQQTTGPEIWSGTEGKIDVLVAGVGTGGTISGISRYIKQDQGKKIITVAVEPEESPVITQTLAGEETKPGPHKIQGIGAGFIPKNLDLSLVDQVEKVSSETAIITARRLMAEEGILGGISSGAALAVADRIAQRPEFSDKLIVVILPSASERYLSTALFDGFEG

SEQ ID NO: 16848 - protein, 385 aa, Haemophilus somnus 129PT
MSLDLSEIRQQITQIDRSLLKLLSERHRLAFDVVRSKEISQKALRDVEREQQLLKELVQFAENENYQLEPQYITQIFQKIIEDSVLTQQVYLQKKLNEQREKNIHIAFLGKRGSYSHLAARNYATRYQEQLIELSCASFDEVFSSVQNEEASYGILPLENTTSGAINEVYDLLQHTDLSLVGELAYPIKHCVLVNAQDDLDKIDTLYSHPQVIQQCSQFIRTLARVHIEYCESSSHAMQLVASLNKPNIAALGNEDGGNLYGLKVLKSGIANQENNITRFIVLAKNPIAVSPQIHTKTLLLMSTAQKAGALVDALLVFKKYNINMTKLESRPIYGKPWEEMFYLEIEANINNPIAQQAFTELKAFSNYLKILGCYPSEIVKPAEV

SEQ ID NO: 16849 - protein, 172 aa, Haemophilus somnus 129PT
MINPFALFDLEIDFNLDQQILSQRYLTLQKSLHPDNFAHRSAQEQRLALQKSAEINDALQILKDPISRADSIINLHLGEQNIEQKTNQDMMFLMQQMEWRERLEQVEQQQNMDKLLHFSQEVECVQRDILAELQEFLAQQNWQQAQLLNDRLRFIKKLFVEIERVEEQLAGF

SEQ ID NO: 16850 - protein, 169 aa, Haemophilus somnus 129PT
MITLHTNFGDIKLALNFEKAPITAENFLTYCKEGFYNNTIFHRVIDGFMIQGGGMESGLREKNTKAPIKNEASNGLSNKRGTIAMARTSDPHSATAQFFINVADNTFLDYRAKEMFGKTVVQEWGYAVFGEVVEGMDIVDKIKGVKTGNKSFHQDVPVEDVIITSVTIE

SEQ ID NO: 16851 - protein, 317 aa, Haemophilus somnus 129PT
MSKTLTVLGSINADHVISVPHFAKPGETLSGKQYHIAYGGKGANQAVAAARLADFSQGATVNFVGCIGSDDIGQAMKKAFAQDGINVATITEIPNEMTGIAMIQVADSGENSIVISAGANAYLTPEIVDKFATEIERADYLLMQLETPLNAILEAAKLAKKHGATVVLNPAPASQLPDELLSLLDMITPNETETEILTGVKVTDEQSAAKAASVLHQKGVATVLITLGSKGVYVSRKSSTQELGQNKVIAGFRVNAVDTTAAGDTFNGAFLTALLENKSLDEAIRFAHAAAAISVTRQGAQPSIPTRRETLDFLAQH

SEQ ID NO: 16852 - protein, 166 aa, Haemophilus somnus 129PT
MYIDTAELCDIYLDQIDVVEPIFSSFGGKSTFFGKITTIKCFENNGLISEILEENGEGRVLLIDGGGAVRRALIDANLAQLAADNGWEGIIVYGAIRQLQQLENINIGIQALAPIPVGSDEQSIGETDVPVNFGGVTFFPDDYVYADLTGIILSQEPLDLEEFDSL

SEQ ID NO: 16853 - protein, 436 aa, Haemophilus somnus 129PT
MENQSFLQKYFKFNQKNTTTKTEIIAGITTFFTMVYIVFVNPSILGDAGMDKQVVFVTTCLIAGFGTIAMGLFSNLPIALAPAMGLNAFFAYVVVGKLGYSWEIGMGTIFWGSVGLLLLTVFQIRYWLMASIPLSLRVGIGAGIGFFIALIGFKNMGLVVPNPVTLVSLGDLHSSQVLMGVLGFFIIVVLAARNIYSGVLVSIVTITALALIFDENVVFNGVISMPPSLNTVVGKVDVLGALDTALLGIIFSFLLVNLFDSSGTLLGVTDKAGFSDAQGRFPKMKQALYVDSISAVTGSYIGTSAISTYIESGAGVSVGGRTGMTAVVVGILFLLTIFFSPLAGMVPAYATAGALVYVGILMASSLIRVEWDDLTEATPAFITAAMMPFTYSITEGIAFGFISYCVMKTCTGRWKEINAPVWVVSLLFVAKFVWVG

SEQ ID NO: 16854 - protein, 464 aa, Haemophilus somnus 129PT
MKLTRFQQYHTEAKKLIAIATPILLAQVAQNSMGLVDTIMAGRVSAADMAAVAVGASIWLPLVLFGHGLLLALPPTISYLNGSGQRDHIAHQIRQGLWIVFISCIPLGLLIYNSDFVIQYMKMEEKLANITIGYLRAMLWGLPGYLLLINFRCLNDGIAKTKPAMVITFFGLLCNIPLNYIFIYGKLGIPAFGAVGCGIATAIVNWIMCLMMIVYSKHARNQRDLKVFEHLFEKPDTKTLAKLFRLGLPIAVSLCCEVALFALTSLLLSPLGTQVVASHQIALNTSSFAFMLPMSLGMATTILVGQRLGEGKIDNAKQISFSALTVGLSIAFLTASIIFFFRYEIAAIFVNDKEVIAISSSLLMIVALYQFSDTAQVVSSGALRGYKDTQAILYITLFCYWGIGMPLGFSLSRTDWIIPSIGAAGFWVSFVVSLTIAAILLLWRMYKIQQQPAPILLAKLDKLK

SEQ ID NO: 16855 - protein, 458 aa, Haemophilus somnus 129PT
MAKSPKTAYVCNDCGAEFARWQGQCSACKAWNTISEVRLVSTAKVKNDRFSGYAGETKAKIQTLAEISLQETPRFTSGFRELDRVLGGGIVPGSAILIGGHPGAGKSTLLLQVMCGLAQSMTALYITGEESLQQVAMRANRLGLPTDRLQLLSETSIEQICHLADQLKPQIIVIDSIQVMHLSDIQSSPGSVAQVRECAAFLTRYAKTRQVAIIMVGHVTKDGTLAGPKVLEHAIDASLLLEGESDSRYRTLRSHKNRFGAVNELGVFAMTEQGLREVKNPSAIFLSRGDEQTSGSSVMVVWEGTRPLLVEIQALVDHSMLANPRRVVVGLEHNRLALLLAVLHRHGGLQMSDQDIFVNVVGGVKVTETSADLALLLALISSFRNRPLPQDLVVFGEVGLAGEIRPVPSGQERISEAAKHGFKRAIVPFANKPKSAVENMQVFTVKKLADALAILDNF

SEQ ID NO: 16856 - protein, 373 aa, Haemophilus somnus 129PT
MAKRDYYEILGVQKGADDKEIKRAYKRLAMKYHPDRTKGDKESEEKFKEINEAYEVLADKEKRAMYDQYGHAAFEQGGGAGGFGGFSGADFGDIFGDMFGDIFGGGRSRQRVVRGEDLRYDIEISLEEAVKGCKKDIQINTLVHCGTCHGSGAEAGSKIESCPTCHGAGRVRRQQSFFVTEQTCPHCHGTGKKIEKPCHTCHGEGRVHKTQNLTVTIPMGVDTGNQLRLAGKGAAGENGAPAGDLYVVIHVKKHHIFERDGNNLYCEVPISFTMAALGGEVEIPTLDGRLKVKIPAETQTGKLLRLRGKGITSRGYAGDLICEIVIETPIKLNEEQKELLRKLEESLEGKTLQRPKSSGFLDGVKKFFDNLGK

SEQ ID NO: 16857 - protein, 432 aa, Haemophilus somnus 129PT
MTTSATLFSRAQQVIPGGVNSPVRAFKGVGGTPVFIEKANGAYIFDTEGKQYIDYVGSWGPMILGHNHPSILSAVLKTAENGLSFGTPTPLEIELAELICQLVPSIEMVRMVNSGTEATMSAIRLARGYTKRDKILKFEGCYHGHSDSLLVKAGSGSLTLGQPSSPGVPEDFAKHTITCEYNNLQSVKNAFEQYPDQIACVIVEPVAGNMNCILPKQDFLQGLRQLCNEYGSLFIIDEVMTGFRVALGGAQSYYEVTPDLTTLGKVIGGGMPVGAFGGKKEIMQYIAPTGPVYQAGTLSGNPIAMSAGIACLNELKKEGNEQRLAMLTKKLALGLKNLANQHNIPLVVNYVGGMFGIFFTTQNEVTSYQQAIQCDVEKFNLFFHKMLEQGVYLAPSAFEAGFMSLAHTDADIDRTLQAADIAFASLCSSSFS

SEQ ID NO: 16858 - protein, 456 aa, Haemophilus somnus 129PT
MTKHYDYIAIGGGSGGIASINRAASYGKKCAIIEAKYLGGTCVNVGCVPKKVMFYGAQVAEAITKYAPDYGFDVTLNHFDFAKLVESRQAYIDRIHTSYNNVLAKNNVDVLNGFAKFFDAKTIEVSYANGEKELVTADHILIATGGRPSRPTIPGAEYGIDSDVFFALTELPKRIAVVGAGYIAVELAGVVNSLGAETHLFVRRQTPIRSFDPLIIETLVEVMKQDGIQLHTQAIPQEIIKNADNSLTIKLEDGRTQDVDCLIWAIGREPATDVINLASTGVETNERGFIKVDKYQNTNVEGIYAVGDIIEGGIELTPVAVAAGRRLSERLFNNKPDEHLDYHLVPTVVFSHPTIGTVGLTEPKAIEQYGAEAVKVYTSSFTPMYSAVTSHRQPCRMKLVCVGKEEKIVGLHAIGFGVDEMIQGFAVAIKMGATKADFDNTVAIHPTGSEEFVTMR

SEQ ID NO: 16859 - protein, 474 aa, Haemophilus somnus 129PT
MNKEIKTQVVVLGAGPAGYSAAFRCADLGLETVIVERFSTLGGVCLNVGCIPSKALLHVAKVIEEAKSLSAHGIVFGEPTTDIDKIRGWKEKVINQLTSGLAGMAKQRKVQVVNGYGKFSGPNAIIVAGDEGETKITFDNAIIAAGSRPIQLPFIPHEDPRIWDSTDALKLKEVPENLLIMGGGIIGLEMGTVYHALGSKIDVVEMFDQVIPAADKDMVQIYTKRIEKKFNLLLETKVTAVEAKEDGIYVSMEGKAASETRRYDAVLVAIGRVPNGKLIDAGIAGVEVDDRGFIRTDKQMRTNVPHIFAIGDVVGQPMLAHKGVHEGHVAAEVIAGQKHYFDPKVIPSIAYTEPEVAWVGKTEKECKAEGINYEVAKFPWAASGRAIASDCADGMTKLIFDKDTHRVIGGAIVGTNGGELLGEIGLAIEMGCDAEDLALTIHAHPTLHESVGLAAEVFEGSITDLPNPKAKKKK

SEQ ID NO: 16860 - protein, 479 aa, Haemophilus somnus 129PT
MSRRLRRTKIVCTLGPSTDRGNNLEKIIVAGANVVRMNFSHGTPEDHLARAEKVREIAKKLGKTVAILGDLQGPKIRVSTFKEGKIFLNIGDNFTLDADLPKGEGNQEAVGLDYKTLPQDVVPGDILLLDDGRVQLKVLSTDNTKVFTEVIVGGPLSNNKGINKLGGGLSANALTEKDKEDIILAARIGVDYLAVSFPRSSADLNYARELAQQAGLKAKIVAKVERAETVIDEEAMDDIILASDVIMVARGDLGVEIGDPELVGIQKKLIRRSRQLNRVVITATQMMESMISNPMPTRAEVMDVANAVLDGTDAVMLSAETAAGQYPSETVSAMAKVCLGAEKMPSVNISRHRLDKEFDTIEETIAMSTMFAANHMKGVAAIIAMTSSGHTAKLMSRISSGLPIFALSRNESTLNLCALYRGVIPIHFDQDSRTLEGLKAAIQSLKDKGYLVSGDLVLLTQGDHLTSNGTSTCRALVVE

SEQ ID NO: 16861 - protein, 369 aa, Haemophilus somnus 129PT
MTQQYALDTLLAQTGNRTDERTGAVSTPIFLSTAYGHHGIGESTGFDYTRTKNPTRTVLEETIAKLEGGDRGFACSSGMAAIQLLMNLFASPDEWIVSSDVYGGTYRLLDFAHKNIHGVKPVYVNTASSEEIEKAITENTKAIFVETPSNPLMEECDVAEIAKIAKKYKLLLIVDNTFLTPVLFRPMEHGADIVIHSGTKYIAGHNDTLVGLIVAKGQEICNRLYYIQNGAGPVLSPFDSWLTIRGMKTLALRMERHQKNAQELANFLREQPQVKDVLYPNKGGMLSFRLQNENWVNPFLKAMKLITFAESLGGTESFITYPATQTHMDIPEVERVARGVCNRLLRFSVGLENVEDIKADLLQAFSQLK

SEQ ID NO: 16862 - protein, 210 aa, Haemophilus somnus 129PT
MTKQFFAQVALDDVSAQGSYGIGLQIGQQLVDSKLAVKAEAVAKGIYDALNQNPPALELNEVAKALQELQQQASEIAQAQFKQIEEEGKKYLEENAKKDCVKVTETGLQYEVLVEGNGAIPTRQDQVRVHYTGTLIDGTVFDSSVNRGQPAEFPVSGVIAGWIEALSMMPLGSKWKLTIPHHLAYGERGAGASIPPFSTLVFEVELLDIL

SEQ ID NO: 16863 - protein, 454 aa, Haemophilus somnus 129PT
MTIKTPVQATLASNQYFLDRQDIMESNVRSYPRKLPFAYQKAQGVWVTDVEGNEYLDFLAGAGTLALGHNHPKLIQAIKDVLDSGLPLHSLDITTPLKDAFTEELLSFFPKDKYILQFTGPSGADANEAAIKLAKTYTGRGNVIAFSGGFHGMTHGALSLTGNLGAKNAVQGLMPGVQFMPYPHEYRCPFGIGGKAGVKAVEDYFENFIEDVESGVVKPAAVILEAIQGEGGVVPAPISFLQKVREVTQKHGILMIVDEVQAGFCRSGKMFAFEHANIEPDIVVMSKAIGGSLPLAVLAIKKEFDAWQPAGHTGTFRGNQLAMATGYVSLKIMREENLAQNAKERGEYLTKALTELSQEFPCIGNVRGKGLMMGIDIVDEHQAKDATGAYPRDCDLAVAIQKYCFKNKLLLERGGRGGNVVRILCAVNITQAECEEFIKRFKQSVAEAVKAVRG

SEQ ID NO: 16864 - protein, 236 aa, Haemophilus somnus 129PT
MSKLSLIQQLKQQKLSVGILSANWLQLNEEVTTLLENQINVLHFDIADGQFSSLFTVGAIGIKYFPTHCFKDVHLMVRNQLEVAKAVVANGANLVTLQLEQYHDFALTIEWLAKQKTTYANQVYPVLIGACLCPETPISELEPYLDQIDVIQLLTLDPRNGTKYPSELILDRVIQVEKRLGNRRVEKLINIDGSMTLELAKYFKQGTHQIDWLVSGSALFSGELKTNLKVWKSSIM

SEQ ID NO: 16865 - protein, 255 aa, Haemophilus somnus 129PT
MARRPLVMGNWKLNGSKAFTKELITGLKDELNAVSGCDVAIAPPVMYLAEAETALVSSDIALGTQNVDLNKQGAFTGDISTEMLKDFGVKYVIIGHSERRQYHHESDEFIAKKFGVLKDAGLVPVLCIGESEAENEAGKTEEVCARQIDAVMNTLGVEAFNGAVIAYEPIWAIGTGKSATPAQAQAVHAFIRGHIAKQSQAVAERVIIQYGGSVNDANAAELFTQPDIDGALVGGASLKASAFAVIVKAAAKAKN

SEQ ID NO: 16866 - protein, 228 aa, Haemophilus somnus 129PT
MLKIKKRSAIALIASAVVSQSVFADKQFNDDVSYALGYFMGKYLTVMGEEHKDVASYNYEKIVAGIKDVVENKSTLTDEKAQETLQELENKARHAKMAKIKAENEKFTAEFAKKSNVKKTESGLLYRIEKMGEGKSIKPTDRVKVHYTGKLANGKVFDSSRERGQPAEFKLNQVILGWKEGLQFIKKGGKIELVIPADLAYGERGAGLIPPSSTLYFDIEILDVTSEK

SEQ ID NO: 16867 - protein, 437 aa, Haemophilus somnus 129PT
MSLEKTFELTKRGSNVRQEIIAGLTTFLAMVYSVIVVPNMLSAAGFPAESVFIATCLVAGLGSILIGLWANAPMAIGCAISLTAFTAFSLVLGQGVSIPVALGAVFLMGIVFTLISATGIRSWILRNLPSSIAHGAGIGIGLFLLLIATTNVGIIVANQNGLLVKFGDFTSFSVLMSLVGLAVIIGLEKMQVKGGILWVMIAITIAGLIWDQNVQFKGEIFRLPTFGEQSLFLELDIMGALQPAILPVVFALVMTAVFDATGTIRAVAGQANLLDKDGQIINGGKALTADSVSSLLSGALGTAPAAVYIESAAGTAAGGKTGMTAIVVGILFLLMLFFQPLASLVPNYATAPALMYVGLLMLSNVSKLDFSDFVGAMSGLVCGVFIVLTANIVTGIMLGFATLVIGRLVCGDWKKLNVGTVIIAIVLVAFYIGGWAI

SEQ ID NO: 16868 - protein, 404 aa, Haemophilus somnus 129PT
MRVFPKSDKLEHVCYDIRGPVHQEALRLEEEGKKILKLNIGNPAPFGFEAPDEILVDILRNLPAAQGYCDSKGLYSARKAIVQYYQSKNILSATVNDVYIGNGVSELITMSLQALLNDGDEVLIPMPDYPLWTAAATLAGGKAVHYLCDEQADWFPDVADIKSKVTSRTKAIVIINPNNPTGAVYSKELLLDIVEVARQNGLMIFADEIYDKILYDNAVHHHIAALAPDLLTVTFNGLSKSYRVAGFRQGWMILNGPKHQAKGYIEGLDMLASMRLCANHPMQHAIQTALGGYQSINEFILPGGRLLEQRNKAYELINQIPGLSCTKPMGALYMFPKIDTKKFNIYDDEKMVLDLLRQEKVLLVHGRGFNWQQPDHFRIVTLPYVNQIEDALGRLARFLEYYRQ

SEQ ID NO: 16869 - protein, 349 aa, Haemophilus somnus 129PT
MNNDFLVLKNITKSFGKSVVIDNLNLSIKRGSMVTLLGPSGCGKTTVLRLVAGLESPTEGEIFIDGEDVTKSSIQNRDICIVFQSYALFPHMSIGDNVGYGLKMQGVGSDERKQRVKEALELVDLAGFEDRYVDQISGGQQQRVALARALVLKPKVLLFDEPLSNLDANLRRSMREKIRELQQRLNITSLYVTHDQTEAFAVSDEVIVMNKGKIMQKAPAKELYKYPNSLFLASFMGESSIFNGYLAQGTVTINDYQFVLPDADKFALNDGECLVGIRPEAVKLKSEGMEEQRCVIKSAVYMGNYWEIITNWGGKDLLVNATPENFSQEMKEAYVHLTESGVFLLNKEE

SEQ ID NO: 16870 - protein, 389 aa, Haemophilus somnus 129PT
MSVIKMTDLDLAGKRVFIRADLNVPVKEGKVTSDARIKATIPTLKLALEKGAKVMVTSHLGRPTEGEFKPEDSLQPVVDYLKGAGFNVRLAQDYLNGVEVNEGEIVVLENVRVNKGEKKNDPELSKKYAALCDVFIMDAFGTAHRAQASTYGVAEFAPVACAGPLLAAELEALGKALKEPQRPMLAIVGGSKVSTKLTVLDSLSKIADQLIVGGGIANTFIAAEGHNVGKSLYEADLIPEAQRLSKVTNIPVPVDVRVGTEFSETALSTEKSVADVSGEESIFDIGDKSAEQLADIIRNAKTILWNGPVGVFEFPNFRKGTEIVSNAIAEATANGAFSIAGGGDTLAAIDLFGIKDKISYISTGGGAFLEFVEGKVLPAVEILEKRANG

SEQ ID NO: 16871 - protein, 484 aa, Haemophilus somnus 129PT
MSQKGDIGVIGLAVMGQNLILNMNDNGFKVVAYNRTTSKVDEFLAGAAKGTNIIGAYSLEELAGKLEKPRKVMLMVRAGEVVDQFIEALLPHLEQGDIIIDGGNSNYPDTNRRVKALAEKGIRFIGSGVSGGEEGARHGPSIMPGGNEEAWQYVKPILQAISAKTDKGEPCCDWVGKEGSGHFVKMVHNGIEYGDMQLICEAYQFLKDGLGLSYDEMQQIFAEWKKTELDSYLIDITTDILGYKDADGEPLVEKILDTAGQKGTGKWTGINALDFGIPLTLITESVFARCVSSFKDQRVAASKLFNKTIGKVEGDKNVWIEAVRKALLASKIISYAQGFMLIREASENFGWNINYGATALLWREGCIIRSRFLGNIRDAYEANPDLIFLGSDPYFKGILENALSDWRKVVAKSIEVGIPMPCMASAVTFLDGYTSERVPANLLQAQRDYFGAHTYERTDKPRGEFFHTNWTGRGGNTASTTYDV

SEQ ID NO: 16872 - protein, 449 aa, Desulfovibrio desulfuricans G20
MSTNYPVFNCKNGDDVIRAVKDYNVSFVQFWFVDILGNLKSFQVTPDELEAAFEEGMGFDGSSILGFTRIEESDMIAFPDASSFQICSWRPMDRPVARMFCDIRTPDGNPYEGDPRYVLRRLVDKAAQKGYTYYVGPELEFFLFADSTCPRPLDSGGYFDAPPLDLGNEVRRDIIFALQKMGIDVEYSHHEVAPSQHEIDLRYNEALKMADIAMTYKVVVKEIARKHGVYATFMPKPIFGENGSGMHVHQSLFKNGKNAFFDANDPHHLSAEARHYIAGLLTHASEITCITNQWVNSYKRLVPGYEAPVYIAWAQRNRSSLIRVPMYKPGKEAATRIELRNPDPACNPYLAFAAMLGAGLEGIEKGYEVPRAVEENIFAMEAEDLSAKGIDSLPGSLYEAAVALRDSALMKEVLGEHTHQNLVGNKLIEWDAYRTHVSEFELKRYLPVL

SEQ ID NO: 16873 - protein, 1003 aa, Desulfovibrio desulfuricans G20
METMPDEKIVSRGKEFFTSISGEAPSIFNKGWWTGKVMDWAMKNEDFKVQLFRFVDVFPYLNTSESLSRHIREYFAEGGDVPAVLKWGAGKAGIGGKLTAMLMEKTIRSNIENMGRQFIIGQNAKEAVKSIAKLRKDGFAFTVDLLGEATVNEEEADAYRDGYLEVLDALAREQDKWSPLKGPGPDTDTDWGCTPRVNVSIKPSALYSQAKPVDIEGSVQGIMKRLVPVYRKVVEMNGFLCIDMEALKYKEMTLELYRRLRSEPEFRHYPHLSIVLQAYLRESEKDLADLLHWARTEKLPIAIRLVKGAYWDAETVIAKQNGWDIPVWVHKPQSDMCFERMARTILENSDICYFACGSHNIRTIAATMETARQLGVPETRYEFQVLYGMAEPVRKGLLNVAGRVRLYCPYGELIPGMAYLVRRLLENTANESFLRQSFADGTDMERLLENPELTLQRELAARPAPVEPSGTGGIPPFRNDPMIDFTIPEQRAAFPRAIAEVRAAAGGTVPLFIGGKEVFTQDTMPTTNPADPDEKLADVCQAGIAEIDAAIEAAGRAFLIWRDVSPEDRANYLFKAADAARRSAYRLSAWQILEVGKQWDQAYHDVGEGIDFMEYYAREMLRLGRPRRMGRAPGEHNHLFYQPKGIAAVISPWNFPFAISIGMASAAIVTGNPVIYKPSGIAARIGYNLTEVFREAGLPDGVFNYCPGRSSVMGDYLVEHPAINMICFTGSMEVGLRIQEKAAVVQPGQHHCKRVIAEMGGKNAIIIDDDADLDEAVLQVIYSAFGFQGQKCSACSRVIVLDPIYDRFVKRLVEACNDLKIGPAEDPANYMGPLADASLQKNVGRYIEIAREEGTILVSRDDIPARGCYVPLTVVADITPDSRIAQEEIFGPVLGVMRASTFEEALEIANGTRFALTGGVFSRSPEHLEKARKEFRVGNLYLNKGSTGALVERQAFGGFKLSGVGSKTGGPDYLLQFMDPRVVTENTMRRGFTPIEEDDDWIV

SEQ ID NO: 16874 - protein, 256 aa, Desulfovibrio desulfuricans G20
MHSSPSITLQDVDVGYPHNIVLHNLHLTIPAGKITVVLGGSGCGKSTLLRHILGLQLPRRGRIYIGQDDLCAMNSEQLYSYRRNMGVLFQGGALLGSLTVGENVALPLMEHTRLDDETIRTVVRLKLSLVGLDNVMDMLPAQLSGGMRKRAGLARALALDPGILLCDEPSAGLDPITAAEVDQLITDMHDSLQMTILVVTHDLDSLYRIAQHVIVLHAGRVLFTGKTDDLRKSQDRYIRQFLERRPDARKTPDWLL

SEQ ID NO: 16875 - protein, 247 aa, Desulfovibrio desulfuricans G20
MQKKNRPVIDIAGLHKWFGDHHVLKGIDLQVMPSDVVVVIGASGSGKSTLLRCVNLLEDFQDGEIRVGGVAVHKEEQFINTLRSRVGMVFQHFHLFPHMTTLGNVMEGPRQVRRMNKKEARELAGHYLEKVGMADKADAYPSTLSGGQKQRVAIARALAMEPEVMLFDEPTSALDPELVGEVLSVMRTLAEDGMTMMVVTHEMGFAREVADTVAFMDEGVILEKESPQTIFSSPREERTQAFLGQIL

SEQ ID NO: 16876 - protein, 305 aa, Desulfovibrio desulfuricans G20
MKIAITTSSFARFSEAPLQLLRQEHIDYVLNPLGRKLTENETIDLLQDCVAVAAGTEPLTARVMDALPGLKVISRCGTGMDNVDMEAARARGIAVRNTPDGPTQAVAELTLGLALDLMRQVSRMDRELRSGVWKKRMGNLLGGKRLGIVGMGRIGRAVADIFTPLGVQVAFNDPVSCCGDYPCMPVEELLGWADILSLHCSMTGGECSLFTAEHLRRMKRGSWVINVARGGLIDEQALYEALADGHLAGAAVDVFGNEPYTGPLSSLDNVILTPHIGSYAKEARIRMETDTIANLIDALRAAGVK

SEQ ID NO: 16877 - protein, 373 aa, Desulfovibrio desulfuricans G20
MAEQDYIFELRGVSKYFDDTCALENIDLQIRNGEFLTLLGPSGCGKTTILRLLSGFETPSSGDVILSGRVVNDVPPEQRQVNTVFQNYALFPHMTVRDNVGFGLKMQKRPKDEIARRVREALKMVHLEQFGDRKPARLSGGQQQRVAIARAVVNNPYVLLLDEPFSALDFKLRKKMQLEIKHLQRQLGITFVFVTHDQEEAFAMSDRVVVMNDGRIEQIGSPQEIYEEPANLYVARFVGDINILDGTITARRNGVLYDATLEGVPFPVQTGKQFETGDRVKVLLRPEDIRLHMMHDLPDGEYFTGAIEETVYKGATVDIVVRLDSPSEGQPGKQLLVAEFFNEDDEEINYTPGERVAVTWVNGWEVVLGDDGE

SEQ ID NO: 16878 - protein, 450 aa, Desulfovibrio desulfuricans G20
MSNSAFLNWTHARHGRISGTDPASLTPRLGEAANLLGLELAAGRLPFIDMPYADGMTARLQELEPLLRRFEHMVVLGIGGSALGARALQKAFFPAQDRPAHTGPWLWIADNVDADSLEAWLQSLPAEKTVVVVISKSGGTIETIGQYFLIRDWLRTARGDAWTNHVIAVTDERSGFLREEADTHGLASMPVPDHLGGRYSVLSAVGLIPAAFTGMDWQALVRGAKTVGAPLCSSPDAATLGAHPAWHLAAWNHALMQAGYSQLIFFSYMPLWAHFGFWFAQLWAESLGKEGKGSMPLPAVGVTDQHSTQQMFLDGPRDKACLFLTCSSLPQGRTFPGDMPPKWDFLRGRRFGDLLEAEALGTRMALHKTGTPLVEIGMAQPSEEQAGRLMALLEITTLLTGWLLDINPLDQPAVELGKRLANARLGAPGYDTETADLGAFLAAQGSRQEF

SEQ ID NO: 16879 - protein, 130 aa, Desulfovibrio desulfuricans G20
MTADLPDFVPDFEKTGGLVPAIAQDAVSGEVLMMAWMNEEAWHRTLTTGEAHYFSRSRGSLWHKGGTSGHTQHIRAVRLDCDSDTILLLVDQIGGAACHKGYKSCFFRELKDGEISVCSPLVFDPEEVYK

SEQ ID NO: 16880 - protein, 188 aa, Desulfovibrio desulfuricans G20
MNCTRRGFLKLAGAGAACISLAQLGFSLKEARAFAASLKIEGAKEVITVCPFCSVSCHIIAYVKNGKLISTEGDPDYPINEGSLCAKGAALLTMSTSHHRLLKPKYRAPFSDKWEEKDWGWTLEQIARRVKDTRDKEIILENNKGQRVNRLESMFLLGTSHADNEECALVHQAMRGLGVVHMDHQARI

SEQ ID NO: 16881 - protein, 461 aa, Desulfovibrio desulfuricans G20
MHAPVSSPRHPAKRFARTAALWLVVATLLHASPALAEDAPAMLSQQHGNILWTLIAAILVMLMQAGFAMVECGFTRAKNAGNILMKNFVDFAAGSLVFFLVGYAFMFGADAGGFIGTSGFALAHVDPATEGGMWDLTFWFFQSVFAATAATIVSGGIAERTRFASYIIVSVLVTGIIYPVSGHWAWGGLAGNAGWLEGLGFADFAGSTVVHSVGGWVALAGAIVVGPRAGKYGPDGSVRAIPGHNIPLAALGVFILWFGWFGFNPGSTTTADGTIGYIAVNTSLAACAGTVTAMLTAWIRFGKPDASITMNGALAGLVGITAGCYELSPSGAIIVGIICGFVVVLSIEFLDKILKIDDPVGAVSVHGVCGAIGTLMVGLLAHPSYGGSTGLVYGGDASLLMVQALGVAVVFAWAFGMGLVVFRIVAAVAGLRVSPEEELKGLDITEHGSESYNGFQIFTVE

SEQ ID NO: 16882 - protein, 422 aa, Desulfovibrio desulfuricans G20
MERSRNLFERAQKLIPGGVNSPVRACLSVDSAPVFVERGQGSKLYSVDGREYIDFVESWGPLLLGHAHPAVNKAIHEAVDKGSSFGAPCEDEIRLAEAVVDAVPSIEMVRMVSSGTEATMSALRLARGYTGRNKLIKFEGCYHGHGDAFLASAGSGVATLSIPGTPGVPDTVVADTLLAPYNNLERVKALFENHGADIAAVIVEPTAGNMGLVRPAAGFLQGLRELCDRYGALLIFDEVITGFRLSYGGAQQYFGITPDLTTLGKIIGGGMPVGAYGGRREIMERIAPCGDVYQAGTLAGNPVAMAAGIATLAELKKADYPALEKRVDALASEIEAILKAKGVPVTVNRLASMFTIFFTEEPVTDYDSAKKADGTLYTRFYQQMRDQGIYLAPSGFECAMVSLAHTEDDFAAMLAAVRNVTF

SEQ ID NO: 16883 - protein, 263 aa, Desulfovibrio desulfuricans G20
MHRPPEAGGSMYKLVLVRHGQSTWNLENRFTGWTDVDLTPLGETEAREGARLIAAAGLTFDECHTSVLKRAIRTLNIIQEELDLLWLPVHRHWRLNERHYGALQGLNKKEMSEKYGEEQVFIWRRSFDTPPPALTADDPRHPAHDRRYASLTARQMPLCESLKDTVARVLPYWHETLAPAIQAGRRLLVAAHGNSLRALVMHLDGMSPDEVTGLNIPTGLPLVYELDSNLTPLRRAYLGDAEAAEAKARAVAEQAKAGTTERP

SEQ ID NO: 16884 - protein, 394 aa, Desulfovibrio desulfuricans G20
MYEFPRMHRLPPYVFAVVGELKMQLRRQNVDIVDMGMGNPDMPTPQHIVEKLNEAAAKGVNHRYSVSRGIPNLRKAICEWYMRKFDVYLDPDKEAVVTMGAKEGLSHLALAMLSPGDVVFAPDPTYPIHTYAAIIAGADVRRIPIGKGRDFFEDLLAATRQTWPQPKLLMLSYPHNPTTELATLEFFQKVVDFAKEHKMYVVHDMAYADLAFDGYEPPSFMQADGAKDVGVEFYSMSKSYSMAGWRVGFCVGNREMVHALTRIKSYLDYGIFQPIQIAATVALNGPEDCVKEIVDTYRQRRDVLCEGLNRVGWPIEPPKATMFAWAEIPEPFRQMGSVEFSKLLLREAGVAVSPGLGFGHFGDHHVRFALIENPHRIKQAIKGIKRVLSGSSCG

SEQ ID NO: 16885 - protein, 161 aa, Desulfovibrio desulfuricans G20
MAEQAKVTMFLYAKNHARSFYMAIKNGDTVRVHYTGTLDDGTVFDSSRDREPLEFTMGEGMLIPGFEAALMGLAAGDTTKTTIQPEDAYGEPNDELILAVAREQVPDHITPEVGLMLQVQTEEGMMDVTITDVTDEQVVLDANHPLAGESLTFEIEVMEVL

SEQ ID NO: 16886 - protein, 459 aa, Desulfovibrio desulfuricans G20
MNALQPDTERLRALDTAHVWHPFTQMATWHEDAPLIIEKARGNWLVDTDGNRYLDGVSSLWTNVHGHRHPHIDAAIRAQLDNVAHSTLLGLSSRPAIELAAMLARVAPQGLNRVFYSDSGSTAVEVALKIAYQYQKQRGPAGEGRSKFLCLRGAYHGDTVGAVSLGGIDLFHAVYGGLLFKTVRAEAPYCYRCPFGRQKESCRHECFTHLEETATRHAPELAAMVIEPLVQGAAGQITHPDGYLAHARALCDRLGILLIADEVAVGFGKTGTMFACEQEKVTPDLLCLAKGISGGYLPLAATMVTDAVYEAFLGDHAQCRTFFHGHTYTGNALACAAGIASLQLFRTEGTLERLQHIITIYDALLRQLETLPHVGDIRRRGIMTGIELVEDRATRRPYPFALRTAHKVVLAARRRGVIIRPLGDVLVLMPPLSITAQECGLLVEATAEAIQEVTGGPRV

SEQ ID NO: 16887 - protein, 217 aa, Desulfovibrio desulfuricans G20
MILSPSLLSSDYGRLADELAALEDAGLSWVHWDVMDGMFVPNITLGAPIIKKLRKASGLFFDVHLMVQAPERYIADFADAGADMLVVHAEATNHLERTLSEIRRMGVQCGVALNPHTPLCVLEYVLDQLDMVLIMSVNPGFGGQKFIPFTMRKIEELSAMITARGLKTLIQVDGGVDPENTPELVRRGADVLVSGSAFFGHPPYRQRHDAFQAAAAR

SEQ ID NO: 16888 - protein, 333 aa, Desulfovibrio desulfuricans G20
MNLAKFPRRGYVQQATPIEKLDNFSAALGGKVQIYIKRDDLLPGCAGGNKTRKLDFCIADALEQGADTIITCGAVQSNHCRLTLAWAVKEGMDCHLVLEERVKGSYKPQGSGNNLLFHLMGVKSITVVPGGSDMMEAMTKVAGTLKEQGRNPYIIPGGASNTIGATGYVACAQEMMQQLFEQGINIDHMVVPSGSAGTHAGIVVGMAATNSGIPVSGVNVSRTKPVQEELVHKLACATAERVGVSGGIAREEVVCFDGYVGAGYSLPTDSMVEAVKLLASTEGILLDPVYSGKAMAGLIDLVRKGHFPEGSNVLFLHTGGSPALYAYTDTFME

SEQ ID NO: 16889 - protein, 255 aa, Desulfovibrio desulfuricans G20
MTAAKSPILRVENVCKQLGGKEILKSVTLSVNKGELKVLIGPSGAGKSTLLQCINYLIPPDSGDVYLENRKVELHRKAELYELRQQVGMIFQDFNLFDHLTAADNVSIALRKVKGMSRKDAAARAMQELERVGLVERASLYPAELSGGQKQRVAIARALAMDPKVILLDEPTSALDPELVGEVLTVIRDLARGGMTMIMATHQMDFAQALAHEILFMQDGAIIEQGTPAELLAEGANTRTQDFCSRLSNLCEELC

SEQ ID NO: 16890 - protein, 431 aa, Desulfovibrio desulfuricans G20
MSTIVSVWAREILDSRGNPTVEVEVSLESGHSGRAAVPSGASTGSREALELRDGDKGRYLGKGVEKAVDNVMGEIAENIVGMDALRQVAVDNALIDLDGTDNKDRLGANAMLGVSLATARAAANFIGMPLYQYLGGINSKVLPVPMMNIINGGEHAPNNLDIQEFMIMPVGAPTFSEALRMGAEIFHNLKALLAADGHVTSVGDEGGFAPNLKSHDEAFRYIMRAIETAGYIPGSEVALAIDAAASEFYKDGKYHLKGENKVLSSSEMIDWLMDFTQRYPLISIEDGMAEGDWEGWQEMTVKMGDSVQIVGDDVFVTNPDILAQGIDEGVANSILIKLNQIGTLTETLDTVEMAKGAGYTTVISHRSGETEDHFIADLAVALNAGQIKTGSLCRSDRLAKYNQLLRIEEDLDDEGIYFGPYMASHFGLGEE

SEQ ID NO: 16891 - protein, 251 aa, Desulfovibrio desulfuricans G20
MKELSLGKELVSEFMGTLVLILFGTGTVAMTVLFGEALNITWANITLGWGLAVLLGVMAGLPSGAHINPAVTLGLAVTGRFPWRKVVPFTLAQTAGAFVGAALVFIDFKAKWLLVDPNLASTAGIFCTFPAIPDSFMPGFIDQIIGTAILLFGILAAGDFAAKNNAGWSVPFIVALLVTVIGMALGAMNGYAINPARDFGPRLFALVAGFTQANLMDISIVLTPIIGPFIGGAVGAVVYDWTTGAVHKAQN

SEQ ID NO: 16892 - protein, 1110 aa, Desulfovibrio desulfuricans G20
MSIMIEPAGLDPQWYRDAIIYELHIKSFHDSDGDGMGDMAGLIEKLDYLQDLGVTALWLLPFYPSPLRDDGYDIADYMSINPDYGSMADFRKLLREAHSRGLRVITELVLNHTSDQHAWFRRARRAPAGSEERDFYVWSDTSDRYKDARIIFKDFEPSNWSWDPVARAYYWHRFYHHQPDLNYENPAVHKAMFRVIDFWLDMGVDGVRLDAVPYLYEEEGTNCENLPRTHDFLKALRSHIDSRFQGRMLLAEANQWPEDAARYFGDGDSCHMAFHFPLMPRMFMAIEMEDRHPVIDIMEQTPELPDGCQWAIFLRNHDELTLEMVTDEERDYMYRMYARDPRARINLGIRRRLAPLLGNDRRRVELLNVLLFTMPGTPVLYYGDEIGMGDNYYLGDRDGVRTPMQWSADRNAGFSRSNPQRLFLPVVIDPEYHYEAVNVETQQSNKSSLLWWMKRIIAMRRRYTAFSRGGISFLRPENSRVLAYMRSSGEEHVLVVTNLSRHAQAASLDLSGWEGYRPVEVFSNTRFPAVRQPAYTITLNPYGYYIFHMRREEAAEALTGLFSPPMLMPVSGARFLDVEVREALQRRVLPGYLTRRGLLGTSAVQLREAVILEAVPVGGKGAPSWLLIVEARYQERQPEWFGMLVSLLAGEPARQTVREAPVHLMCTFGEDAPEAVLVESFDASCRCGALLQLVSRTQTVKGRHGELAVAPAGGTRGRVRAACAEDAPALWKPHIHATSVVCGESVLFKVYRRMDEGVNPDVELLRFLTEEAGYPHVPAYMGVVEYRRSRTSSMAVAMLHEYVQAQGDAQEMCRDMVRRFFDRVLAARGEMDIRPRLYARSPVEAAGRPLPQEYRELMGDMDFAGMQLLGRRVGELHRALAFSSEDSAFAPEPFSTLYQRSVYQGMQSRVKQVLTRLERSLALLPESARDDAARVLELREEALRRMRGFLTRKLDCLKIRVHGNLHLGNVLRSGREYVIVNFEGRPDKSLSERRLKRSPLRDVADLVRSVHYTVLTVLMHESVLRPEDRAFLEPWADLWRIEASGAFMTTYLEAVGGSRLVPENEQGVQVLLEAFLLEKAFMELDAELKAPSGMVGLPLAAIITLLGAEG

SEQ ID NO: 16893 - protein, 176 aa, Desulfovibrio desulfuricans G20
MTVTGMDVVYTAEQVQERVRELAVQINAEYEDKPLVVVCVLKGAFMFFSDLLKHLTVRPEIDFVRVASYGNSTTRSRNISFTKDLEVSIDGKHVLVVEDIVDTGHTVDFLYRQLAARGAASIRLCAIVDKAERREVDVTVDFPGFALDKGYIIGYGMDYAEQYRELDAIYDAHVAN

SEQ ID NO: 16894 - protein, 352 aa, Desulfovibrio desulfuricans G20
MSNPMNFAFLRKSPLPPNGRKVGIIGAGPSGLAACGYLACLGYEVVVYDKLPQPGGLMVFGIPRKRIPPERIRAGVRRMERQFGVVFRTKTKICCSAPLHEEEGDHFSCDIRGLGELVEEHDAVMICTGSWKSRKLGIPGENLAGVHSGLEFLFPIRAAKYASPNVTMPDVRGKRVAVVGAGHSAVDVVDSAHALGAAKIYMIYRRTAREAPCGSFEIDRICEMGAEWLERRTPLRVEGECGVQRLELANGMTGEAEHLDVDMLITAIGEIPTPPFQQELGLENVRKGEVRWLHMTSIENVFVAGDVLTGPSKIGKAVYSGLRASRSLTNWLDLKAQNREGEYRYDEDRIVP

SEQ ID NO: 16895 - protein, 1240 aa, Desulfovibrio desulfuricans G20
MENRSARAGGFPPFNTRDRDLTRGMPSRRKNYVAGWVFSSPIGGETMAKAQADKPKAEVKSQKAKAETTALTNKLVLTGAEITAIGEDAELLVGGKNYNTAIISQVEGVRSPQFRAISSVAFHKLLDETKVNASLVRSVLDKEYNSIDWNDTEINRDPEFLKKFVRNLANEIRQKAAASGAQNMLKTRTFINNVVEGFATSPEGIDQLRKRSLLVQAAILSVDLPEAVAACVREAYNAICKEAGVENVAVAVRSSAAGEDSRKKAFAGLQDTYLNIVGESQAVDAYHWDCASAYNLRSMTYRREAILDAMARAEATGDESIAATAKEEWAIENTSLSVCIMRMVNPVISGTAFSADTATGCRGTARKDLVSIDASYGLGEAVVGGMVTPDKFYVFQRGDGQEVVIRQMGCKDKKIVNDEKGGTKMVSVPENEAFRWSLSLAQAEAVAKGVRGISIAYGGMIMDTEFCIDSSDRLWFVQARPETRWNEEFEKHPHTIFMRRLEVNEKAANNAEVILEGNGASRGAGQGTVKYLRSALELNKINKGDLLAAERTDPDMVPGMRIASAILADVGGDTSHAAITSRELGIPAVIGIQRLEILRSLDGQEVTVDGTRGKVYRGMLPLEEVGGEMDVSTLPATKAKVGLILADVGQAMFLSRLRDVAGFEVGLLRAEFMLGNISVHPQALEAYDNGELDIVVAAKLKELEARLTKVLRDQLGAGLIGLDLKLREYVGVLTGLAAEIQQLTERENVRGTEEVLAMHRRMRELDHKLDEHVELATRRLDVLKTSVDVEDHIRVVMGYDDELALLVGKEPDTVKRRAEIEGTVKSMAEKVADAAMVKDVLTRIKALRLEVAQKSGLLKEMEEVRTVPSKIRDLIRSRGFRTGKEHYVQTLAQGLALFAMAFHGKEIIYRTTDFKSNEYRNLLGGSLFEHVEDNPMLGFRGVSRNLHDWEIEAFKLARGVFGGTNLMIMLPFVRTLEEARSMRRYLEQVHKLKSGVDGLKIILMSEIPSNAIMAKQFIQEFDGFSIGSNDMTQMVLATDRDNARLGHIYDEEDPAVVWAILVTIFTGQKYGKKVGFCGQGVSNSKILRGIVAVAGITSASVVPDTYFQTKHDMAAVEAENIPTSKLGDWLRRQYLATLRQLLEENGYGHILKKYKNAEDLMEWYDGELRRLHEQLRESIETPKEKFYRQELENFRAVFHKPVIYASWDWNATVTDAMHQAGFASFEEQARALEEQRKKQW

SEQ ID NO: 16896 - protein, 257 aa, Desulfovibrio desulfuricans G20
MNTDSEHLGVRGLKVAYGDFVLMRDVSFSIRRGDIFVIMGGSGCGKSTLLKVLVGLKSPAEGQVLYEGQSLWQADAGARRDMLRKTGMLYQSGALWSSLSLAENVALPLEQYTSLNKKEIRELAEFKLALVGLAGFADFYPSEISGGMRKRAGLARAMALDPEILFFDEPSAGLDPVSAYLLDELILEIRESLDATVVLVTHELPSIFAIGTNSIFLDVSRRTMTASGNPKTLLNTSDDPALIRFLTRGQGYVQEVR

SEQ ID NO: 16897 - protein, 202 aa, Desulfovibrio desulfuricans G20
GTLGEVVSLAGISQFRIAETEKYAHVTYFFNCGREEPFTGEDRLLVPSPRDVATYDLKPEMSVYEVTDSLLAALDKGYGLIVCNLANLDMVGHTGVFSAAVKACEAVDACTGRIIDAFVERGGVVMVTADHGNAEQLLDAQGNPHTAHSMNPVPVALLGAPAAWRLVPEGKLGDVAPTIIDILGLHRPEAMTGQSLLVKESV

SEQ ID NO: 16898 - protein, 299 aa, Desulfovibrio desulfuricans G20
MSLCEHEERFLDSELEPVAPGKARFHIIPAGYEASVSYGGGTFRGPAAILAASRQLELWDGLSDPSRLGLFTHCPVDCDAETAEVLMRIEASVQAALDAAPENPPVPVLLGGEHTVTLGALRALYKRYGSFGVVQFDAHADLRERYDGTPYSHACVMRRALEMGLPLVQVGVRACSEEEVRVRTAHGVTCWDARQLAEHGLPEHILPPDFPSRVYVTFDVDGLDPAVIRATGTPVPGGLGWWDAQHMLRQAVEGRHVLGMDVVELAPDLGDIASDFAAAQLVYNMMGMVQRHAAAKGRV

SEQ ID NO: 16899 - protein, 400 aa, Desulfovibrio desulfuricans G20
MTTFDELKQREESLLCRTYGRYPLAVASARGSVLTDFSGREYIDLLSGIAVTNLGHCHPALAEVMHAQAGRLVHLSNLFYQQEQLELAEKLLGTTHLGKAFFCNSGAEANEAAIKLARRYAQRVKERDAGTVITLTGAFHGRTLATVAATGQAKFQDGFAPIPQGFRQVEWGSLDALEAAMDDDVVAVLAEIVQGEGGIRPMTPEYAQGVQDICRRHGVLFMVDEVQSGMCRTGRFWAFQHYGLTPDVVTSAKALANGLPMGAMLATDEAAKGFEPGSHATTFGAGALVSAVAARVVDIMQQEKLAERADRVGGAFMADVRSLAARLPGTIQEVRGLGLMIGIVLTFPGREVWEELLRRGFVLNLTQERVLRLLPALTVPETYLQDFLTALEEILSERTV

SEQ ID NO: 16900 - protein, 485 aa, Desulfovibrio desulfuricans G20
MGTILGKALTFDDVLLVPGYSEITPDQVDVSTMLTAQIKLNIPLISAAMDTVTESAMAISMARNGGVGVIHKNMTIDEQRLEIEKVKKSESGMIIDPVTIAPDYTVAQALQIMREYRVSGLPVVKDAELVGILTNRDVRFVTDLEGTRVHEVMTSEELVTVPVGTTLDEARHHLHEHRIEKLLVVDENNRLKGLITMKDIDKVQKYPQACKDDKGRLRVGAAIGVGGECEARAQALLGAGADFLVLDSAHGHSQNILKTVEMVKNTFPDCQLIAGNVASYEGAKALFKAGADTVKVGIGPGSICTTRIVAGVGVPQITAIMEAVRAAREFGRHIIADGGIKYSGDIVKALAVGANTVMLGSLLAGTEESPGETVLYQGRTYKIYRGMGSIDAMKDGSSDRYFQEKTKKLVPEGIVGRVPYRGHVGDTVFQLVGGLRSGMGYTGAATIAELDEKAQMVQISVAGLRESHVHDVIITKEAPNYNMDK

SEQ ID NO: 16901 - protein, 322 aa, Desulfovibrio desulfuricans G20
MRITVLDGYTLNPGDLSWAEIEKLGEVTVHDRTHGQDIVKRGGQAQILLTNKVRLTAETLAMLPQLRFISVLATGYDVVDIAAAAARGIPVSNAPGYGVEAVAQHTMALLLELCRKTARHDTLVKQGAWSQAPDWCFWEGTQQQLTGKTMGIVGFGNSGRRVAVLADAFGMDVIAYAPRPKEAPALRNFRFAPLEELTAQADVISLHCPLTADNRHLINAQRIASMKDGALLLNTARGPLVDETALAQALVSGKLGGAGLDVLETEPPLPDNPLFRAPNCLITPHIAWATQTARQSLMSITARNIEMFKHGTPQNVVNAHML

SEQ ID NO: 16902 - protein, 323 aa, Desulfovibrio desulfuricans G20
NLILAAGSEPASFPGLIPDGNCVLHSSHILQLETPPQSLIIVGGGAIGLEMGDLFARFGTQITIVEALPHLVPAEDGDIADALTKALKREGWTVHTGRRVRSLVTDEEGALLTFEDGTAIRADKALMAAGRSPATAALHPEKAGIMTDGRGWISTDNFLQAAENIYAVGDVNGRTLLAHAAEHQARYVVSRLRGLTAAEYPAPVMPSCVYGHMEVMRTGATAKELTAQGISVSVSRAPLASNAIAQSCGATQGFVKAVWAAGNGTPELRGIAATGHGVSHLVGLATVMVQQRWRRENIHDIIYAHPTLDEALEAALSAPLENA

SEQ ID NO: 16903 - protein, 375 aa, Lycopersicon esculentum
MACCFPVILDRSMRSSFKLSKSSSSSKLDKSKSSICSPTSLSTKKKSIQENDNLVVCFGELLIDFVPTVSGVSLAEAPGFKKAPGGAPANVAVGIARLGGSSAFIGKVGADEFGYMLADILKQNNVDNSGMRFDTHARTALAFVTLKSDGEREFMFFRNPSADMLLTEAELDKNLIQKARIFHYGSISLIAEPCRSAHLAAMETAKNAGCILSYDPNLRLPLWPSEEAAREGILSIWDQADIIKVSEDEITFLTNGEDAYDDNVVMTKLFHSNLKLLLVTEGGDGCRYYTNNFHGRVSGVKVAAVDTTGAGDAFVGGLLNSMASDPDIYMDEKKLRDALLFANGCGAITVTEKGAIPALPTKEAVLKILDGATAN

SEQ ID NO: 16904 - protein, 356 aa, Leptosphaeria maculans
MDIVLEVCDTFLFDPLYATLLPAQASSFTANATANATLSSIRQEPTAYALPHASWQYEPATKYFSIEPSKYAYMSSWPRDDWRRQALTLYLITWLFGVCVYYLFAGLSYLLVFDKATFNHPRYLKHQIKLEMKQANIAFPIMAIFTVPWFLAEVRGYSKLYDTTEKGPGRWYDYLQIPFFIAFTDLCIYWIHRGLHHPMVYKHIHKPHHKWIMPTPFASHAFHPIDGYAQGLPYYIFPFLFPLSKIASVAFFVFVNIWTVLIHDGEYAHNSPIINGAACHTMHHLYFNYNYGQFTTLWDRLGGSYRKPNDELFKRELKMCQDEWNKQAKAVDMMVEQVEGENDRSYQGEPESKKVQ

SEQ ID NO: 16905 - protein, 361 aa, Phytophthora cinnamomi
MTIFNSTFAAVVIFSAVATGSPMIRQEVEAGDPCNLTGTYKAGTDISSCSTITVGPLTVPAGVTLDLSRAKDGATITFIGTTTFGTMQWSGPLVSVSGNSLTVKGSGTLDGQGDWYWKLGESITRPVFFKLQSAISSDLSGFTVKNSPFRTFSIVTCQQTTLSGLTLDSSSGNGRAQNTDGFDLSKNDHVTITGNKIYNQDDCLAMQSSTNTIFSNNLCSGSHGISVGSIGGEAVDPSTTVRGLTVQDNTIVNSDNGLRIKALIGTKGLVTDVKYINNQLQNVQNAIAIHSDYSRSTGAYTGTPTSQVTISDITVDGLQGSADQIYDILVNPSAVSGWTFKGITVTGAKGTCKGQPSGITC

SEQ ID NO: 16906 - protein, 361 aa, Phytophthora cinnamomi
MKLFSIALAAFALIAATANGSPMMRQEQEASSCTLSGTYKSGTDISSCSTLTIGTLSVPAGVTLDLSKAKTGATIKISGTVTFGEKKWAGPLVLLGGSDLTVSGSGTLDGQGAWYWKQGTSISRPVFFRLHGVTGSTLSGFKIKNSPYRTFSILNSEKTTISGLTLDSSAGDGTAKNTDGFDLSKNNYVTITGNKIYNQDDCLAMQSSTNTVFSNNYCSGGHGISIGSIGGSTVSSADTVSGLTVKGNTIVNSVNGIRIKTIVDLKGLVSDVTYTDNKLSSVKNAIVIHSDYSKSKGGYTGKATSAVTIKGVTISGLSGTATNLYDIVANSKVVSNWKFSGITVKASKTGTCSGQPSTVTC

SEQ ID NO: 16907 - protein, 361 aa, Phytophthora cinnamomi
MKLFSTALATFALIAATANGSPMMRQEQEATSCTLSGTYKSGTDISSCSTLTIGTLSVPAGVTLDLSKAKTGATIKISGTVTFGEKKWAGPLVLLGGSDLTVSGSGTLDGQGAWYWKQGTSISRPVFFRLHGVTGSTLSGFKIKNSPYRTFSILNSEKTTISGLTLDSSAGDGTAKNTDGFDLSKNNYVTITGNKIYNQDDCLAMQSSTNTVFSNNYCSGGHGISIGSIGGSTVSSADTVSGLTVKGNTIVNSVNGIRIKTIVDLKGLVSDVTYADNKLSSVKNAIVIHSDYSKSKGGYTGKATSAVTIKDVTISGLSGTATNLYDIVANSKVVSNWKFSGITVKASKTGTCSGQPSTVTC

SEQ ID NO: 16908 - protein, 361 aa, Phytophthora cinnamomi
MKVFTPTLAAVALVASAVSASPMMRQVKESSSSCTLSGTYTSGTDVSSCSTITISSLTVPAGVTLDLSDVADGATIEFTGTTTFETSEWEGPLILLTGTDLTVGGTGTLDGQGDWYWEKGTSIDRPVFFRMSKVISSTVSDFTIKNSPYRTFSIINSQSTTVSGLTLDSSAGDGTAKNTDGFDLSGNTGVTISGNTIYNQDDCLAMQSSTNTVFSSNTCSGGHGISIGSIGGSSVSSSDTVSGLTVKNNKIVDSVNGIRIKTIIDDYGTVEDVTYTSNTLSNVENAIVIHGDYSKSEGGYTGSATSKVTITGITIDGLTGSADTVYDILIDSDVASDWTFSGIDVSGSTGSCSGEPSGITC

SEQ ID NO: 16909 - protein, 363 aa, Phytophthora cinnamomi
MKFFAPVLAATALVFAAVSGSPMIRQEAEEVESSSCTLTGTYTSGTDVSSCSTVTISSLTVPAGVTLDLSDLKSGASVVFSGTTTFGKKKWSGPLVLLTGTKLTVSGSGTLDGQGSWYWKQGTSITRPVFFRMSKVISSTVKGFTIKNSPYRTFSILSSQSTTISGLTLDSSDGDDLAKNTDGFDLSKNTGVTITGCKIYNQDDCLAMQSSTNTVFSSNTCSGGHGISIGSIGGSSISSSDTVSGLTVKNNKIVDSVNGIRIKTIIDLTGKVTDVTYTSNTLSNVENAIVIHGDYSKSKGGYTGTASSKVYVTDITIDGLTGSADQIYDILVNSKYVSGWTFSGIDVSGSTGSCSGEPSSVDC

SEQ ID NO: 16910 - protein, 335 aa, Malus x domestica
MADESVAGSADFPVKRPREEEENGSAAAASAVSMEPDGGKEPDSVSAVIPGWFSEISSMWPGEAHSLKIEKILFQGKSDYQNVMVFQSATYGKVLVLDGVIQLTERDECAYQEMITHLPLCSIPNPKKVLVIGGGDGGVLREVARYASVEKIDICEIDKMVIDVSKQFFPEVAIGYEDPRVTLHVGDGVAFLKAVPAGTYDAVIVDSSDPIGPAKELFEKPFFQTVANALRPGGVVCTQAESIWLHMHIIEDIVANCREIFKGSVNYAWTTVPTYPSGVIGFMLCSTEGTAVDFKHPVNSIDESKRPLRFYNSEIHTAAFCLPSFAKKVIDAKAK

SEQ ID NO: 16911 - protein, 335 aa, Malus x domestica
MADEIVVGSADLPLKRPREEEENGAEAAASAVSMETDGGKEPDSVSAVIPGWFSEISPMWPGEAHSLKIEKILFQGKSDYQNVMVFQSATYGKVLVLDGVIQLTERDECAYQEMITHLPLCSIPNPKKVLVIGGGDGGVLREVARYASVEKIDICEIDKMVVDVSKQFFPDVAIGYDDPRVSLHVGDGVAFLKAVPAGTYDAVIVDSSDPIGPAKELFEKPFFQTVANALRPGGVVCTQAESIWLHMDIIEDIVENCREVFKGSVNYAWTTVPTYPSGVIGFMLCSTEGPAVDFKHPVNSIDASKRPLKFYNSEIHTAAFCLPSFAKKVIDAKAK

SEQ ID NO: 16912 - protein, 292 aa, Malus x domestica
MINFTPLLSYMSSSVGMQGEAHSLKIEKILFQGKSDYQNVMVFQSATYGKVLVLDGVIQLTERDECAYQEMITHLPLCSIPNPKKVLVIGGGDGGVLREVARYASVEKIDICEIDKMVVDVSKQFFPDVAIGYDDPRVSLHVGDGVAFLKAVPAGTYDAVIVDSSDPIGPAKELFEKPFFQTVANALRPGGVVCTQAESIWLHMDIIEDIVENCREVFKGSVNYAWTTVPTYPSGVIGFMLCSTEGPAVDFKHPVNSIDASKRPLKFYNSEIHTAAFCLPSFAKKVIDAKAK

SEQ ID NO: 16913 - protein, 370 aa, Streptococcus salivarius
MKWHEAESNPELLELWVADMDFLPVPEIRDAVINYAETHIFGYPYPSEELYQSIINWEKNQHGYVVDKESIVLIEGVVPAISTAIQAFTKEGDAVLINTPVYPPFARSVRLNNRRLIENSLVKVNGHFEIDFEQLERDIVENDVKLYVFCSPHNPGGRVWTKEELTKVADLCQKHGVLLVSDEIHQDLALYGNKHISMNTISDAYKDFTLVLSSATKTFNIAGTKNSFTIIENEDLRKAFKQKQLANNQHEIPTIGLITTQAALTYGQPWLEELKTVFETNIDLLTKELSEKTNIKVMKPEGTYLVWLDFSAYDQDHNELGRLLKEEAKVVLNDGITFGSEGEKHFRFNVATPTTVVAEGVKRLVSVFGK

SEQ ID NO: 16914 - protein, 219 aa, Leymus triticoides
  misc_feature (50)..(50): Xaa can be any naturally occurring amino acid
GRRRVEMEDRHVAKLALGGDPEVALFAVFDGHGGAAEFAAENMPKFMAEXVRKVDGGGSEEIEGAVKKCYLKTDEEFLKREESGGACCVAALLQKGGLTVSNTGDCRAVLSRAGTAEALASDHRASCEDERERIENLGGFIVNNRGTWRVQDSLAVSRGIGDAHLKQWVVADPDTRTLLVDPQCEFLVLASDGLWDKVDNQEAIDIARPLCIGNDKASR

SEQ ID NO: 16915 - protein, 221 aa, Leymus cinereus
GRRRVEMEDRHVAKLALGGDPEVALFAVFDGHGGKNAAEFAAQNMPKFMAEEVRKVDGGDSDEIEGAVKKCYLKTDEEFLKREESGGACCVTALLQKGGLTVSNTGDCRAVLSRSGTAATLTSDHRASREDERERIENLGGFVVNNRGTWRVQGSLAVSRGIGDAHLKQWVVADPDTRTLLVDPQCEFLVLASDGLWDKVDNQEAIDIARPLCIGNDKASR

SEQ ID NO: 16916 - protein, 206 aa, Nicotiana tabacum
MSATGKVESSAVEQPPAKAPKAEDQPPATKKSVKEKKPRAPREKKPKSAKTVTHPPYFQMIKEALLALNEKGGSSPYAIAKYMEDKHKDELPANFRKILGLQLKNSAAKGKLMKIKASYKLSVAGKKERTTASTKKVPKADTKKKPRSTRSTTATAKKTEVAKKAKPTQKPKKVGAKKIRKSTPAKAKQPKSIKSPAAKRAKKVAA

SEQ ID NO: 16917 - protein, 175 aa, Capsicum annuum
MDLIDKAKNFVSEKVANMEKPEATITDVDLKRIGFDGVSFHAKVSVKNPYSVPIPIMEIDYVLKSASRVIASGRIPDPGNLKANDSTMLDVPVKVPHSVLISLARDIGGDWDVDYTLELGLIIDLPVIGNITIPLSYSGEYKLPTLSDLWKGGKEEEKKKEEEEEKEDPSKVVEI

SEQ ID NO: 16918 - protein, 437 aa, Corynebacterium glutamicum
MTHMTSSNTARSAEWFEKAQKLTPGGVNSPVRAFGSVGGQARFIEKAHGSTLIDVDGNEYVDLVCSWGPMLMGHAHPAVVEAVQKAVVDGLSFGAPTIGEVELAQDIVKRTSVEEVRLVNSGTEATMSAVRLARGYTQRSKILKFEGCYHGHVDALLASAGSGVATFALPDSPGITGAQTSDTIVVPYNDIEAVRNAFAEYPGEIACIIAEAAGGNMGTVAPKDNFNDKLLAIAHADGALLILDEVMTGFRTSYRGWFGIDKVAADLVTFGKVVSGGLPAAAFGGKAEIMNMLAPQGPVYQAGTLSGNPVAVAAGRASLKLADESLYTTINANADRLHGLISDALTHEGVAHHIQRASNMLSIRFAEGEGHNFSDMKAADTFRFAPFFHTLLDNGVYAPPSVFETWFVSSALTDDDFSKIEQALKPAARAAAEAKAS

SEQ ID NO: 16919 - protein, 357 aa, Dioscorea gracillima
LKQKIDRMYNGEKINCTENRSVLHIALRAARDKVIESDGKNVVPDVWHVLDKIKEFSEIIRSGSWVGATGKALTDVVAVGIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGIPLPFETGEIDFGEPGTNGQHSFYQLIHQGRVIPCDFIGVMRSQQPIYLKGEVVSNHDEL

SEQ ID NO: 16920 - protein, 357 aa, Dioscorea nipponica
LKQKIDRMYNGEKINSTENRSVLHIALRAARDKVIESDGKNVVPDVWHVLDKIKEFSDRIRSGSWVGATGKALTDVMAVGIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLNGAASIDDHFHSIPFEKNIPVLLGLLSVWNVSFLGYPARAILPYSQALEKFGPHIQQVSMESNGKGVSIDGIPLPFEAGEIDFGEPGPNGQHSFYQLIHQGRVIPCDFIGVMRSQQPIYLKGEVVSNHDEL

SEQ ID NO: 16921 - protein, 357 aa, Dioscorea quinqueloba
LKQKIDRMYNGEKINCTENRSVLHIALRAARDKVIESDGKNVVPDVWHVLDKIKEFSERIRSGSWVGATGKALTDVVAVDIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLKGAASIDDHFHSTPFEKNIPVLLGLLSVWNVSFLGYPARAILPYSQALEKFAPHIQQVSMESNGKGVSIDGIPLPFETGEIDFGEPGTNGQHSFYQLIHQGRVIPCDFIGVMRSQQPIYLKGEVVSNHDEL

SEQ ID NO: 16922 - protein, 357 aa, Dioscorea septemloba
LKQKIDRMYNGEKINCTENRSVLHIALRAARDKVIESDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLGYPARAILPYSQALEKFAPHIQQVSMESNGKGVSIDGFPLPFETGEIDFGEPGTNGQHSFYQLIHQGRVIPCDFIGVMRSQQPIYLKGEVVSNHDEL

SEQ ID NO: 16923 - protein, 357 aa, Dioscorea tenuipes
LKQKIDRMYNGEKINCTENRSVLHIALRAARDKVIKSDGKNVVPDVWHVLDKIKEFSERIRSGSWVGATGKALTDVVAVGIGGSFLGPLFVHTALQTDPEAAECAKGRQLRFLANVDPIDVARSIAGLNPETTLVVVVSKTFTTAETMLNARTLREWISAALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGIMRSQQPIYLKGEVVSNHDEL

SEQ ID NO: 16924 - protein, 354 aa, Ipomoea nil
MVGGNHTPASPAPTVCVTGAAGFVGSWLVMKLLQRGYIVHATVRDPGNAQKVKHLLELPKGEGKLKVWKGVLEEEGSFDEAIAGCEGVFHVAAAVNFASKDPENEVIKPAVKGILSIINSCAKAKTVKKLVFTSSTAAVHIKETQQLEYDESSWSDLDFIYANKMGGWMYFASKTLAEKEAWKAAKEKQIEFISIIPPLVIGPFLIPTFPLSLVTALSPIMGNGLHHNIIKQGKFVHLDDLCEAQIFLYQHPKAGGRFICSSHHATIHDVAKMIRHNWPEYYVPSEFKGIEKELPIVSFSSKKLQEMGFQFKYTLEDMYKGAIETLRKKGLLPYSTKEPADIEQEQHSGKEPKS

SEQ ID NO: 16925 - protein, 403 aa, Ipomoea nil
MVDGNHPLLPPKVCVTGAAGFIGSWLVKTLLQRGYHIHATVRDPGNTKKVKHLLELPKADTNLTIWKGVMEEEGSFDEAIAGCEGVFHVATPMDFDSKDPENEVIKPAINGVLNIINSCVKAKTVKRLVFTSSAGTLNVQPQQKPVYDETCWSDLDFIYAKKMTGWMYFASKILAEKEAWKVTKEKKIDFISIIPPLVVGPFITPTFPPSLITALSLITGNQAHYSIIKQGQYVHLDDLCEAHIFLYEHPKAEGRFICSSHHTTIHGLADMITQNWPEYYIPSEFKGIEKDLPVVYFSSKKLQDMGFQFKYSLEDMYRGAIETLRKKGLLPYSTKEAAAIEEEQETVALKVEKPTAIEQKQEAKTVPLKPSAIEQKQETAVPLKLEEEPTAIEQKQEVVPLKA

SEQ ID NO: 16926 - protein, 356 aa, Ipomoea nil
MSGGGRNAPTLPAPKVCVTGAAGYVGSWLVMKLLQRGYVVHATVRDPGNTKKVKRLLELPKAAEGKLRLWKGVLEEEGSFDDAIAGCEGVFHVAATPVDFVSDDPENEIIRPAVKGILSIINSCAKAKTVKRLVFTSSAVTLIVQENPKPVYDESSWSDLDLIYAKKMPGWMYFASKTQAEKEAWKAAKEKQIDFISIIPPLVIGASIVPTVPLSFTIALSPVTGNEAHYFVIKQGQYVHLDDLCEAQIFLFEHPKAEGRFICSSHDATIHDLAKMIRQNWPEYYVPSEFKGIEKDLPVVSLSSKKLLDMGFQFKYTLEDMYREVIETLRNKCVLPYSIKPPPKEQEWENGKTLEA

SEQ ID NO: 16927 - protein, 231 aa, Prunus armeniaca [sequence omitted]

SEQ ID NO: 16928 - protein, 401 aa, Catharanthus roseus
MPKSWPIVISSHSFCFLPNSEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 16929 - protein, 356 aa, Hypocrea virens
MSRSNPPNNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDTLSKEQLKQLIYQEIMR

SEQ ID NO: 16930 - protein, 431 aa, Mycobacterium abscessus
MELRVRYSENERRKVRQKGHPCPPLCRRIPHRNRNVITSNPRNSNSRKVIMSSPISPWMNAELLELRDLAAKFFSAELAPHANRFADQHHVDRELWNRAGELGLLCMSIPEEYGGGGGTFAHEAVVLEEQARIGDSSWGAGLHSGIVAHYILQYATEELRAQWLPKMASGEMIGAIAMTEPGTGSDLQSVKTKALLDGDEYVITGSKTFITNGQQADLIIVVAKTDPSQGAAGISLIVVEADRAGFRRGKVLDKIGQRGQDTSELFFDEVRVPRSHLLGQAEGQGFIQLMTQLPQERLIVAVGAVAAMELALEQTLKYTREREAFGRPVFGFQNTKFTLAEAATETRIARVFLDYCIDLHLAGQLDVQTVAMAKWWTTERAMKVLDDCMQLHGGYGYMTEYPISRLWVDQRVQKIYAGTNEVMKEIISRSL

SEQ ID NO: 16931 - protein, 399 aa, Mycobacterium abscessus
MPGDHPGQFARPPCAVGTTTSEASLDRRDFNMKTRAAVLWGLEQKWEVEEVDLDPPGPGEVLVRLAATGLCHSDEHLVTGDLPIPLPVVGGHEGAGTVVECGEGVEDLSEGDSVILTFLPSCGRCSYCARGMGNLCELGAALMMGPQIDGTYRFHARGEDVGQMCLLGTFSEYTVVPQASVVKIDGGIPLDRAALIGCGVTTGYGSAVRTGEVRAGDTVVVVGAGGIGMNAIQGARIAGALAIVAVDPVNFKREQASGFGATHTAASMDEAWSLVSDMTRGKLADVCILTTDVAEGSYTAEALALVGKRGRVVVTAIGHPDESSISGSLLEMTLYEKQIRGALYGSSNAPHDIPRLVELYSAGLLKLDELVTREYSLDQINEGYQDMRSGRNIRGLVRF

SEQ ID NO: 16932 - protein, 399 aa, Mycobacterium abscessus
MTDAGTTTASEDGAARFVVAPEAWTTPERRALSQMARSFVEREIAPKLAEWEHVGEIPRDLHLNAAEVGLLGIGFPEEVGGSGGNAIDSALVTEAILAAGGSTGVCAALFTHGIALPHIAANGSDALIERYVRPTLAGKMIGSLGVTEPGAGSDVANLRTRAVREGDTYVVNGAKTFITSGVRADFVTTAVRTGGPGYGGVSLLVIDKNSPGFEVSRRLDKMGWRCSDTAELSFVDVRVPADNLVGAENSGFLQIMQQFQAERLGIAVQAYATAGRALDLAKSWARERETFGRPLTGRQIIRHKLAEMARQVDVACTYTRAVMQRWLAGEDVVAEVSMAKNTAVYACDYVVNEAVQIFGGMGYMRESEIERHYRDCRILGIGGGTNEIMNEVIAKRIGL

SEQ ID NO: 16933 - protein, 362 aa, Penicillium citrinum
MGVAMTEGSFIPPVKQTILTVNDKDEVVIWDDAPTPKLPADQVYVRIHAVAVNPSDTKMRGDFATPFACLGTDYAGTVVAVGSEITHVKVGDRVFGAQNEMCPRTPEQGAFSQYTITRGRIWAKIPDSMTWEAAASLPAGISTTGLAMKLLGMPLPYSETKPSKKTYVLIYGGSTATATIAMQFMRLSGYTPIATCSHKNFDLAKKNGAEEVFDYRDADCAQKIRDYTRNNLAYALDCIINVESTSTCYKAIGRAGGRYVALNPFPEHAATRKMVTSDWTLGPTIFGEGSTWPAPYGCEASEEVRLFGTELWQVASRLVEEDKLYHHPLRVIDGGLEQVKQGMETVRNGELSGEKIVVRFSV

SEQ ID NO: 16934 - protein, 2563 aa, Penicillium citrinum
MNNTPAVTATATATATATAMAGSACSNTSTPIAIVGMGCRFAGDATSPQKLWEMVERGGSAWSKVPSSRFNVRGVYHPNGERVGSTHVKGGHFIDEDPALFDAAFFNMTTEVASCMDPQYRLMLEVVYESLESAGITIDGMAGSNTSVFGGVMYHDYQDSLNRDPETVPRYFITGNSGTMLSNRISHFYDLRGPSVTVDTACSTTLTALHLACQSLRTGESDTAIVIGANLLLNPDVFVTMSNLGFLSPDGISYSFDPRANGYGRGEGIAALVIKALPNALRDQDPIRAVIRETALNQDGKTPAITAPSDVAQKSLIQECYDKAGLDMSLTSYVEAHGTGTPTGDPLEISAISAAFKGHPLHLGSVKANIGHTEAASGLASIIKVALALEKGLIPPNARFLQKNSKLMLDQKNIKIPMSAQDWPVKDGTRRASVNNFGFGGSNAHVILESYDRASLALPEDQVHVNGNSEHGRVEDGSKQSRIYVVRAKDEQACRRTIASLRDYIKSVADIDGEPFLASLAYTLGSRRSILPWTSVYVADSLGGLVSALSDESNQPKRANEKVRLGFVFTGQGAQWHAMGRELVNTFPVFKQAILECDGYIKQLGASWNFMEELHRDELTTRVNDAEYSLPLSTAIQIALVRLLWSWGIRPTGITSHSSGEAAAAYAAGALSARSAIGITYIRGVLTTKPKPALAAKGGMMAVGLGRSETNVYISRLNQEDGCVVVGCINSQCSVTVSGDLGAIEKLEKLLHADGIFTRKLKVTEAFHSSHMRPMADAFGASLRDLFNSDNNNDNPNADTSKGVLYSSPKTGSRMTDLKLLLDPTHWMDSMLQPVEFESSLREMCFDPNTKEKAVDVIIEIGPHGALGGPINQVMQDLGLKGTDINYLSCLSRGRSSLETMYRAATELISKGYGLKMDAINFPHGRKEPRVKVLSDLPAYPWNHQTRYWREPRGSRESKQRTHPPHTLIGSRESLSPQFAPKWKHVLRLSDIPWIRDHVVGSSIIFPGAGFISMAIEGFSQVCPPVAGASINYNLRDVELAQALIIPADAEAEVDLRLTIRSCEERSLGTKNWHQFSVHSISGENNTWTEHCTGLIRSESERSHLDCSTVEASRRLNLGSDNRSIDPNDLWESLHANGICHGPIFQNIQRIQNNGQGSFCRFSIADTASAMPHSYENRHIVHPTTLDSVIQAAYTVLPYAGTRMKTAMVPRRLRNVKISSSLADLEAGDALDAQASIKDRNSQSFSTDLAVFDDYDSGSSPSDGIPVIEIEGLVFQSVGSSFSDQKSDSNDTENACSSWVWAPDISLGDSTWLKEKLSTEAETKETELMMDLRRCTINFIQEAVTDLTNSDIQHLDGHLQKYFDWMNVQLDLARQNKLSPASCDWLSDDAEQKKCLQARVAGESVNGEMISRLGPQLIAMLRRETEPLELMMQDQLLSRYYVNAIKWSRSNAQASELIRLCAHKNPRSRILEIGGGTGGCTKLIVNALGNTKPIDRYDFTDVSAGFFESAREQFADWQDVMTFKKLDIESDPEQQGFECATYDVVVACQVLHATRCMKRTLSNVRKLLKPGGNLILVETTRDQLDLFFTFGLLPGWWLSEEPERKSTPSLTTDLWNTMLDTSGFNGVELEVRDCEDDEFYMISTMLSTARKENTTPDTVAESEVLLLHGALRPPSSWLESLQAAICEKTSSSPSINALGEVDTTGRTCIFLGEMESSLLGEVGSETFKSITAMLNNCNALLWVSRGAAMSSEDPWKALHIGLLRTIRNENNGKEYVSLDLDPSRNAYTHESLYAICNIFNGRLGDLSEDKEFEFAERNGVIHVPRLFNDPHWKDQEAVEVTLQPFEQPGRRLRMEVETPGLLDSLQFRDDEGREGKDLPDDWVEIEPKAFGLNFRDVMVAMGQLEANRVMGFECAGVITKLGGAAAASQGLRLGDRVCALLKGHWATRTQTPYTNVVRIPDEMGFPEAASVPLAFTTAYIALYTTAKLRRGERVLIHSGAGGVGQAAIILSQLAGAEVFVTAGTQAKRDFVGDKFGINPDHIFSSRNDLFVDGIKAYTGGLGVHVVLNSLAGQLLQASFDCMAEFGRFVEIGKKDLEQNSRLDMLPFTRDVSFTSIDLLSWQRAKSEEVSEALNHVTKLLETKAIGLIGPIQQHSLSNIEKAFRTMQSGQHVGKVVVNVSGDELVPVGDGGFSLKLKPDSSYLVAGGLGGIGKQICQWLVDHGAKHLIILSRSAKASPFITSLQNQQCAVYLHACDISDQDQVTKVLRLCEEAHAPPIRGIIQGAMVLKDALLSRMTLDEFNAATRPKVQGSWYLHKIAQDVDFFVMLSSLVGVMGGAGQANYAAAGAFQDALAHHRRAHGMPAVTIDLGMVKSVGYVAETGRGVADRLARIGYKPMHEKDVMDVLEKAILCSSPQFPSPPAAVVTGINTSPGAHWTEANWIQEQRFVGLKYRQVLHADQSFVSSHKKGPDGVRAQLSRVTSHDEAISIVLKAMTEKLMRMFGLAEDDMSSSKNLAGVGVDSLVAIELRNWITSEIHVDVSIFELMNGNTIAGLVELVVAKCS

SEQ ID NO: 16935 - protein, 277 aa, Asparagus officinalis
ACENWGFFELLNHGISIELLDKVEGMTKGHYKKCMEQKFKEFAKQALERGEELDMISNMDWESTFFLKHLPQSNITGIPDLEDEYREVMKEFALELEKLAERLLDLLCENLGLEQGYLKNRFGGSNGPTFGTKVTNYPPCPRPELFKGLRAHTDAGGLILLFQDDKVTGLQLLKDANWVDVPPMTHSIVVNLGDQLEVITNGKYKSVMHRVVAQTDGNRMSIASFYNPGGDAVIYPAPALIKEEEEEKENEVTTYPKFVFEDYMKLYVAQKFQAKEP

SEQ ID NO: 16936 - protein, 469 aa, Pantoea agglomerans
MSAEHVLSMMNEHEVKFVDLRFTDTKGKEQHVTIPAHQVNADFFEEGKMFDGSSIGGWKGINESDMVLMPDATTAVMDPFFEDSTLIIRCDILEPGTMQGYDRDPRSIAKRAEDFLRSSGIADTVLFGPEPEFFLFDDIRFGSSTSGSHVAIDDIEAAWNTGKEYEGGNKGHRPGLKGGYFPVPPVDSSQDIRSAMCLTMEQMGLVVEAHHHEVATAGQNEVATRFNTMTKKADEIQIYKYVVHNVAHAYGKTATFMPKPMFGDNGSGMHCHMSLSKGGQNLFAGDKYGGLSEMALFYIGGIIKHAKAINALANPTTNSYKRLVPGYEAPVMLAYSARNRSASIRIPVVASPKARRIEARFPDPAANPYLAFTALLMAGLDGIINKIHPGDAMDKNLYDLPPEEEAEIPKVAGSLEEALNALNEDREFLTRGGVFTDESIDAYIELRKAEMDRVRMTPHPVEFELYYSV

SEQ ID NO: 16937 - protein, 1184 aa, Cryptococcus neoformans var. neoformans
MFVTRPPFSPLDHRGSPLEDDHTNTSGSSRDDVPSSHSTNTAFHEFKSSTPFPPHYLNVPSGLAFKTYLEKWGPEQIMGFLAIHGCEHHSGIFIKNSIDGKLLLDLDMSVLTSLGITKVGERVRLMAGIKCLRQRIAHEAEKDNVRSAHLCNGSLGMDRVKVMIHPKMSASLYVCRQGPFDSDPSTARRSRLTPSSSADRERNPSPMQRSQEVMKHSFITRSSGGQVIPPLWSGQIHNHGIDNSPTPGLYQPPMQRSVPLRSSVSYSDIAAKGMPLLVTQSINSAADHTFAVTDSHDTTSSLGGHLPRPDYFHSTNDAFQTCTKGEDNTISELPQRNQESSPSKWKKSGVICEDEAMLDSSPFAPTSPKHPFAINVTGNNVMEYPPNLPIKNCLSLRSFQSPDKSAGEDRLNMNPRAPSLDDLRRKLVKFVNAEDGTTRTVNVMKATSGAEVLERALRKFGKTGTGSAPFLDEENHNGGKYEGSLCIDGWGVFAEDLLGEEIGPMTEGDLFDICASLQNGAAIQRDALILRQTSESQKRKDMRFYLGNMPVLPTPVNLPISFYSPHSGQFERNSALQHTAQHQPLLSKNRSRASMMSIMSGLGVSHPDIKQPTHDSVQSPTSVTRSSSKKKSMYNFFGHRPPSELISSHLADYFPSAKKRDVAKVRGSMLRLNIAHTAEHDPRSVKSLGMIETDDMPFSSTEQSLTEQGGHYFDPSTCQPADTSSRGHVDHIITDHAGNSKGYYRLPCDEKASPTVKTQELHSANSANSILRACPPNLPPTYQSARLTDLHSDSTFSQLQLLRHSSSLSFKQPSSSHRRTVDEITAEMQHRQTSLSSNRPTSTIDSDISGPPCDSETSPDHTSDVSDVSESSSEYWDDQSSVSSKDSDHNTVEHTRAFTSNGSKRNIKWIKGALIGAGSFGSVFLGMDAQSGLLMAVKQVELPRGIAKMEARRRDMLSALEREIELLKDLQHENIVQYLDSSADANHLNIFLEYVPGGSVAALLNSYGAFEEALVGNFVRQILTGLNYLHERDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPDIPSDISAHAADFLSRAFALDYRMRPSATSLLQHAFIIHDGSGGNDEV

SEQ ID NO: 16938 - protein, 414 aa, Azoarcus evansii
MNAPAEHANLARQHLIDPEICIRCNTCEEICPVDAITHDSRNYVVKFETCNGCLACISPCPTGAIDSWRNVDKATPHSLADQYSWDYLPDTTELDQFEATVMGAAELPAEVQQITEVATAGQGGPAMAPWSASHPYVNLYTPANPITATVTGNYRLTAEDASSDIHHIVLDFGTTPFPVLEGQSIGIIPPGVDEKGKPHLLRMYSVASPRDGERPHYNNLSLTVKRVVEDHEGNPTRGVASNYVCDLKKGDKVQVTGPYGSTYLMPNHPGSSIMMICTGTGSAPMRAMTERRRRRMDRKEGGELVLFFGARAPEELPYFGPLQKLPKEFIDINFAFSRVPGEPKRYVQDAIRERADKVFQMLQDDNCYIYICGLKGMEAGVLEAFRDICRAKGADWDALRPQLLSKARFHVETY

SEQ ID NO: 16939 - protein, 352 aa, Leptosphaeria maculans
MPPTGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTNDLALDLLERLLAFNPVKRITVEEALKHPYLEPYHDPDDEPTADPIPEEFFDFDKNKDNLTKEQLKLLIYQEIMR

SEQ ID NO: 16940 - protein, 365 aa, Buchnera aphidicola
HVDHGKTTLTAAITTVLAKKYGGSARAFDQIDNAPEEKARGITINTSHVEYDTSLRHYAHVDCPGHADYIKNMITGAAQMDGAILVVAATDGPMPQTREHILLGRQVGVPYIVVFLNKCDMVDDEELLELVEMEVRDLLTQYDFPGDKTPIIRGSALKALEGDCIWESKIIDLANILDTYIPEPKRSIDQPFLLPIEDVFSISGRGTVVTGRVERGIIKVGEEVEIVGIKPTSKTICTGVEMFRKLLDEGRAGENVGVLLRGTKRDDIERGQVLSKPGTITPHIKFESEVYVLSKEEGGRHTPFFKGYRPQFYFRTTDVTGYVELPEGIEMVMPGDNVKMVVTLIHPIAMSDGLRFAIREGGRTV

SEQ ID NO: 16941 - protein, 365 aa, Buchnera aphidicola
HVDHGKTTLTAAITTVLAKKYGGSARAFDQIDNAPEEKARGITINTSHVEYDTSMRHYAHVDCPGHADYIKNMITGAAQMDGAILVVAATDGPMPQTREHILLGRQVGVPYIVVFLNKCDMVDDEELLELVEMEVRDLLTQYDFPGEKTPIIRGSALKALEGDAVWEEKIVDLANTLDSYIPTPERSIDQPFLLPIEDVFSISGRGTVVTGRVERGVIKVGEEVEIVGIKVTSKTICTGVEMFRKLLDEGRAGENVGVLLRGTKRDDIERGQVLAKPGTITPHIKFESEVYVLSKEEGGRHTPFFKGYRPQFYFRTTDVTGYVELPEGVEMVMPGDNIKMVVTLIHPIAMSDGLRFAIREGGRTV

SEQ ID NO: 16942 - protein, 232 aa, Helicobacter pylori
MNKVITDLDKALSTLKDGDTILVGGFGLCGIPEYAIDYIYKKGIKDLIVVSNNCGVDDFGLGILLEKKQIKKIIASYVGENKIFESQMLNGEIEVVLTPQGTLAENLRPGGAGIPAYYTPTGVGTLIAQGKESREFNGKEYILERAITGDYGLIKAYKSDTLGNLVFRKTARNFNPLCAMAAKICVAEVEEIVPAGELDPDEIHLPGIYVQHIYKGEKFEKRIEKITTRSAK

SEQ ID NO: 16943 - protein, 423 aa, Medicago sativa
MFGRGPTRKSDNTKYYDILGVSKSASEDEIKKAYRKAAMKNHPDKGGDPEKFKELGQAYEVLSDPEKKELYDQYGEDALKEGMGGGAGSSFHNPFDIFESFFGAGFGGGGPSRARRQKQGEDVVHSIKVSLEDVYNGTTKKLSLSRNALCSKCKGKGSKSGTAGRCFGCQGTGMKITRRQIGLGMIQQMQHVCPDCKGTGEVISERDRCPQCKGNKITQEKKVLEVHVEKGMQQGHKIVFEGQADELPDTITGDIVFVLQVKGHPKFRRERDDLHIEHNLSLTDALCGFQFNVTHLDGRQLLVKSNPGEVIKPGQHKAINDEGMPQHGRPFMKGRLYIKFSVDFPDSGFLSPSQSLELEKILPQKTSKNLSQKEVDDCEETTLHDVNIAEEMSRKKQQYREAYDDDDDEDDEHSQPRVQCAQQ

SEQ ID NO: 16944 - protein, 1401 aa, Schizosaccharomyces pombe
MGLEHTFYPAEDRFEPLLEHSEPVNFVPKENAKSYVRQGFASPHQSLMDNLVDSTESTKRSENFVSHIPLTPSHSGQSEKLMSTRTSHSPYISPTMSYTNHSPANLTRNSSFNHQHYSTTLRSPPSMRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLRLAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHDDSKAETDSLAASYKEESALPVASNVGLRQPNELRIDSINLPPAIVTPDTINYSVD

SEQ ID NO: 16945 - protein, 157 aa, Pseudomonas putida
MSQFDELAPQQLFKALESATTTASLPKLATLLDAIRFNEDGLIPAIAQQHDTGEVLMMAWMNREALEETLTTQRVCYFSRSRQKLWRKGETSGQQQRLKSAALDCDGDTLLVQVEQTGPACHSGRRSCFYVSLGADSAKITSEPLIDPATLYGKKAP

SEQ ID NO: 16946 - protein, 157 aa, Spiroplasma citri
MDKFNINEKMKRTKIITTIGPSTHSPGAIEELFKTGMTTIRLNFSHGDHAEQGARIVWAREVSAKIGKPISVLLDTKGPEIRAGIMKGGKQEIVAGATVTIYSLPTEYQNREGTGTEITVSYDMSQDLKVGDVVLVDDGKLQLNVTGIKPGIIETKA

SEQ ID NO: 16947 - protein, 425 aa, Podospora anserina
MVSLTDLFLASLLVPTSPWLCLPPRIDTIDQRGGRVTLKQVRNPRGHKAFNPARATYRTFLKYGVPAPDYIKKAVAHIDEEQEEAFARIKRDTGSAAAIPINEVDIAYVTPVTIGTPPQTLMLDLDTGSSDLWVFSSLTPSNQVRGQEIYSPTKSSTSKLLSGHTWSIRYGDGSGSRGTVYTDNFTIGGLEVKSQAVQAALEVSSMLTQEQSLDGLVGLGFSALNTVRPSSQLTFFDNARPNLDEEVFTADLKYHATGSYDFGFIDSKKYAGNITYTAVQQSPGYWTHSLSGYSVGSGAFQASQISGISDTGTTLLYLPTAIVTAYYRQVQGAQNSQYYGGYVFPCSSTLPTFTFGIEGARFTIPASYINYTRISPTSTTCYGGLQSSSGLGINIFGDVALKRAFVVFSGTNPPRIGFAIKPLAS

SEQ ID NO: 16948 - protein, 467 aa, Cuttsia viburnea
  misc_feature (80)..(80): Xaa can be any naturally occurring amino acid
  misc_feature (85)..(85): Xaa can be any naturally occurring amino acid
  misc_feature (459)..(459): Xaa can be any naturally occurring amino acid
SVGFKAGVKDYKLTYYTPDYETKDTDILAAFRVTPQPGVPPEEAGAAVAAESSTGTWTTVWTDGLTSLDRYKGRCYHIEXVPGEXNQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYITGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLASEGNEIIRGASKWSPELAAACEVWKEIKFXFQAMDTLD

SEQ ID NO: 16949 - protein, 351 aa, Rhodotorula graminis
MPRPRVLLLGDPARHLDDLWSDFQQKFEVIPANLTTHDGFKQALREKRYGDFEAIIKLAVENGTESYPWNADLISHLPSSLKVFAAAGAGFDWLDLDALNERGVAFANSRGAGDTATSDLALYLILSVFRLASYSERAARTGDPETFNRVHLEIGKSAHNPRGHVLGAVGLGAIQKEIARKAVHGLGMKLVYYDVAPADAETEKALGAERVDSLEELARRSDCVSVSVPYMKLTHHLIDEAFFAAMKPGSRIVNTARGPVISQDALIAALKSGKLLSAGLDVHEFEPQVSKELIEMKHVTLTTHIGGVAIETFHEFERLTMTNIDRFLLQGKPLLTVRLCPNSLRPAFRAY

SEQ ID NO: 16950 - protein, 500 aa, Amaranthus hypochondriacus
MAIRVPSRQLFIDGEWREPIKKNRIPIINPSTEEIIGVIPAATAEDVELAVAAARRALKRNKGEDWASASGAHRAKYLRAIAAKITEKKDYFAKLEAMDCGKPLDEAAWDIDDVAGCFEYYADQAEALDAKQKAPIALPMDTFKCHVLKQPIGVVGLISPWNYPLLMATWKVAPALAAGCSAVLKPSELASVTCLELAEVCREVGLPPGVLNILTGLGPEAGGPLACHPDVDKVAFTGSTATGSKVMSSAAQLVKPVTLELGGKSPIVIFEDVDLDKAAEWTAFGCFWTNGQICSATSRLLVHESIAAEFLDRLVKWCKNIKISDPFEEGCRLGPVVSKSQYEKVLKFISTAKSEGATILCGGSRPEHLKKGYYVEPTIISDVSTSMQIWREEVFGPVLCVKTFGSEDEAIELANDTQYGLGAAVLSKDLDRCERITKALQAGIVWVNCSQPCFCQAPWGGTKRSGFGRELGEWGIENYLNIKQVTEYISDEPWGWYKSP

SEQ ID NO: 16951 - protein, 397 aa, Schizosaccharomyces pombe
MSVVCSCLLPTPSTDFVNQRNMPIPIIAHIAQFKYEHLITHWAQYTKAAIAVSTIAAFKFWTSGRTTTWERKMNGMVVMVTGGSSGIGQVVVEKLASLGAQVVILLRTEPDQFTVDYIMDLRKRTKNQLIYTEVCDLSSMLSVRKFATKWIDCTPIRRLDMIVLCSGVLLPPFMDRQTTEEGVELQWATNFLGPYQLLRILRPVIYGQPGHREVRIVAATCSSYILGNIDFNDLDLSNHPYPRKSPWKVVGNAKLALMTYLYDFQKKAEAHERPDKMPCNLHTIMANPGVVRTPGFRRVVSFGKVWGLFLYLLLWPFWWLLLKGTIHGAQSFFHAICSPEFASITQPVLVNECSIVEYSRKEITDPEFAEKLIKAADAQIDEVEKQYKKKKIKKSKK

SEQ ID NO: 16952 - protein, 491 aa, Schizosaccharomyces pombe
MSLDKQIPIIYDFGENYEKNKDIWRRQCIYQILTDRFALDDHCTTAPSTGRMYLGGTWRGIIQKLDYIQSLGCTAVWISPIVKNIEGVTGYGEAYHGYWAEDLTQLNPHFGTKQDLTELVDQLHKRNMLCMIDIVVNHMAHAGDSPIDYSKYAPFNSPSHYHPKRFLHNYDDTWDCEIAWLGDEVVSLMDIRTEDQEVHNFFQNWIRDLIQTYHFDGLRIDTAKHVQKEFYPPFIAAANVFAFGEVYHGDPKFIAKYLEYIPSAANYPLYYQIENTFFPPKQSMNIFYQKAILEARATSMDTTILGNFTENHDVPRFLNRSTDYSLLCNTLTLLLFTDGIPIIFQGQEQMYAGGHDPENRDALWTSNYNQQNPIFQFLKKLIKLRQFLVDNVSGFTTELSNMLFVNEHVYVFRRPGVIIVVSNAGSNSDVDTSAEFSITERESLEFIDVLSGSQFSSLPTEDSSTISMNLEFSFPRVLVHRGLFHSMNELA

SEQ ID NO: 16953 - protein, 228 aa, Schizosaccharomyces pombe
MVQAKIAPSLLAGDFANLEKEVGRMLKYGSDWLHVDVMDAQFVPNLTIGPIVVKAMRNHYTKEEAFFDCHLMVIEPERYIDQLADAGASLFCFHYEATEKHEEIISRAHEKGMLVGCALKPKTPVEVILPFVEKLDMVLVMTVEPGKGGQSFMPECLPKVEFLRKKYPTLNVEVDGGLSLKTVDAAADAGANVIVAGTAVFHAQSPEEVISGLRNSVMKAQETKPWFK

SEQ ID NO: 16954 - protein, 372 aa, Schizosaccharomyces pombe
MASATSTPTIADGNSNKESVATSRSPHTHDLNFELPEEYEMINLIGQGAYGVVCAALHKPSGLKVAVKKIHPFNHPVFCLRTLREIKLLRHFRHENIISILDILPPPSYQELEDVYIVQELMETDLYRVIRSQPLSDDHCQYFTYQILRALKAMHSAGVVHRDLKPSNLLLNANCDLKVADFGLARSTTAQGGNPGFMTEYVATRWYRAPEIMLSFREYSKAIDLWSTGCILAEMLSARPLFPGKDYHSQITLILNILGTPTMDDFSRIKSARARKYIKSLPFTPKVSFKALFPQASPDAIDLLEKLLTFNPDKRITAEEALKHPYVAAYHDASDEPTASPMPPNLVDLYCNKEDLEIPVLKALIFREVNFR

SEQ ID NO: 16955 - protein, 325 aa, Schizosaccharomyces pombe
MQVVDEKTILELENERFDESSQFKTPEKLIVEASDMTAFRQSKAYYRIFDFLQRLNIASVGVNDYHVEYSTRVEKLVRILCRVKEITKTVPPASGRHRFGNPAFRIWHEKLRDSASQIMDIIIPDSLSKAKVELLDYFLGSFGNSQRIDFGTGHELNFLGFIKGLDLLGLLDAADYKAIALYITHVYLEVCRELVQTYRLEPAGSHGVWGLDDHFFIPYIFGSAQLADKASSSIIKPDAILNKKIVDEKANSNLYFSAIKFINVMKKGPFYEHSPILYDITAVPIWSKVNQGLIKMYDVEVLSKYPVVQHFHFGNLFPFNPLVAK

SEQ ID NO: 16956 - protein, 211 aa, Schizosaccharomyces pombe
MASNTAPKNVVTINQKLVLLGDSAVGKSSLVLRFVKDQFDDYRESTIGAAFLTQTLPIDENTSVKLEIWDTAGQERYKSLAPMYYRNANCAIVVYDITQAASLEKAKSWIKELQRQAPEGIVIALAGNKLDLAQERRAVEKADAEAYAAEANLLFFETSAKTAENVNELFTAIAKKLPLEDKLNQARGAVNRGVNLSEARPAAQPSGSCSC

SEQ ID NO: 16957 - protein, 333 aa, Lactobacillus casei
MKIIAYGARVDEIQYFKQWAKDTGNTLEYHTEFLDENTVEWAKGFDGINSLQTTPYAAGVFEKMHAYGIKFLTIRNVGTDNIDMTAMKQYGIRLSNVPAYSPAAIAEFALTDTLYLLRNMGKVQAQLQAGDYEKAGTFIGKELGQQTVGVMGTGHIGQVAIKLFKGFGAKVIAYDPYPMKGDHPDFDYVSLEDLFKQSDVIDLHVPGIEQNTHIINEAAFNLMKPGAIVINTARPNLIDTQAMLSNLKSGKLAGVGIDTYEYETEDLLNLAKHGSFKDPLWDELLGMPNVVLSPHIAYYTETAVHNMVYFSLQHLVDFLTKGETSTEVTGPAK

SEQ ID NO: 16958 - protein, 489 aa, Sulfolobus solfataricus
MYSFPNSFRFGWSQAGFQSEMGTPGSEDPNTDWYKWVHDPENMAAGLVSGDLPENGPGYWGNYKTFHDNAQKMGLKIARLNSEWSRQFPNPLPRPQNFDESKQDVTEVEINENELKRLDEYANKDALNHYREIFKDLKSRGLYFIQNMYHWPLPLWLHDPIRVRRGDFTGPSGWLSTRTVYEFARFSAYTAWKFDDLVDEYSTMNEPNVVGGLGYVGVKSGFPPGYLSFELSRRAMYNIIQAHARAYDGIKSVSKKPVGIIYANSSFQPLTDKDMEAVEMAENDNRWWFFDAIIRGEITRGNEKIVRDDLKGRLDWIGVNYYTRTVVKRTEKGYVSLGGYGHGCERNSVSLAGLPTSDFGWEFFPEGLYDVLTKYWNRYHLYMYVTENGIADDADYQRPYYLVSHVYQVHRAINSGADVRGYLHWSLADNYEWASGFSMRFGLLKVDYNTKRLYWRPSALVYREIATNGAITDEIEHLNSVPPVKPLRH

SEQ ID NO: 16959 - protein, 168 aa, Zea mays
MEYGQQGQRGHGRTGHVDQYGNPVGGVEHGTGGMRHGTGTTGGMGQLGEHGGAGMGGGQFQPAREEHKTGGILHRSGSSSSSSSEDDGMGGRRKKGIKEKIKEKLPGATRDDLHATATTGGAYGQQGHTGSAYGQQGHTGGAYATGTEGAGEKKGIMDKIKEKLPGQH

SEQ ID NO: 16960 - protein, 217 aa, Geobacillus stearothermophilus
MNLVLMGLPGAGKGTQAEKIVAAYGIPHISTGDMFRAAMKEGTPLGLQAKQYMDRGDLVPDEVTIGIVRERLSKDDCQNGFLLDGFPRTVAQAEALETMLADIGRKLDYVIHIDVRQDVLMERLTGRRICRNCGATYHLIFHPPAKPGVCDKCGGELYQRADDNEATVANRLEVNMKQMKPLVDFYEQKGYLRNINGEQDMEKVFADIRELLGGLAR

SEQ ID NO: 16961 - protein, 468 aa, Lactococcus lactis
MTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYCDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 16962 - protein, 452 aa, Arabidopsis thaliana
VPLGMSSVSTASLNCLPDELLVHVLSSLETKQAASTSVLSKRWRTLFAVRRNLDFDDSIISHPEVGEQNMDDVQESFRDFVDKRLAFQGSVPINKFSLIYGDKHDDVRVDRWINTALEHGVSELHLCLTSVTRRLHRFPSNVFRSTTLVKLTLGTNLFIVYFPSDTCLPVLKILVLDSIWFDRIKFSNVLLAGCPALEDLTIDQKSFPGLPNVVSSKTVKSLSIVYKYSADFDWFRTVALDTPNLVTLLYSTYARHRYRHCNLESLVNATLDLHFLENCDEAFEPNVTDLMIAVRNVQMLHLTSSATEVISQCCKGGLPMFKNLLVLVFLGNTERVWKVFLPLLLEHSPNLTKLCLESLFLILQGLYHGTDEDEFDEIHIPRSNKVNMLRIIQCQGTENELKHISHFLLKMECLQLVQVNFSETIVDSKKVQLTEDLMKLPSASSRLTMQVI

SEQ ID NO: 16963 - protein, 468 aa, Lactococcus lactis
MTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITCNGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 16964 - protein, 214 aa, Paeonia delavayi
IVESVGEGVTDLKPGDHVLPVFTGECKECRHCKSEESNMCDLLRINTERGVMLSDGKSRFSINGQPIFHFIGTSTFSEYTVVHVGCVAKINPEAPLDKVCILSCGISTGLGATLNVAKPKKGSSVAIFGLGAVGLAAAEGARIAGASRIIGVDLNPKRFEEAKKFGVTEFVNPKDYDKPAQEVIAEMTDGGVDRSVECTGSIMAMVSAFECVHD

SEQ ID NO: 16965 - protein, 214 aa, Paeonia brownii
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSVMAMMSAFECVHD

SEQ ID NO: 16966 - protein, 214 aa, Paeonia californica
IVESVGEGVTDVKPGDHVLPIFTGECKECRHCKSEESNMCDLLRINTDRGVMLNDGKSRFSVNGQPIFHFVGTSTFSEYTVLHVGCLAKINPEAPLDKVCVLSCGISTGLGATLNVAKPKKGSTVAIFGLGAVGLAAAEGARISGASRIIGVDLNPKRFDEARKFGVTEFVNPKDYNKPVQEVIAEMTGGGVDRSVECTGSVMAMMSAFECVHD

SEQ ID NO: 16967 - protein, 214 aa, Paeonia lutea
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRSDEARKFGVTEFVNPKDYNKPVQEVIAEMTGGGVDRSVECTGSIMAMMSAFECVHD

SEQ ID NO: 16968 - protein, 214 aa, Paeonia delavayi
IVESVGEGVTDVKPRDHVLPIFTGECKECRHCKSEESNMCDLLRINTDRGVMLNDSKSRFSINGQPIFHFVGTSTFSEYTVLHVGCLAKINPEAPLDKVCVLSCGISTGLGATLNVAKPNKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 16969 - protein, 214 aa, Paeonia suffruticosa subsp. spontanea
IVESVGEGVTDVKPGDHVLPIFTGECKECRHCKSEESNMCDLLRINTDRGVMLNDGKSRFSINGQPIFHFVGTSTFSEYTVLHVGCLAKINPDAPLDKVCVLSCGISTGLGATLNVAKPKKGSTVAIFGLGAVGLAAAEGARIACASRIIGVDLNPKRFDEARKFGVTEFVNPKDYNKPVQEVIAEMTGGGVDRSVECTGSIMAMMSAFECVHD

SEQ ID NO: 16970 - protein, 214 aa, Paeonia szechuanica
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECAGSIMAMMSAFECVHD

SEQ ID NO: 16971 - protein, 214 aa, Paeonia rockii
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 16972 - protein, 214 aa, Paeonia rockii
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHG

SEQ ID NO: 16973 - protein, 214 aa, Paeonia tenuifolia
IVESVGEDVTDVKPGDHVLPIFTGECKECRHCKSEESNLCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 16974 - protein, 214 aa, Paeonia veitchii
IVESVGEGVTDVKPGDHVLPIFTGECKECRHCKLEESNMCDLLRINTDRGVMLNDGKSRFSINGQPIFHFVGTSTFSEYTVLHVGCLAKINPEAPLDKVCVLSCGISTGLGATLNVAKPKKGSTAAIFGLGAVGLAAAEGARMAGASRIIGVDLNPKRFDEARKFGVTEFVNPKDYNKPVQEVIAEMTGGGVDRSVECTGSIMAMMSAFECVHD

SEQ ID NO: 16975 - protein, 469 aa, Methylobacterium extorquens
MPARIQPVILCGGSGTRLWPTSRTSLPKQFVPLLGPHSTFQQTLLRLQGPLFARPIVVANRDHRCLVEKQAAAIDAGVTLLLEPERRDSGPAILAACTLVAREDPEAVVLVLPSDHIVTEPRAFRRAVASALPAARAGRLVTFGIEADHASTEYGWIRPGTRVEARCHAVHTFAEKPDAARAATYLSDRWLWNSGNFLMRADTLCAEYAAFDPDTAAAAALAVEAAADEGGALALDAEGFAGTHKTSLDFAVMEKTSRAAVARMRCGWSDVGNWNALWAISERDDLGNVSRGAAELFDTEGCFVSSDGMVTSLVGVRDLVVVAEKDAILVADRSRCGDVRKMVEILRSKGRPQAEWHASSHRPWGSYRVLEASDGFQVKRITVAPGGRLSLQKHRHRAEHWVVVRGCARVTVDDTVADYRESEHIFIPLGAIHRLENPGNDDVELIEVQLGSYLGEDDIVRLEDAYHRA

SEQ ID NO: 16976 - protein, 252 aa, Kandelia candel
MPIRQIAVGHPHEATRPDVLKAALAEFISTLIFVFAGEGSGMAFNKLTDNGSTTPAGLIAASIAHAFGLFVGVSVSANISGGHVNPAVTFGAFIGGNITLLRGILYWIGQLLGSTVACLLLKFSTGGLTTSAFSLSSGVSVWNAFVFEIVMTFGLVYTVYATAIDPKKGNLGTIAPSPSVSLWVPSVWTGGAFDGASMNPAVSFGPALVSWTWENHWVYWAGPLIGSAIAALIYDSFFIGYGTHEQLPTADY

SEQ ID NO: 16977 - protein, 169 aa, Nicotiana tabacum
GLIVSFGEMLIDFVPTVSGVSLAEVPGFLKAPGGAPANVAIAVTRLGGKSAFVGKLGDDEFGHMLAGILKQNGVQADGINFDKGARTALAFVTLRADGEREFMFYRNPSADMLLTPDELNLEVIRSAKVFHYGSISLIVEPCRSAHLKAMEVAKEAGALLSYDPNLRLP

SEQ ID NO: 16978 - protein, 1055 aa, Zea mays
MADNGDAKGGSGAYAINIENFSKRLKVFYDHWKEHKSDLWGSSDAIAIATPPPSDDLRYLKSSALDIWLLGYEFPETIIVFMHKQIHVLSSQKKGNLIGTLKKAANEAVGVDIVLHVKTKNSDGADLMDDIVHAARNQSKSDKPVVGHIAKEAPEGKLLETWIKKLSGSGLRLVDVTNGFSELFAVKDTTEITCVKKAAYLTSSVLKNFVIPKLEKVIDEEKEVSHSSLMDDAEKAILDPLKVKVKLKPDNVDICYPPVFQSGGKFDLKPGASSNDEYLYYDSASIIICAIGSKYSSYCSNVARTYLIDATPTQNKAYETLRKAHEAAIQQVKPGNQMSAVYQAAVAVIERDAPELLPNLTKSAGTGIGLEFRESGLNLNAKNDRRIKKGMVFNVSLGLHNIQAETTSEKTKQFSLLLADTVLVNERGHEILTAPCSKAFKDVAYSFNEDDDAVAAEVKIKSKTIDVMPTKATLRSDNQEMSKEELRRQHQAELARQKNEETARRLAGVGTGSGDGRGPARASNELVAYKNVNDVPFVRDLVIQVDQKNEAVLLPIYGSMVPFHVSTVKSVTSHQDNRTCTIRIFFNVPGMPFSNDSKFNSQGAIYLKEITFRSKDPRHSSEVVQQIKTLRRQVASRESERAERATLVTQEKLQIGSNRMKMMRLSDVWIRPAFGGRGRKLTGNLEAHFNGFRYSTSRSDERVDIMFGNIKHAFFQPAEKEMITLLHFHLHNHIMVGNKKTKDVQFYVEVMDVVQTLGGSRRSALDPDEIEEEQRERDRKNRINMDFQNFVNKVNDHWSQPQFKGLDLEFDVPLRELGFHGVPYKASAFIIPTSTCLVELIETPFLVVSLSEIEIVNLERVGFGTKNFDMAIVFKDFKKDVLRIDSIPSASLDAIKEWLDTTDLKYYESRLNLNWRPILKTIIDDPQKFIDDGGWEFLNMEASDSETEDTEESDQGYVPSDAEPESESEDDDSDSESLVESDDDDEESDEDSEEEKGKTWEELEREASNADREHGAESDSEEERRRRKAKTFGKSRAPERSSFKGAPPSKKPKFR

SEQ ID NO: 16979 - protein, 243 aa, Arabidopsis thaliana
MRFDPGARTALAFVTLTNEGEREFMFYRNPSADMLLEESELDFDLIKKAKIFHYGSISLITEPCKSAHISAAKAAKEAGVILSYDPNLRLPLWPSADNAREEILSIWETADIIKISEEEIVFLTKGEDPYDDNVVRKLFHPKLKLLLVTEGPEGCRYYTKDFSGRVHGLKVDVVDTTGAGDAFVAGILSQLANDLSLLQDEERLREALMFANACGALTVKVRGAIPALPTKEAVHEALLKAVV

SEQ ID NO: 16980 - protein, 362 aa, Oryza sativa (indica cultivar-group)
MASATLLKSSFLPKKSEWGATRQAAAPKPVTVSMVVRAGAYDDELVKTAKTIASPGRGILAMDESNATCGKRLASIGLEKHRSQPPGLPDPPCHRTGLGTVHLRCYPLRGELYHSTVDGVRMVDILTEHKIVPGIKVDKGLVPSAGSNNESWCQGLDGLASREAAYYQQGARFAEWRTVVSIPNGPSELLRSFSTVSMASTGSFQVAQKVWAENFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 16981 - protein, 175 aa, Oryza sativa (indica cultivar-group)
MGPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEDAKKAYPDAFVRIIGFDNVRQVQLISLIANKPPGRAEFGGN

SEQ ID NO: 16982 - protein, 235 aa, Photobacterium leiognathi
ASDGIMVARGDLGVEIPVEEVIFAQKMMIEKCNRARKVVITATQMLDSMIKNPRPTRAEAGDVANAIMDGTDAVMLSGESAKGKYPIEAVTIMAQICARTDDVVKPELGSRLDSPRLRITEAVCKGAVDTAEKLNAPLIIVATEAGKSARSVRKYFPTARILAVTTNTKTAAQLCLSKGVTPVVVDSIESTDAFYLRGKELALETGLGAKGDIVVMVSGALVASGTTNTASVHVL

SEQ ID NO: 16983 - protein, 199 aa, Schizosaccharomyces pombe
MADARKNNVTIKVGMIGDSSIGKTSLMVTYVQGSFDEESTQTLVGVNFMEKTISIRNTEITFSIWDLGGQREFVNMLPMVCNDAVAILFMFDLSRKSTLNSIKEWYRQARGFNKTAVPILIGTKYDHFMTFPREDQEEITKQARRYAKAMKASLVFCSTSHSINVQKIFKIVLAKVFDLKCTIPEIKNVGDPILEYIDR

SEQ ID NO: 16984 - protein, 1026 aa, Arabidopsis thaliana
MPSMLVLVGTMPSLASLVSLGGACASVSGTSSSDASYALVKRVSLSRRSVKGTKKWLCRYSVSSSTTTTTADFIADQNNNSVSIDSNSFRGSKDGDDSEVVLKQTPKPVLKPPVARVERGLGVNTAPWSKDLSNGGKFDGEEERNKVIESLGEVLDKAEKLEIPKPGNKEGGEAVKPSQPSANSSNSRNGSYANASDGGTRKTKTMKSVWRKGDAVAAVQKVVKESPKIFNRGVQTEPRTREEGEVNAKAGTPLAPPQPPFRPQPPVRPQPMLQGKPMVAPPVKKSPILKDLGMAAKPLVSEEVDSSVKSKERKPILVDKFASKKKGVDPAASQAVLAPTKPGKGPPSNKFRVEHRNKKNASASPRRRIVAEDDGDDDASISRSGRKGRKWSKASRKAVRLQAAKDAAPVKAEILEVEEEGMSIEDLAYNLAIGEGDILGYLYSKGIRPDGVHTLDREMVKMICRDYDVEVLDADSVKVEEMAKKRQTFDEEDLDKLEDRPPVITIMGHVDHGKTTLLDYIRKSKVAASEAGGITQGIGAYKVSVPVDGKLQSCVFLDTPGHEAFGAMRARGARVTDIAIIVVAADDGIRPQTNEAIAHAKAAAVPIVIAINKIDKEGASPDRVMQELSSIGLMPEDWGGDVPMVQISALKGENVDDLLETVMLVAELQELKANPHRNAKGIVIEAGLDKAKGPFATFIVQKGTLKRGDVVVCGEAFGKVRALFDHSGERVDEAGPSIPVQVIGLNNVPIAGDEFEIVSSLDVAREMAEARAVSLRDEGISAKAGDGKVTLSSLASAVSAKKMSGLDLHQLNIILKVDVQGSIEAVRQALQVLPQENVTLKFLLQATGDVSNSDVDLASASEAIVFGFNVKASGSVKKAAENKGVEIRLYRVIYELIDDVRNAMEGLLESVEEQIPIGSAEVRATFSSGSGRVAGCMVNEGKFVKDCGIRVVRKGKTVHVGVLDSLKRVKENVKEVSAGLECGIGMDDYDDWIEGDIIEAFNAVQKRRTLEEASASMSAAIEEAGV

SEQ ID NO: 16985 - protein, 243 aa, Arabidopsis thaliana
MKRDYAFVEFSDPRDADDARYYLDGRDFDGSRITVEASRGAPRGSRDNGSRGPPPGSGRCFNCGVDGHWARDCTAGDWKNKCYRCGERGHIERNCKNSPSPKKARQGGSYSRSPVKSRSPRRRRSPSRSRSYSRGRSYSRSRSPVRREKSVEDRSRSPKAMERSVSPKGRDQSLSPDRKVIDASPKRGSDYDGSPKENGNGRNSASPIVGGGESPVGLNGQDRSPIDDEAELSRPSPKGSESP

SEQ ID NO: 16986 - protein, 503 aa, Arabidopsis thaliana
MSNIQEMEMILMVSLCLTTLITLFLLKQFLKRTANKVNLPPSPWRLPLIGNLHQLSLHPHRSLHSLSLRYGPLMLLHFGRVPILVVSSGEAAQEVLKTHDLKFANRPRSKAVHGLMNGGRDVVFGPYGEYWRQMKSVCILNLLTNKMVASFEKIREEELNEMIKKLEKASSSSSSENLSELFVTLPSDVTSRIALGRKHSEDETARDLKKRVRQIMELLGEFPIGDYVPALAWIDRINGFNARIKEVSQGFSDLMDKVVQEHLEAGNHKEDFVDILLSIESEKSIGFQAQRDDIKFMILDMFIGGTSTSSTLLEWIMTELIRNPNVMKKLQDEIRSTIRPHGSYIKEKDVENMKYLKAVIKEVFRVHPPLPLILPRLLSEDVKVKGYNIAAGTEVIINAWAIQRDPAIWGPDAEEFKPERHLDSTLDYHGKDLNFIPFGSGRRICPGINLALGLVEVTVANLVGRFDWRAEAGPNGDQPDLTEAFGLDVCRKFPLIAFPSSVI

SEQ ID NO: 16987 - protein, 380 aa, Shigella flexneri 2a str. 301 [sequence omitted]

SEQ ID NO: 16988 - protein, 464 aa, Shigella flexneri 2a str. 301
MQPSRNFDDLKFSSIHRRILLWGSGGPFLDGYVLVMIGVALEQLTPALKLDADWIGLLGAGTLAGLFVGTSLFGYISDKVGRRKMFLIDIIAIGVISVATMCVSSPVELLVMRVLIGIVIGADYPIATSMITEFSSTRQRAFSISFIAAMWYVGATCADLVGYWLYDVEGGWRWMLGSAAIPCLLILIGRFELPESPRWLLRKGRVKECEEMMIKLFGEPVAFDEEQPQQTRFRDLFNRRHFPFVLFVAAIWTCQVIPMFAIYTFGPQIVGSLGLGVGKNAALGNVVISLFFMLGCIPPMLWLNTAGRRPLLIGSFAMMTLALAVLGLIPDMGIWLVVMAFAVYAFFSGGPGNLQWLYPNELFPTDIRASAVGVIMSLSRIGTIVSTWALPIFINNYGISNTMLMGAGISLFGLLISVAFAPETRGMSLAQTSNMTIRGQRMGLFVQISLFSESILLTISRVNI

SEQ ID NO: 16989 - protein, 347 aa, Shigella flexneri 2a str. 301
MRIEEDLKLGFKDVLIRPKRSTLKSRSDVELERQFTFKHSGQSWSGVPIIAANMDTVGTFSMASALASFDILTAVHKHFSVEEWQAFINNSSADVLKHVMVSTGTSDADFEKTKQILDLNPALNFVCIDVANGYSEHFVQFVAKAREAWPTKTICAGNVVTGEMCEELILSGADIVKVGIGPGSVCTTRVKTGVGYPQLSAVIECADAAHGLGGMIVSDGGCTTPGDVAKAFGGGADFVMLGGMLAGHEESGGRIVEENGEKFMLFYGMSSESAMKRHVGGVAEYRAAEGKTVKLPLRGQVENTARDILGGLRSACTYVGASRLKELTKRTTFIRVLEQENRIFNNL

SEQ ID NO: 16990 - protein, 457 aa, Shigella flexneri 2a str. 301
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 16991 - protein, 288 aa, Shigella flexneri 2a str. 301
MAEKKQWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVESITMVEIDAGVVSFCRQYLPNHNAGSYDDPRFQLVIDDGVNFVNQTSQTFDVIISDCTDPIGPGESLFTSAFYEGCKRCLNPGGIFVAQNGVCFLQQEEAIDSHRKLSHYFSDVGFYQAAIPTYYGGIMTFAWATDNDALRHLSTEIIQARFLASGLKCRYYNPAIHTAAFALPQYLQDALASQPS

SEQ ID NO: 16992 - protein, 426 aa, Shigella flexneri 2a str. 301
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKHTLTCTYNDLASVRAAFEQYPQEIACIIVEPVAGNMNCVPPLPEFLPGLRALCDEFGALLIIDEVMTGFRVALAGAQDYFAVVPDLTCLGKIIGGGMPVGAFGGRRDVMDALAPTGPVYQAGTLSGNPIAMAAGFACLNEVAQPGIHETLDELTTRLAEGLLEAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 16993 - protein, 272 aa, Shigella flexneri 2a str. 301
MKPENKLPVLDLISAEMKTVVNTLQPDLPSWPATGTIAEQRQYYTLERRFWNAGAPEMATRAYMVPTKYGQVETRLFCPQPDSPATLFYLHGGGFILGNLDTHDRIMRLLASYSQCTVIGINYTLSPEARFPQAIEEIVAACCYFHQQAEDYQINMSRIGFAGDSAGAMLALASALWLRDKQIDCGKIAGVLLWYGLYGLRDSVTRRLLGGVWDGLTQQDLQMYEEAYLSNDADRESPYYCLFNNDLTREVPPCFIAGAEFDPLLDDSRLLY

SEQ ID NO: 16994 - protein, 310 aa, Shigella flexneri 2a str. 301
MLDANKLQQAVDQAYTQFHSLNGGQNADYIPFLANVPGQLAAVAIVTCDGNVYSAGDSDYRFALESISKVCTLALALEDVGPQAVQDKIGADPTGLPFNSVIALELHGGKPLSPLVNAGAIATTSLINAENAEQRWQRILHIQQQLAGEQVALSDEVNQSEQTTNFHNRAIAWLLYSAGYLYCDAMEACDVYTRQCSTLINTVELATLGATLAAGGVNPLTHKRVLQADNVPYILAEMMMEGLYGRSGDWAYRVGLPGKSGVGGGILAVVPGVMGIAAFSPPLDEEGNSVRGQKMVASVAKQLGYNVFKG

SEQ ID NO: 16995 - protein, 164 aa, Shigella flexneri 2a str. 301
MVTFHTNHGDIVIKTFDDKAPETVKNFLDYCREGFYNNTIFHRVINGFMIQGGGFEPGMKQKATKEPIKNEANNGLKNTRGTLAMARTQAPHSATAQFFINVVDNDFLNFSGESLQGWGYCVFAEVVDGMDVVDKIKGVATGRNGMHQDVPKEDVIIESVTVSE

SEQ ID NO: 16996 - protein, 241 aa, Shigella flexneri 2a str. 301
MITLKNVSKWYGHFQVLTDCSTEVKKGEVVVVCGPSGSGKSTLIKTVNGLEPVQQGEITVDGIVVNDKKTDLAKLRSRVGMVFQHFELFPHLSIIENLTLAQVKVLKRDKAPAREKALKLLERVGLSAHANKFPAQLSGGQQQRVAIARALCMAPIAMLFDEPTSALDPEMINEVLDVMVELANEGMTMMVVTHEMGFARKVANRVIFMDEGKIVEDSPKDAFFDDPKSDRAKDFLAKILH

SEQ ID NO: 16997 - protein, 240 aa, Shigella flexneri 2a str. 301
MIEFKNVSKHFGPTQVLHNIDLNIAQGEVVVIIGPSGSGKSTLLRCINKLEEITSGDLIVDGLKVNDPKVDERLIRQEAGMVFQQFYLFPHLTALGNVMFGPLRVRGANKEEAEKLARELLAKVGLAERAHHYPSELSGGQQQRVAIARALAVKPKMMLFDEPTSALDPELRHEVLKVMQDLAEEGMTMVIVTHEIGFAEKVASRLIFIDKGRIAEDGNPQVLIKNPPSQRLQEFLQHVS

SEQ ID NO: 16998 - protein, 421 aa, Shigella flexneri 2a str. 301
MSNNEFHQRRLSATPRGVGVMCNFFAQSAENATLKDVEGNEYIDFAAGIAVLNTGHRHPDLVAAVEQQLQQFTHTAYQIVPYESYVTLAEKINTLAPVSGQAKTAFFTTGAEAVENAVKIARAHTGRPSVIAFSGGFHGRTYMTMALTGKVAPYKIGFGPFPGSVYHVPYPSDLHGISTQDSLDAIERLFKSDIEAKQVAAIIFEPVQGECGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERANQLGQRLKNTLIDAKESVPAIAAVRGLGSMIAAEFNDPQTGEPSAAIAQKIQQRALAQGLLLLTCGAYGNVIRFLYPLTIPDAQFDAAMKILQDALSD

SEQ ID NO: 16999 - protein, 183 aa, Shigella flexneri 2a str. 301
MQDSILTTVVKDIDGEVTTLEKYAGNVLLIVNVASKCGLTPQYEQLENIQKAWADRGFVVLGFPCNQFLEQEPGSDEEIKTYCTTTWGVTFPMFSKIEVNGEGRHPLYQKLIAAAPTTVAPEESGFYARMVSKGRAPLYPDDILWNFEKFLVGRDGKVIQRFSPDMTPEDPIVMESIKLALAK

SEQ ID NO: 17000 - protein, 308 aa, Shigella flexneri 2a str. 301
MAVAMDNAILENILRQVRPLIGQGKVADYIPALATVDGSRLGIAICTVDGQLFQAGDAQERFSIQSISKVLSLVVAMRHYSEEEIWQRVGKDPSGSPFNSLVQLEMEQGIPRNPFINTGALVVCDMLQGRLSAPRQRMLEVVRGLSGVSDISYDTVVARSEFEHSARNAAIAWLMKSFGNFHHDVTTVLQNYFHYCALKMSCVELARTFVFLANQGKAIHIDEPVVTPMQARQINALMATSGMYQNAGEFAWRVGLPAKSGVGGGIVAIVPHEMAIAVWSPELDDAGNSLAGIAVLEQLTKQLGRSVY

SEQ ID NO: 17001 - protein, 277 aa, Shigella flexneri 2a str. 301
MRGRSIRRRINHPDRLNDPMKRVGKRGEGKFERISWDEALDTIASSLKKTVEQYGNEAVYIQYSSGIVGGNMTRSSPSASAVKRLMNCYGGSLNQYGSYSTAQISCAMPYTYGSNDGNSTTDIENSKLVVMFGNNPAETRMSGGGITYLLEKAREKSNAKMIVIDPRYTDTAAGREEEWLPIRPGTDAALVAGIAWVLINENLVDQPFLDKYCVGYDEKTLPADAPKNGHYKAYILGEGDDKTAKTPQWASQITGIPVDRIIKLAREIGTTKPAYIC

SEQ ID NO: 17002 - protein, 365 aa, Shigella flexneri 2a str. 301
MSSEKLYSPLKVGAITAANRIFMAPLTRLRSIEPGDIPTPLMAEYYRQRASAGLIISEATQISAQAKGYAGAPGIHSPEQIAAWKKITAGVHAENGHMALQLWHTGRISHASLQPGGQAPVAPSALSAGTRTSLRDENGQAIRVETSMPRALELEEIPGIVNDFRQAIANAREAAFDLVELHSAHGYLLHQFLSPSSNHRTDQYGGSVENRARLVLEVVDAGIEEWGADRIGIRVSPIGTFQNTDNGPNEEADALYLIEQLGKRGIAYLHMSEPDWAGGEPYTDAFREKVRARFHGPIIGAGAYTVEKAETLIGKGLIDAVAFGRDWIANPDLVARLQLKAELNPQRAESFYGGGAEGYTDYPTL

SEQ ID NO: 17003 - protein, 1015 aa, Shigella flexneri 2a str. 301
  misc_feature (196)..(196): Xaa can be any naturally occurring amino acid
MDVSRRQFFKICAGGMAGTTVAALGFAPKQALAQARNYKLLRAKEIRNTCTYCSVGCGLLMYSLGDGAKNAREAIYHIEGDPDHPVSRGALCPKGAGLLDYVNSENRLRYPKYRAPGSDKWQRISWEEAFSRIAKLMKADRDANFIEKNEQGVTVNRWLSTGMLCASGASNETGMLTQKFARSLGMLAVDNQARVXHGPTVASLAPTFGRGAMTNHWVDIKNANVVMVMGGNAAEAHPVGFRWAMEAKNNNDATLIVVDPRFTRTASVADIYAPIRSGTDITFLSGILRYLIENNKINAEYVKHYTNASLLVRDDFAFEDGLFSGYDAEKRQYDKSSWNYQFDENGYAKRDETLTHPRCVWNLLKAHVSRYTPDVVENICGTPKADFLKVCEVLASTSAPDRTTTFLYALGWTQHTVGAQNIRTMAMIQLLLGNMGMAGGGVNALRGHSNIQGLTDLGLLSTSLPGYLTLPSEKQVDLQSYLEANTPKATLADQVNYWSNYPKFFVSLMKSFYGDAAQKENNWGYDWLPKWDQTYDVIKYFNMMDEGKVTGYFCQGFNPVASFPDKNKVVSCLSKLKYMVVIDPLVTETSTFWQNHGESNDVDPASIQTEVFRLPSTCFAEEDGSIANSGRWLQWHWKGQDAPGEARNDGEILAGIYHHLRELYQAEGGKGVEPLMKMSWNYKQPHEPQSDEVAKENNGYALEDLYDANGVLIAKKGQLLSSFAHLRDDGTTASSCWIYTGSWTEQGNQMANRDNSDPSGLGNTLGWAWAWPLNRRVLYNRASADINGKPWDPKRMLIQWNGSKWTGNDIPDFGNAAPGTPTGPFIMQPEGMGRLFAINKMAEGPFPEHYEPIETPLGTNPLHPNVVSNPVVRLYEQDALRMGKKEQFPYVGTTYRLTEHFHTWTKHALLNAIAQPEQFVEISETQAAAKGINNGDRVTVSSKRGFIRAVAVVTRRLKPLNVNGQQVETVGIPIHWGFEGVARKGYIANTLTPNVGDANSQTPEYKAFLVNIEKA

SEQ ID NO: 17004 - protein, 474 aa, Shigella flexneri 2a str. 301
MQHKLLINGERVSGEGEKQPVYNPATGDVLLEIAEVSAEQVDAAVRAADAAFAEWGQTTPKARAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVSKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 17005 - protein, 479 aa, Shigella flexneri 2a str. 301
MSVPVQHPMYIDGQFVTWRGDAWIDVVNPATEAVISRIPDGQAEDARKAIDAAERAQPEWEALPAIERASWLCKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNLLGEALQAVQFGNPAERNDIAMGPLINAAALERVEQKVARAVEEGARVALGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 17006 - protein, 250 aa, Shigella flexneri 2a str. 301
MSAIEVKNLVKKFHGQTVLHGIDLEVKPGEVVAIIGPSGSGKTTLLRSINLLEQPEAGTITVGDITIDTARSLSQQKSLIRQLRQHVGFVFQNFNLFPHRTVLENIIEGPVIVKGEPKEEATARARELLAKVGLAGKETSYPRRLSGGQQQRVAIARALAMRPEVILFDEPTSALDPELVGEVLNTIRQLAQEKRTMVIVTHEMSFARDVADRAIFMDQGRIVEQGAAKALFADPQQPRTRQFLEKLLLQ

SEQ ID NO: 17007 - protein, 360 aa, Shigella flexneri 2a str. 301
MTKKGAFTSAFFIYAFSACIIRKSQQHTSEAVMPLHNLTRFPRLEFIGAPTPLEYLPRFSDYLGREIFIKRDEVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 17008 - protein, 478 aa, Shigella flexneri 2a str. 301
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRAAVRNAMPYAEAGKLVTFGIVPDLPETGYGYIRRGEVSVGEQDTVAFEVAQFVEKPNLETAQAYVASGEYYWNSGMFLFRAGRYLEELKKYRPDILDACEKAMSAVDPDLDFIRVDEEAFLACPEESVDYAVMEPTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 17009 - protein, 412 aa, Shigella flexneri 2a str. 301
MPQQNYLDELTPAFTPLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIYEKEAHPGGWLRNGIPQFRLPQSVLDAEIARIEKMGVTIKCNNEIGKTLTLEQLKAENRAVLVTVGLSSGSGLPLFEHSDVEIAVDFLQRVRQAQGDISIPQSALIIGGGDVAMDVASTLKVLGCQAVTCVAREELDEFPASEKEFASARELGVSIIDGFTPVAVEGNKVTFKHVRLSGELTMAADKIILAVGQHARLDAFAELEQQRNTIKTQNYQTRDPQVFAAGDIVEGDKTVVYAVKTGKEAAEAIHHYLEGACSC

SEQ ID NO: 17010 - protein, 489 aa, Shigella flexneri 2a str. 301
MGSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 17011 - protein, 452 aa, Shigella flexneri 2a str. 301
MLSIFKPAPHKARLPAAEIDPTYRRLRWQIFLGIFFGYAAYYLVRKNFALAMPYLVEQGFSRGDLRFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFFYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHEQLLQKRNGG

SEQ ID NO: 17012 - protein, 257 aa, Shigella flexneri 2a str. 301
MSENKLNVIDLHKRYGEHEVLKGVSLQANAGDVISIIGSSGSGKSTFLRCINFLEKPSEGSIVVNGQTINLVRDKDGQLKVADKNQLRLLRTRLTMVFQHFNLWSHMTVLENVMEAPIQVLGLSKQEARERAVKYLAKVGIDERAQGKYPVHLSGGQQQRVSIARALAMEPEVLLFDEPTSALDPELVGEVLRIMQQLAEEGKTMVVVTHEMGFARHVSTHVIFLHQGKIEEEGAPEQLFGNPQSPRLQQFLKGSLK

SEQ ID NO: 17013 - protein, 323 aa, Shigella flexneri 2a str. 301
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQVLAGEEIKPGPHKIQGIGAGFIPANLDLKLVDKVIGITNEEAISTARRLMEEEGILAGISSGAAVAAALKLQEDESFTNKNIVVILPSSGERYLSTALFADLFTEKELQQ

SEQ ID NO: 17014 - protein, 171 aa, Shigella flexneri 2a str. 301
MDYFTLFGLPARYQLDTQALSLRFQDLQRQYHPDKFASGSLAEQLAAVQQSATINQAWQTLRHPLMRAEYLLSLHGFDLASEQHTVRDTAFLMEQLELREELDEIEQAKDEARLESFIKRVKKMFDTRHQLMVEQLDNEAWDAAADTVRKLRFLDKLRSSAEQLEEKLLDF

SEQ ID NO: 17015 - protein, 386 aa, Shigella flexneri 2a str. 301
MTSENPLLALREKISALDEKLLALLAERRELAVEVGKAKLLSHRPVRDIDRERDLLERLITLGKAHHLDAHYITRLFQLIIEDSVLTQQALLQQHLNKINPHSARIAFLGPKGSYSHLAARQYAARHFEQFIESGCAKFADIFNQVETGQADYAVVPIENTSSGAINDVYDLLQHTSLSIVGEMTLTIDHCLLVSGTTDLSTINTVYSHPQPFQQCSKFLNRYPHWKIEYTESTSAAMEKVAQAKSPHVAALGSEAGGTLYGLQVLERIEANQRQNFTRFVVLARKAINVSDQVPAKTTLLMATGQQAGALVEALLVLRNHNLIMTRLESRPIHGNPWEEMFYLDIQANLESAEMQKALKELGEITRSMKVLGCYPSENVVPVDPT

SEQ ID NO: 17016 - protein, 375 aa, Shigella flexneri 2a str. 301
MLNTGHLHPKVVAAVEAQLKKLSHTCFQVLAYEPYLELCEIMNQKVPGDFAKKTLLVTTGSEAVENAVKIARAATKRSGTIAFSGEYHGRTHYTLALTGKVNPYSAGMGLMPGHVYRALYPCPLHGISEDDAIASIHRIFKNDAAPEDIAAIMIEPVQGEGGFYAASPAFMQRLRALCDEHGIMLIADEVQSGAGRTGTLFAMEQMGVAPDLTTFAKSIAGGFPLAGVTGRAEVMDAVAPGGLGGTYAGNPIACVAALEVLKVFEQENLLQKANDLGQKLKDGLLAIAEKHPEIGDVRGLGSMIAIELFEDGDHSKPDAKLTAEIVARARDKGLILLSCGPYYNVLRILVPLTIEDAQIRQGLEIIGQCFDEAKQ

SEQ ID NO: 17017 - protein, 425 aa, Shigella flexneri 2a str. 301
MTRRGKCRGALPSDTLSRGFRMGQSSQPHELGGGLKSRHVTMLSIAGVIGASLFVGSSVAIAEADPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDMPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLDP

SEQ ID NO: 17018 - protein, 469 aa, Shigella flexneri 2a str. 301
MTGRCLFGFSGEKPFLLPDNEGVKMNTSPVRMDDLPLNRFHCRIATLTFGAHLTDGYVLGVIGYAIIQLTPAMQLTPFMAGMIGGSALLGLFLGSLVLGWISDHIGRQKIFTFSFLLITLASFLQFFATTPEHLIGLRILIGIGLGGDYSVGHTLLAEFSPRRHRGILLGAFSVVWTVGYVLASIAGHHFISENPEAWRWLLASAALPALLITLLRWGTPESPRWLLCQGRFAEAHAIVHRYFGPHVLLGDEVVTATHKHIKTLFSSRYWRRTAFNSVFFVCLVIPWFVIYTWLPTIAQTIGLEDALTASLMLNALLIVGALLGLVLTHLLAHRKFLLGSFLLLAATLVVMACLPSGSSLTLLLFVLFSTTISAVSNLVGILPAESFPTDIRSLGVGFATAMSRLGAAVSTGLLPWVLAQWGMQVTLLLLATVLLVGFVVTWLWAPETKALPLVAAGNVGGANEHSVSV

SEQ ID NO: 17019 - protein, 432 aa, Shigella flexneri 2a str. 301
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 17020 - protein, 176 aa, Shigella flexneri 2a str. 301
MIDDDGYRPNVGIVICNRQGQVMWARRFGQHSWQFPQGGINPGESAEQAMYRELFEEVGLSRKDVRILASTRNWLRYKLPKRLVRWDTKPVCIGQKQKWFLLQLVSGDAEINMQTSSTPEFDGWRWVSYWYPVRQVVSFKRDVYRRVMKEFASVVMSLQENTPKPQNASAYRRKRG

SEQ ID NO: 17021 - protein, 395 aa, Shigella flexneri 2a str. 301
MADKKLDTQLVNAGRSKKYTLGAVNSVIQRASSLVFESMEAKKHATRNRANGELFYGRRGTLTHFSLQQAMCELEGGAGCALFPCGAAAVANSILAFVEQGDHVLMTNTAYEPSQDFCSKILSKLGVTTSWFDPLIGADIVKHLQPNTKIVFLESPGSITMEVHDVPAIVAAVRSVVPDAIIMIDNTWAAGVLFKALDFGIDVSIQAATKYLVGHSDAMIGTAVCNARCWEQLRENAYLMGQMVDADTAYITSRGLRTLGVRLRQHHESSLKVAEWLAEHPQVARVNHPALPGSKGHEFWKRDFTGSSGLFSFVLKKKLNDEELANYLDNFSLFSMAYSWGGYESLILANQPEHIAAIRPQGEIDFSGTLIRLHIGLEDVDDLIADLDAGFARIV

SEQ ID NO: 17022 - protein, 299 aa, Shigella flexneri 2a str. 301
MIDMTMKVGFIGLGIMGKPMSKNLLKAGYSLVVADRNPEAIADVIAAGAETASTAKAIAEQCDVIITMLPNSPHVKEVALGENGIIEGAKPGTVLIDMSSIAPLASREISEALKAKGIDMLDAPVSGGEPKAIDGTLSVMVGGDKAIFDKYYDLMKAMAGSVVHTGAIGAGNVTKLANQVIVALNIAAMSEALTLATKAGVNPDLVYQAIRGGLAGSTVLDAKAPMVMDRNFKPGFRIDLHIKDLANALDTSHGVGAQLPLTAAVMEMMQALRADGLGTADHSALVCYYEKLAKVEVTR

SEQ ID NO: 17023 - protein, 445 aa, Shigella flexneri 2a str. 301
MSNRKYFGTDGIRGRVGDAPITPDFVLKLGWAAGKVLARHGSRKIIIGKDTRISGYMLESALEAGLAAAGLSALFTGPMPTPAVAYLTRTFRAEAGIVISASHNPFYDNGIKFFSIDGTKLPDAVEEAIEAEMEKEISCVDSAELGKASRIVDAAGRYIEFCKATFPNELSLSELKIVVDCANGATYHIAPNVLRELGANVIAIGCEPNGVNINAEVGATDVRALQARVLAEKADLGIAFDGDGDRVIMVDHEGNKVYGDQIMYIIAREGLRQGHLRGGAVGTLMSNMGLELALKQLGIPFARAKVGDRYVLEKMQEKGWRIGAENSGHVILLDKTTTGAGIVAGLQVLTAMARNHMSLHDLCSGMKMFPQILVNVRYTAGSGDPLEHESVKAVTAEVEAALGNRGRVLLRKSGTEPLIRVMVEGEDAAQVTEFAHRITDAVKAV

SEQ ID NO: 17024 - protein, 269 aa, Shigella flexneri 2a str. 301
MEQSVANLVDMRDVSFTRGNRCIFDNISLTVPRGKITAIMGPSGIGKTTLLRLIGGQIAPDHGEILFDGENIPAMSRSRLYTVRKRMSMLFQSGALFTDMNVFDNVAYPLREHTQLPAPLLHSTVMMKLEAVGLRGAAKLMPSELSGGMARRAALARAIALEPDLIMFDEPFVGQDPITMGVLVKLISELNSALGVTCVVVSHDVPEVLSIADHAWILADKKIVAHGSAQALQTNPDPRVRQFLDGIADGPVPFRYPAGDYHADLLPGS

SEQ ID NO: 17025 - protein, 472 aa, Shigella flexneri 2a str. 301
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDMSGVKQTGKKVAIIGAGPAGLACADVLTRNGVKAVVFDRHPEIGGLLTFGIPAFKLEKEVMTRRREIFTGMGIEFKLNTEVGRDVQLDDLLSDYDAVFLGVGTYQSMRGGLENEDADGVYAALPFLIANTKQLMGFGETRDEPFVSMEGKRVVVLGGGDTAMDCVRTSVRQGAKHVTCAYRRDEENMPGSRREVKNAREEGVEFKFNVQPLGIEVNGNGKVSGVKMVRTEMGEPDAKGRRRAEIVAGSEHIVPADAVIMAFGFRPHNMEWLAKHSVELDSQGRIIAPEGNDNAFQTSNPKIFAGGDIVRGSDLVVTAIAEGRKAADGIMNWLEV

SEQ ID NO: 17026 - protein, 252 aa, Shigella flexneri 2a str. 301
MSQILLQPANAMITLENVHKWYGQFHVLKNINLTVQPGERIVLCGPSGSGKSTTIRCINHLEEHQQGRIVVDGIELNEDIRNIERVRQEVGMVFQHFNLFPHLTVLQNCTLAPIWVRKMPKKEAEALAMHYLERVRIAEHAHKFPGQISGGQQQRVAIARSLCMKPKIMLFDEPTSALDPEMVKEVLDTMIGLAQSGMTMLCVTHEMGFARTVADRVIFMDRGEIVEQATPDEFFAHPKSERTRAFLSQVIH

SEQ ID NO: 17027 - protein, 270 aa, Shigella flexneri 2a str. 301
MKSLFKVTLLATTMAVALHAPITFAAEAAKPATTADSKASFKNDDQKSAYALGASLGRYMENSLKEQEKLGIKLDKDQLIAGVQDAFADKSKLSDQEIEQTLQAFEARVKSSAQAKMEKDAADNEAKGKEYREKFAKEKGVKTSSTGLVYQVVEAGKGEAPKDSDTVVVNYKGTLIDGKEFDNSYTRGEPLSFRLDGVIPGWTEGLKNIKKGGKIKLVIPPELAYGKAGVPGIPPNSTLVFDVELLDVKPAPKADAKPEADAKAADSAKK

SEQ ID NO: 17028 - protein, 406 aa, Shigella flexneri 2a str. 301
MAIEQTAITRATFDEVILPIYAPAEFIPVKGQGSRIWDQQGKEYVDFAGGIAVTALGHCHPALVNALKTQGETLWHISNVFTNEPALRLGRKLIEATFAERVVFMNSGTEANETAFKLARHYACVRHSPFKTKIIAFHNAFHGRSLFTVSVGGQPKYSDGFGPKPADIIHVPFNDLHAVKAVMDDHTCAVVVEPIQGEGGVTAATPEFLQGLRELCDQHQALLVFDEVQCGMGRTGDLFAYRYYGVTPDILTSAKALGGGFPISAMLTTAEIASAFHPGSHGSTYGGNPLACAVAGAAFDIINTPEVLEGIQAKRQRFVDHLQKIDQQYDVFSDIRGMGLLIGAELKPHYKGRARDFLYAGAEVGVMVLNAGPDVMRLAPSLVVEDADIDEGMQRFAHAVAKVVGA

SEQ ID NO: 17029 - protein, 193 aa, Shigella flexneri 2a str. 301
MFKSTLAAMAAVFALSALSALSPAAMAAKGDPHVLLTTSAGNIELELDKQKAPVSVQNFVDYVNSGFYNNTTFHRVIPGFMIQGGGFTEQMQQKKPNPPIKNEADNGLRNTRGTIAMARTADKDSATSQFFINVADNAFLDHGQRDFGYAVFGKVVKGMDVADKISQVPTHDVGPYQNVPSKPVVILSAKVLP

SEQ ID NO: 17030 - protein, 225 aa, Shigella flexneri 2a str. 301
MKQYLIAPSILSADFARLGEDTAKALAAGADVVHFDVMDNHYVPNLTIGPMVLKSLRNYGITAPIDVHLMVKPVDRIVPDFAAAGASIITFHPEASEHVDRTLQLIKENGCKAGLVFNPATPLSYLDYVMDKLDVILLMSVNPGFGGQSFIPQTLDKLREVRRRIDESGFDIRLEVDGGVKVNNIGEIAAAGADMFVAGSAIFDQPDYKKVIDEMRSELAKVSHE

SEQ ID NO: 17031 - protein, 450 aa, Shigella flexneri 2a str. 301
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTLEVNGETITADHILIATGGRPSHPDIPGVEYGIDSDGFFALPALPERVAVVGAGYIAVELAGVINGLGAKTHLFVRKHAPLRSFDPMISETLVEVMNAEGPQLHTNAIPKAVVKNADGSLTLELEDGRSETVDCLIWAIGREPANDNINLEAAGVKTNEKGYIVVDKYQNTNIEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGPEEKIVGIHGIGFGMDEMLQGFAVALKMGATKKDFDNTVAIHPTAAEEFVTMR

SEQ ID NO: 17032 - protein, 470 aa, Shigella flexneri 2a str. 301
MIIITEPLLSFVLQKQGIKSPPMDKKMNNDNTDYVSNESGTLSRLFKLPQHGTTVRTELIAGMTTFLTMVYIVFVNPQILGAAQMDPKVVFVTTCLIAGIGSIAMGIFANLPVALAPAMGLNAFFAFVVVGAMGISWQTGMGAIFWGAIGLFLLTLFRIRYWMISNIPLSLRIGITSGIGLFIALMGLKNTGVIVANKDTLVMIGDLSSHGVLLGILGFFIITVLSSRHFHAAVLVSIVVTSCCGLFFGDVHFSGVYSIPPDISGVIGEVDLSGALTLELAGIIFSFMLINLFDSSGTLIGVTDKAGLIDSNGKFPNMNKALYVDSVSSVAGAFIGTSSVTAYIESTSGVAVGGRTGLTAVVVGVMFLLVMFFSPLVAMVPPYATAGALIFVGVLMTSSLARVNWDDFTESVPAFITTVMMPFTFSITEGIALGFMSYCIMKVCTGRWRDLNLCVVVVAALFALKIILVD

SEQ ID NO: 17033 - protein, 417 aa, Shigella flexneri 2a str. 301
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMTVGISEITAIGVYVQFWSPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLIAF

SEQ ID NO: 17034 - protein, 1016 aa, Shigella flexneri 2a str. 301
  misc_feature (196)..(196): Xaa can be any naturally occurring amino acid
MQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNHEYTEAYTNASLIVREDYGFEDGLFTGYDAEKRKYDKSSWTYELDENGFAKRDTTLQHPRCVWNLLKQHVSRYTPDVVENICGTPKDAFLKVCEYIAETSAHDKTASFLYALGWTQHSVGAQNIRTMAMIQLLLGNMGMAGGGVNALRGHSNIQGLTDLGLLSQSLPGYMTLPSEKQTDLQTYLTANTPKPLLEGQVNYWGNYPKFFVSMMKAFFGDKATAENSWGFDWLPKWDKGYDVLQYFEMMKEGKVNGYICQGFNPVASFPNKNKVIGCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPKSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 17035 - protein, 214 aa, Shigella flexneri 2a str. 301
MSQTSTLKGQCIAEFLGTGLLIFFGVGCVAALKVAGASFGQWEISVIWGLGVAMAIYLTAGVSGAHLNPAVTIALWLFACFDKRKVIPFIVSQVAGAFCAAALVYGLYYNLFFDFEQTHHIVRGSVESVDLAGTFSTYPNPHINFVQAFAVEMVITAILMGLILALTDDGNGVPRGPLAPLLIGLLIAVIGASMGPLTGFAMNPARDFGPKVFA

SEQ ID NO: 17036 - protein, 445 aa, Shigella flexneri 2a str. 301 [sequence omitted]

SEQ ID NO: 17037 - protein, 449 aa, Shigella flexneri 2a str. 301
MSTPSARTGGSLDAWFKISQRGSTVRQEVVAGLTTFLAMVYSVIVVPGMLGKAGFPPAAVFVATCLVAGLGSIVMGLWANLPLAIGCAISLTAFTAFSLVLGQHISVPVALGAVFLMGVLFTVISATGIRSWILRNLPHGVAHGTGIGIGLFLLLIAANGVGLVIKNPLDGLPVALGDFATFPVIMSLAGLAVIIGLEKLKVPGGILLTIIGISIVGLIFDPNVHFSGVFAMPSLSDENGNSLIGSLDIMGALNPVVLPSVLALVMTAVFDATGTIRAVAGQANLLDKDGQIIDGGKALTTDSMSSVFSGLVGAAPAAVYIESAAGTAAGGKTGLTAITVGVLFLLILFLSPLSYLVPGYATAPALMYVGLLMLSNVAKIDFADFVDAMAGLVTAVFIVLTCNIVTGIMIGFATLVIGRLVSGEWRKLNIGTVVIAVALVTFYAGGWAI

SEQ ID NO: 17038 - protein, 491 aa, Shigella flexneri 2a str. 301
MNTQYNSSYIFSITLVATLGGLLFGYDTAVISGTVESLNTVFVAPQNLSESAANSLLGFCVASALIGCIIGGALGGYCSNRFGRRDSLKISAVLFFISGVGSAWPELGFTSINPDNTVPIYLAGYVPEFVIYRIIGGIGVGLASMLSPMYIAELAPAHIRGKLVSFNQFAIIFGQLLVYCVNYFIARSGDASWLNTDGRRYMFASECIPALLFLMLLYTVPESPRWLMSRGKQEQTESILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQASGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 17039 - protein, 470 aa, Shigella flexneri 2a str. 301
MVDQVKVVADDQAPAEQSLRRNLTNRHVQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPDLSDWVASLAVIVLLLTLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFALIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVVVLLTLEDDTRQALLVTPLWFIALGLGWLFIGKKRAAELRK

SEQ ID NO: 17040 - protein, 223 aa, Shigella flexneri 2a str. 301
MWLICCPLLLYPKKGNTMTTPTFDTIEAQASYGIGLQVGQQLSESGLEGLLPEALVAGIADALEGKHPAVPVDVVHRALREIHERADAVRRQRFQAMAAEGVKYLEENAKKEGVNSTESGLQFRVINQGEGAIPARTDRVRVHYTGKLIDGTVFDSSVARGEPAEFPVNGVIPGWIEALTLMPVGSKWELTIPQELAYGERGAGASIPPFSTLVFEVELLEIL

SEQ ID NO: 17041 - protein, 488 aa, Shigella flexneri 2a str. 301
MKKVNHWINGKNVAGNDYFQTTNPATGEVLADVASGGEAEINQAVAAAKEAFPKWADLPMKERARLMRRLGDLIDQNVPEIAAMETADTGLPIHQTKNVLIPRASHNFEFFAEVCQQMNGKTYPVDDKMLNYTLVQPVGVCALASPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPNDPNTQVRALISQQHWEKVSGYIRLGIEEGATLLAGGPDKPSDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 17042 - protein, 492 aa, Schizosaccharomyces pombe
MSAKSIREYDGKAVLAYWLNRSPSISKEEYKTVSATPAVQLAQIQFPLPTLVIPAESTTYREVVEDVFAKVEQEHPWVKETKLVAKPDQLIKRRGKSGLLKLNATWDEAKEWIRERAGKNQKVQHAVGYLTTFLVEPFVPHPPNTEYYININSVREGDWILFCNEGGVDVGDVDAKARKLLVPVRLSEFPSRATIASTLLSDIPVEQHESLVDFIIRLYSVYVDCQFTYLEINPLVVIPTAKGADVFYLDLAAKLDQTAEFECGAKWAVARAPESLGIKTSGEESGAINADHGPPMVFPAPFGRELSKEEAYVQGLDAKTGASLKLTILNAEGRVWNLVAGGGASVVYADAVAVNGAADELANYGEYSGAPTDGQTYEYAKTVLDLMTRGEPRADGKVLFIGGGIANFTSPAVTFRAIARALGDYKDKLHAHKVSIWVRRAGPNYQEGLRVIREAGKKFDLPLKVYGPECHISGIVPMGLGKAPVEAEWQMA

SEQ ID NO: 17043 - protein, 503 aa, Schizosaccharomyces pombe
MSTKLVDHVEITVPTGKTYIQPVGLFINNQHVDSVHGGRVKVYSPSTEKLICEVADADEEDVDIAVKVARAAFQTDAPWRKFSSAQRGRCLSRLADCIEQNLEYLASIETLDNGKSITLARGDVQAAADCFRYYGGWADKDYGQTIETDIKRFAYTRHEPIGVCGQIIPWNFPFLMCAWKIAPAVACGNTIILKTAELTPLSALCLTKFVPECGFPPGVINVLSGDGRRCGNAISSHMDIDKVAFTGSTGVGRMVMRAAASSNLKKVTLELGGKSPNIVFNDADLDSAAVWTNYGIFYNSGQVCCAGSRVYVQEDVYDEFIKRMVAKAKTLKVGDPFAEDTFQGAQVSKQQYERIVSYIESGIAHGAKLEIGGKRHGNLGYFVEPTILSNVTEDMAVGKEEIFGPVLAVIKFKTIEEAIRRGNNSTYGLAAGVHTNNITNAIKVSNALEAGTVWVNCYNLLHHQIPFGGYKESGIGRELGSYGLTNYTQTKAVHINLGMDSPI

SEQ ID NO: 17044 - protein, 333 aa, Schizosaccharomyces pombe
MPIVSGFKVGPIGFGLMGLTWKPKQTPDEEAFEVMNYALSQGSNYWDAGEFYGVDPPTSNLDLLARYFEKYPENANKVFLSVKGGLDFKTLVPDGNPDFVSKSVENVIAHLRGTKKLDLFQCARVDPNVPIETTMKTLKGFVDSGKISCVGLSEVSAETIKRAHAVVPIAAVEVEYSLFSRDIETNGIMDICRKLSIPIIAYSPFCRGLLTGRIKTVEDLKEFAKSFPFLEYLDRFSPDVFAKNLPFLQAVEQLAKKFGMTMPEFSLLFIMASGNGLVIPIPGSTSVSRTKSNLNALNKSLSPEQFKEAKEVLSKYPIYGLRYNEQLAGTLSV

SEQ ID NO: 17045 - protein, 180 aa, Salmonella typhimurium
GSMQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALE

SEQ ID NO: 17046 - protein, 394 aa, Leptospira interrogans serovar Lai str. 56601
MRALLEKSNDLFNPTENHLALRENVAKFAKENMDTQAKEHDDYETFNLSLFRRIGSELGLFGVTVPEEDGGMGMDAVAAVIIHEELSAYDPGFTLSYLAHEVLFVNNFYHSSNAAQRAKYLLKVISGEWIGGMGMTEPGAGTDVLGMRTIAVKKGDKYVLNGSKQYITNGNVGSVFLVYAKMNKDSKRTTSFIVESSFPGFSVGKKEEKMGMRSSPTTQLIFEDCEVPAENLVGQEDGALVHMMRNLEIERITLAAQSLGIAKRCVDVMADYTIRHREAFGKKLSEFGQIQRLLAESYADYQAARALVYQVASGIHPESRNSLGAASAKLVATQMAERVSRNAIQALGGYGYCREYPVERLHRDSILLSIGGGTNEAMQKNIVADLKKIYEGTP

SEQ ID NO: 17047 - protein, 187 aa, Leptospira interrogans serovar Lai str. 56601
MSSREITILKIQEPTRSIASLTRIMEEELSQYRKTLPKGFREEVDCDEDTVLFLHVDFLPLDFQKTTELLLTGKKNLVPVVAIDLQGQILMQAFGNEESQTLSLKTGYAHYFSRSRNQLWKKGDTSGHTQKILQILSPTDRSFLVYQVEQEVAACHEGYYSCFFRERMEGVTWKLLPVPRNFLPEKS

SEQ ID NO: 17048 - protein, 496 aa, Leptospira interrogans serovar Lai str. 56601
MNYTRGALSMPTLQESPVKLPNSNQPPSVNKAEIERVFNLQKKHFHKVMKLTTAGQRIQRLKKLKEAIFKYSPEIEKAVHSDFRKSEREVDITEIMPSISEINDAIKHVRRWMKPVDVKTPMTLFGSKSQIIYEPRGVVLIIGPWNYPFYLTFAPLAAAIAAGNTVLIKPSEFTPVTSNLIQKIISEVFPKEEVAVFEGDYQVSGALMELPLDHIFFTGSTHVGKIVMTAAAKHLTTVTLELGGKSPAIIDKSADIKKAAKKLIWGKVLNAGQTCVAPDYLLIPNELIKPFVEEAKTVIKEFYGNSLKENSDFCRIVNDRNFNRVSGYIHEAVEKGAKIEMGGDTDASQNYIEPTLLSNVPENSNIMEDEIFGPVLPMIPYTNLDEAIEKINSKPKPLALYIFGKKDRSIKKILKETSSGGVAVNDVILHLANPNLPFGGINHSGHGSYHGYFGFKAFSHERSVLRQAALSSIDLMYPPYTNFVKRLVSFTKKFLV

SEQ ID NO: 17049 - protein, 465 aa, Leptospira interrogans serovar Lai str. 56601
MNGVNMEKSPSDKSLLRFFGLGELVNHGWNAILAFWMIMGMAFFLFADQNLIAPNLKNIGASFGLNNQEDVDWYIGGVIPILFFILGGAVSVSMGYLSQKYSRKTLIIFSVFLGEVPCFLSGFATSYPEFVFYRTLTGFGLGGIFPLLFTVLGDYFSDKSRSTAAAYVSLSMGIGLGVGQLLGGILGSADPANGWRTSFIYLSIPSFFFAIIYWIFCKEPIRGGGESEWSGIAEKFSEESFHLRWNDVRLLFKNKTNIGIFLQGIPGCVPWGVFFVFLVDYYETSYHLDKATATMLLTYAAIGVFAGTFFGGIIGQKIYNYKKRLLPIFCMSSILIGILPCIYLLKAENIADSGLFILINVVAGFIISVTGPNVRATLINVNIPKNRSSMFALYNLTDDLGKGLGPAMSALILGLTPGDRSLGLSISVLFWIPCALSWLIVLKNFEKDEKDVHEYLVLEAEKIKG

SEQ ID NO: 17050 - protein, 189 aa, Leptospira interrogans serovar Lai str. 56601
MKEGASFMYSKYFIWFMTLGIFLPLAGIFAKGSFYDFKVKDIKGNEVSLSKYKGKVVMVVNVASKCGYTYQYEHLEKVYKKYKDQGFAVVGFPANNFGGQEPGTDQEIETFCRIQKGASFDMMSKISVKGKDIHPLYSYLIQNSPNPGEVEWNFEKILISKNGTIEARYRSSVEPDSSAVTQKIETLLK

SEQ ID NO: 17051 - protein, 467 aa, Leptospira interrogans serovar Lai str. 56601
MSAEFDVVVIGAGPGGYVCAIRCAQLGFKTAIIEKRKTLGGTCLNVGCIPSKALLDSSEEYHKTLHKLEVHGISVGKVDLDLNKLMNRKDQIVKEVTDGVDFLMNKNKIKRYEGFGKVLSAGKVEVAFNDGKKETLSAKHIVVATGSVPIDIPGLTVDGKNIITSDHAIDVRKLPKKMIIIGAGVIGLELGSVWGRLGTSVTVVEFLPGLISNVDRQMGSLLERSLTSQGMEFLFEHKVKGAATTKNGVKVQIEDSKGESKDLEADVVLVAVGRRPFLEGVGLEEAGVAFTQRKRIQVDAHFKTSVPGIYAIGDAIDGPMLAHKAEEEGVALAELLAGQSGHVNYNAVPYVIYTWPEMAWVGKGEEELKAAGIEYKVGKSLFRPNARSKAMNEAEGQVKILADKKTDKLLGAFVFGPRASDMVAELAVAMEFGASAEDIARSFHAHPTLSEVIKEAAMAVDKWAIHA

SEQ ID NO: 17052 - protein, 353 aa, Leptospira interrogans serovar Lai str. 56601
MNQDKPVVLIMAGGKGERFWPRSRISTPKQLQKVYSNKTLLRETLERALTITTIDRIYIGTNASLKKSILIQEKNFPEKNFIIEPEGKNTAPIIALASLYFQERYGDPLQVVLSADAWIHPVKEFTKTISKALEYTKEHLVLLGIKPNRPEIGYGYIEAGKSTDACFAVKSFYEKPDVKTALKYIKKKNFYWNPGIFLWRTSIILEEFKTYSPKILDPLKERFPFKKAGELAAAFKIIPSEPVDIAIMEKSSRIKMVEASFGWDDVGSWTSLERVMPGDELGNRHMGKTILFHKSSGNITQTRKEFTAVLGVNDLIVVEEEDVLFISTKSGIGDIKNLVSELRKNKTLQKYTE

SEQ ID NO: 17053 - protein, 250 aa, Leptospira interrogans serovar Lai str. 56601
MRKTIIAGNWKMNLSLKEAVFLAHSIREKIPSISKDKVSMVFPSTLHLENVSKILEGSSVIVGAQNCYHSGLAAFTGETSPDQLKEIGVKVVMVGHSERRQFLGESNFFCNDKIRFLLKNEFTVLYCVGETLSERESGKTLEVLSSQIREGLKGIDSVFFSNLILAYEPVWAIGTGKVATPSQAQEVHSFIRKEISGLFVGASSISESISILYGGSVKPDNIQDLLKEKDIDGGLVGGASQKISSFAELF

SEQ ID NO: 17054 - protein, 396 aa, Leptospira interrogans serovar Lai str. 56601
MELPRLENVDLSGKRVFLRVDFNVPVENGKVTDKTRIEKTLPTIELLIKKGARIIIASHLGRPKGQVNPEFSLAPVVETFQSLVKSKVYFSKTVIGEDAIKLSKELKNGEILVIENVRFHKEEEENDPGFSKKLSALADIYVNDAFGAAHRAHSSTEGIARLLPAYAGLLMHKEILELSALLHKPARPFVAIIGGSKVSTKIKVLTNLFDKVNHLLIGGGMAYTFLKSRAIPIGNSLVEKEFEVQAFQLIEKAGVAGIDLQLPVDHIIGDQFNEKAKTKSVDKMGILDGWMGMDIGSKTVSNYEKIIKNAGTIFWNGPMGVFEMDKFASGTMAIAKAVAKSKAKTVVGGGDSIAAINKAGVADKITHISTGGGASLEFMEGRKLPGVEALKKKTSE

SEQ ID NO: 17055 - protein, 309 aa, Leptospira interrogans serovar Lai str. 56601
MKAKSILETIGNTPHVKINRLFNTKSEVYAKLERSNPGGSIKDRIALSMIEDAEKTGKLTKDSIIVEPTSGNTGIGLALVAAVKGYKLLLVMPESMSIERRRIMAAYGAEFELTPREKGMPGAIEKAKQIVAENPKAWMPQQFENEANIKIHVETTAQEIAKDFPDGLDYVITGVGTGGHITGVAQVLKQKFPKLKVFAVEPEASPVISGGKPGPHPIQGIGAGFIPKNLHTNLLDGTIQISKDEAFEYAQRAAKEEGLFIGVSSGAALAAVAKKLPEIPEGSRILTFSYDTGERYLSIEGLFPVPSNA

SEQ ID NO: 17056 - protein, 411 aa, Leptospira interrogans serovar Lai str. 56601
MVGRMISFPKDKIQVLLLENVHQDAFDMFQKDGFNVRLLPAAFSEKELLDEIENIHVLGIRSKTNVTSAVLEKAKRLLTIGCFCIGTNQVDLVGAEKKGIPVFNAPYSNTRSVAELVISEIIMLARRVPDHIRNTHSGIWNKISKNCFEVRGKTIGIVGYGHIGSQVSVLAEAMGMKVIYYDIQTVLPLGNATPVSSYEELLKNSDFISFHVPETPQTMNLYGKKEIEVTKKGAYMINLSRGKVVDLEALAKAIQSGHIAGAGIDVFPEEPESNNDPFLTPMQNLPNVILTPHIGGSTEEAQRNIGSEVASKLLKFINNGSTTFSVNFPNLEITPLPAGQYRILNVHKNQPGFLKDINSMVSAIGANISSQHLGTSAEIGYLSMVIDKSVGDELKEKIEKHPFSIKTRILY

SEQ ID NO: 17057 - protein, 434 aa, Leptospira interrogans serovar Lai str. 56601
MPRNYKPETIALHGGQSPDPSTLSRAVPIYQTTSYVFKNTEHAAKLFGLQEFGNIYTRIMNPTTDVLEQRIAALEGGVAALATASGQAAETLALLNIVEAGQEIVASSSLYGGTYNLLHYTFPKLGIKVHFVDPSDPENFRKAVNDKTRAFYAETLGNPKLNTLNLEAIAKVAHDSEVPLIIDNTLPSPYLVNPIEHGADIVVHSLTKFLGGHGTSIGGIIVDSGKFNWGNGKFKNFTEPDPSYHGLKFWEVFGKFEPFGGVNIAYIIKAKVQGLRDMGASISPFNAWQILQGVETLPLRMRKHSENALAVAEYLTKHPKVSWVNYPGLKMDKNYSLAKKYHKKDLYGAILGFGIKGGAVEAKKFIDGLELFSLLANVGDAKSLVIHPASTTHQQLTPEEQLSAGVTPDFVRLSVGLENIEDILFDLEEALKKV

SEQ ID NO: 17058 - protein, 460 aa, Leptospira interrogans serovar Lai str. 56601
MKEYDIIVIGTGGGTKLVTPPSKIGYKIAVIEKENPGGTCLNRGCIPSKMLIYPAEILSLTKHSEKFQISFPKKPEVDFKTLIERISKTVDDESASILPAYDKNPNITYISGTASFISDKVITVNGEQLTAKRIFIASGARPAIPDIPGLAGTPFMTSRETLRRTDLPKSMIVIGGGFIALELGFAYSSFGSEVTFLVRNRMLKNEDKDIVDEFERIFTKEHNVLLHTNIHKIEYNKNLFYVEAISQGKTILLQSEALLVATGIRPNTDLLNLQNTNIQTDKNGYIVVNEYLETTSPGVYALGDITGKYFYRHSVNFEGEFLFRTLYQEKKRTPIEYPPVPHAVFTHPQIAKVGKTEEELIQEGIDYVAAKNSYSASATGMARLSDSGFVKILIDKKSKKVLGAHVIGDEASNLIHLFILLMTMKGTLDDLLKMIYVHPALPEIARNAARKAKELLQSKK

SEQ ID NO: 17059 - protein, 433 aa, Leptospira interrogans serovar Lai str. 56601
MIWYPFTLQFEPDSPLKIERAKGEFLYDELGNSYIDGISSWWVSIHGHNHPKIVQAVKNQLEKLDHVLLAGFTHDPAEKLAAELLKITDGLFQKVLYSDNGSTAVEIMIKLAYQYFQNIGEVDRKIFIKWNSSYHGDTIGTMSVGGNSVFNRVFQGLMFPTKEFQTPNCNFCPMGKKPESCKVECIDPIEKFFQKSPKAVAGIVIEPLILGSGGMIFYKEEVLQRLETISKKYGSLLLLDEVFTGFGRTGSVFAYQRAKIRPDFIALAKGLSAGVSAVAVTLTTDRIHSAFVTADPEKGFYHGHTMTGNPIACSAALASLKIFFEENRLEQILRLESKLNVGLKKIAKEFPKAVKNCRVLGAVGVLELEVGKASGYHYPGNKILKKKFLEKGVLLRPLGNVIYLTPPYNIENSSLEKIFSAIRETLSEISFGN

SEQ ID NO: 17060 - protein, 511 aa, Leptospira interrogans serovar Lai str. 56601
MIQIKRALISVSDKSGLVEFAKFLNQNGVEIISTGGTLKLLKDNGIAAIAIDDYTGFPEILDGRVKTLHPKVHGGLLGVISNPAHKQKMEELKIPKIDLVVVNLYPFLKTVSKPEVQLEEAIENIDIGGPSMIRSAAKNYKHTLVLTDPNDYKKIQNLISSSGISEEISASYMRKAFSHTAMYDAAISSWFYKQSGEVFPDVLNLSFIKKQKLRYGENPHQAASFYEPLFTKSDFSPLQGKELSFNNMLDFDAAFHISSLLPENTVCIIKHLNPCGIAYADNPLEAFQLARRTDPISAFGGVIGIKGQVNGELATSITENFVEGVIAQKFTQEALEVFSKKPNIRLIEIQDFKEALDELDLRPIHHGLLIQDRDYTTITEKDLKVVTKKQPSPDDIRGLMFAWSCVRFIKSNAIVYTEENATLGIGAGQMSRVDSVQLGANKALNVGLSVVGSYVASDAFFPFRDGIDALAKAGAKAIIQPGGSVRDEEVIQAADEHGLIMVFTGMRHFRH

SEQ ID NO: 17061 - protein, 215 aa, Leptospira interrogans serovar Lai str. 56601
MKISASILATKLTELVKTVPNYDPTAIDLMHMDVMDGNFVPQISFGEALTKEVKSLTSIPLDVHLMVAKPENHVFKYYEFNPYCITFHIETTDFPIRLAQEIKSHGTKVGVSLNPGTPVSSLENVLPYVDLILLMTVEPGFYGQKFIINGMDKIRKVKELIGSRPIEIEVDGGVNDTNIQELRKNGVDIVVVGAGLYKTGNPVENAKNLKYLARV

SEQ ID NO: 17062 - protein, 506 aa, Leptospira interrogans serovar Lai str. 56601
MKQKIAFILYTIWFISCSPQSRIDIAPLLLATLSQTTGSQNEISFQVLSPREGEILTVYQLETIVQANSDGEFEIFHEGNKLFSFQSTPSSPQTSPTFKPKNGHNTIQIRFKKSNGFVLSQEIHFYFGTKLSAGGAHSGFLINGELYTVGRNNFGQLGTGISTGDGINDRIVKVDPIRDIFSIHFNQNNSMAISQNGRVYTWGANSKGQLGIGNNNTDPARASDPGNRQPPTEIPGINDAVMGAYGFNHALVLKSDGTVVAFGQNNVGQLGNGENNLNRNSFSSNPVNVVQLRNVIQVIAGSEHSAALTENGEVYIWGRNQYGNLGNGIISPANTVQSVPVKVEGLSKIKQIANGRDHILALTSDGKIYSWGLNASGQLGIGGNGNPPPTPIPTQILNIQDVASIWAGGTQSFAILKNGEVKGWGANGNMASLALGESNTQKVYEPNKAVVGIDNVVHFGCGATHNFALLGNGEIYGWGWNFKGSLGRTDLQNNWGAPNPVYIKFP

SEQ ID NO: 17063 - protein, 490 aa, Leptospira interrogans serovar Lai str. 56601
MRKFDKTLFHEFRRIYKFMPESYDLTVIGAGPGGYVAAIRAAQLGMNVCIIEKDKPGGICLNWGCIPTKALLESAHLLEKLHSAKEYGINLSDPKPDFAAIIRRSRNVADGMASGVEFLLNKNKITRKKGTAVFKDPNTIWLPDSSKEEITSKYFILATGARARELPGLPFDSHTVLSSKTAMIQDKIPESLLIVGAGAIGVEFADFYSTMGTKVTLVEMMDQILPVEDKEISTFLEKSFVKRGIRVLTGVGVSDPKIVNGKVKVLLKGKNLPEAVESFEAEKILVSIGLVPNTDSMHLEEIGIFLQKGFVKTDTKYKTSVPHIYAIGDCNGPPLLAHVASMEGIKAVEAISIHAGNPHHLSYIPIDYNAIPGCTYCHPEVASIGFTEKKATDMGYTISVGKFPFVASGRAKAMGDTGGFTKVIVDKTSGEILGAHLIGPGVTELLPAVSLGITQELTAKEIASTIFAHPTLSETVMESFGAALGEAINL

SEQ ID NO: 17064 - protein, 459 aa, Leptospira interrogans serovar Lai str. 56601
MKKKLSRTFICQSCGQDYTRWAGKCESCGSWNSIVEEIGGERFSSSNGNSQKNKSYKEPIPLDRVEEESLKRMGTGLKELDLVLGGGLVPGSLTLIGGEPGVGKSTLILEVSRYLTQANKNVLYISGEESPSQIRMRAERMGLRASNLFVTSETIAENISSMIEGENPAVVFVDSIQTIAREALPNQAGTVTQLRECTQVLLETAKRSGIPILMTGHITKEGTIAGPKVLEHLVDTVLYFEGDRLNYYRLLRAVKNRFGAVGDLAIFEMFSGGLREVGDRNRVFVSAGAEERSGSVISAVLEGSRALTVEVQALVSKTGFAQARRMAEGPDTRRVILLAAVIEKYIKIKLGECDLFSNLAGGLSADEPALDLAICASIISSYLDQPLPKGTCVLGEVGLSGEVRSIGQANLRVKELAGVGMKKVILPEGNLSELDQNLDIQVKGIRSLNDLRSLFPGAS

SEQ ID NO: 17065 - protein, 478 aa, Leptospira interrogans serovar Lai str. 56601
MPCMKILNRKKTKIVCTIGPASSSEETILSILKAGMDIARMNFSHGTHDSHKRVYDTLRKCEQIFGFPLGIMADLQGPKIRTGKLKLNSILLHKNQEIEIVPDSDILGDEHKIGCTYPNLIRDIQEEDKILIDDGKLILKVISKKSNSAILKVIVGGILWSNKGINLPGTPISAPALSEKDIEDLKFALSLGVDYAALSFVRTGADLELARSYLEGTYTGLIAKIERPEAIGNIEEIIERADGIMIARGDLGVEIDTEKVPILQKELIYKLNQAGKPVITATQMLESMIENPRPTRAEASDVANAVMDGTDAVMLSAESANGHYPVESVEIMSKIIQETETIDHIYEIHWNIKKTFLESERTALGNAAREIAHGIHAKAIVNFTRSGYSALITSEMRPKVPIYSFTPFATTARKMKLYRGVVPFVMPFFTRLEDMIAYMNQKLKEDEFLFPGDKVVILSGAPGTTVRSVDFLQVYKIH

SEQ ID NO: 17066 - protein, 288 aa, Leptospira interrogans serovar Lai str. 56601
MANQLKKRPENQEGNFYVDSTCIDCETCRIVAPKTFAEKNGGSYVWKQPEIESEKIAALRALIACPTTSIGTINRIDLKEAKETFPSKIEENVYYCGYHSKDSFGAFSYLILRENGNILVDSPRFVSSLADKIESLGGIRYHFLTHQDDVADHQKFKEKFGCDRIIHENDLKSLPSAEIVLKGEKVFELDNEVKMIPVPGHTQGHSVLLYKNRFLFTGDHLAYDPLKDRLIAFKNVCWYSWQEQINSMKKLKNYSFEWVLPGHGYPVNKEQKIMLDLLKSCIAWMETR

SEQ ID NO: 17067 - protein, 162 aa, Leptospira interrogans serovar Lai str. 56601
MDKPYRKNVGMVVFNSRGEVLVGERLNFLGSWQFPQGGIDDDEDPIKAAMRELYEEVGIDSGKIVAEYPDWISYDFPENLPLNRHLQKYRGQLQKWFLIYWDGEVDQCDLDIHEREFGTVRFIPIKNTLNTVVPFKKDVYYKIVNDFGPKIQNFLQDIGNRS

SEQ ID NO: 17068 - protein, 443 aa, Leptospira interrogans serovar Lai str. 56601
MISPLRWLLPAKAKPLLSKELIDRSYPRFRWRILEATFIGYATFYLVRNNFPVISKEMGEALHYSQEQITNILAVTAITYGIGKFLMGILSDRSNPKYFMPLGLILTAICNLFFGASNQYEVHFYLWALNGLMQGMGWPPCGRSLGHWFGVSERGSKFAIWNIAHNVGGGLVGIIAAYSASWWGWRNAFYIPALIAIVTAIYLLFRLVDTPQSVGLPPIEEYQKDPEKEVRLSIQEQEKELSFREIILGSVLKNHYVWTFAFANFFVYVVRYGLTDIGPTYLKLSKGASLEKGGISTLIYEFAGIASTLLVGWGSDKLGGKRGMVSLLCMLPILFALISLLFTPLGFLWLDLVLFGIIGFFIYPPVMLLGVAGLDFTSKKAVGAAAGFIGLFGYLGRTILSKSVGWLSKQTGFHWEQPMYLMIGATLISIALLAITWNWKPKA

SEQ ID NO: 17069 - protein, 490 aa, Leptospira interrogans serovar Lai str. 56601
MIRGRIPGGRLTSEQYLVWDELGDKFGGGAIRLTTRQSVQLHTLRIFHLRDVMKAIHEVNLSSMGACGDVVRNVTQAVNPLGKKELQLLDGVSQILSDHFKYKTNAYAEVWLGDKQLNKDEEDPIYGKTYLPRKFKIAVTLAGNNTVDIYANDMGFAATLSSDGNRIDGYFVFAGGGFGMTHNKPETFARAASLLGWVPENALIPVAEAIVTAHRDFGDRTNRKHARLKYVLAEKGVEWFQSEVESRSNVKLDKDKPLPNWETPSYLGWNERQDGTLSLGFHTLAGRIKDFPGKPLKSALKEIIGAYKLSVQITADQDLILIGIQKSDQEKVEKRLEELNVSWKSPSRLYDRALACPALPTCALALTESERSFPEVLNGIQKVLDKLGLSDRAPVVRMTGCPNGCARPYSAEVGIVGQQAGGKYSLFFGADSEGTKVGEYVAKKIALADIPAQLEKAFVLWKNEGDSDEKFGDFVNRFPLERFREALGSM

SEQ ID NO: 17070 - protein, 165 aa, Leptospira interrogans serovar Lai str. 56601
MRFNMNETLYDLTATLNNGKEQKLENYKGKVLLIVNTASECAFTPQYAGLQNLYSKYKTEGLEILGFPCDQFKHQEPGSDETIKNFCQKNYGVEFPIFKKIEVNGDNAHPVFRFLRNKASGFFGNSIKWNFTKFLVDKQGNVIKRYSPITTPENIEKEIQNLLKR

SEQ ID NO: 17071 - protein, 443 aa, Leptospira interrogans serovar Lai str. 56601
MNQNKPTSKLISDFWKGKTSEELFERAKKVSPGGVHSPVRSFRSVGGTPVFFASAKGATLTDISGKEYIDYCLSFGPLILGHRDPEVEEVVRETTEIAWSFGAAEPYSLELAELISSRVPWAEKVRFVNSGTEAVMSALRVARAATGREKILKFDGCYHGHLDSLLVKAGSGLAGESSSDSAGISATSIANTLVLPLDDEASVERVFETEGKNIAALIIEPLPANYGLLIQRKEFLLKIVETARKYGTLVVFDEVISGFRVGFQGMSGLLGIWPDLVTYGKIIGGGFPVGCYAGKKDLLDLVAPSGPVYQAGTLSANPFGMRAGLATLKKVQRDSIYSVLDDRTKIFTDTMTKLLNKKSNQEWEAVIHSSLFWFRKKTQQPIRRIDLIPEGHKESFAKVFHTFLKNGIYLAPSGYEVGFLSWAHDDEIIAKTLEIADKALKTF

SEQ ID NO: 17072 - protein, 316 aa, Leptospira interrogans serovar Lai str. 56601
METKLQKIGEVGTLLFPAWVLIGSILSFFFPQWFTWFTGPAITYGLGFTMLGMGITLLPRDFRNIFKTPIPVFIGVALQYTVMPVSGWGIGVLLDLPIPLATGLVVVSCCPGGVASNVITYLAKGDLALSVSMTASSTILSVFMTPLLTLFLIGKGIDVSTSGLFLDTFQVVILPIVLGVLLNVYFPEVSKKIQAVSPLVAVFLITMIVSSILGAGKEKILQSAGILIFAVLSLHISGFFFGYVISWLFIRKQKISRTISIEVGMQNSGLGVVLSRNNFPDPLVAIPAAISSLVHSLIGSLLAVFWRKLEKETTIR

SEQ ID NO: 17073 - protein, 281 aa, Leptospira interrogans serovar Lai str. 56601
MMELWLDEALELKNGRALKIKVKEFLHSRTTPFQKIDVFESVGFGRMFTLDGVVMMTEADEFAYHEMIVHVPMMSHPNPEKVLVIGGGDGGTVREVLKHPSVKEVHLCEIDKGVIDVCYEYFPEIANAMKDPRVKHAYEDGAKYVKDYQNYFDCIMVDSSDPVGPAEVLFKRPFYETMANCLKEGGICTTQGESFYYHGSIIRELFNFIPEIFKHCGYYYTVVPTYPSGIIGFTYCSKGPDPYTVVPDPQRVPQGLKYYSAEMHKAAFVLPQFAQKHIVRK

SEQ ID NO: 17074 - protein, 487 aa, Pseudomonas putida
MRETKEQPIWYGKVFSSNWVEARGGVANVVDPSNGDILGITGVANGEDVDAAVNAAKRAQKEWAAIPFSERAAIVRKAAEKLKEREHEFADWNVRECGAIRPKGLWEAGIAYEQMHQAAGLAYLSNGTLFPSAVPGRMNLCQRVPVGVVGVIAPWNFPLFLAMRSVAPALALGNAVILKPDLQTAVTGGALIAEIFSDAGMPDGVLHVLPGGADVGESMVANSGINMISFTGSTQVGRLIGEKCGRMLKKVALELGGNNVHIVLPDADLDGAVSCAAWGTFLHQGQVCMAAGRHLVHRDVAQQYAEKLALRAKNLVVGDPNSDRVHLGPLINDKQVVRVHALVESAQSAGAKVLAGGTYQDRYYQATVIMDVKPEMEVFKSEIFGPVAPITVFDSIEEAIELANCSEYGLAASIHTRALATGLDIAKRLNTGMVHINDQPINCEPHVPFGGMGASGSGGRFGGPASIEEFTQSQWISMVEKPANYPF

SEQ ID NO: 17075 - protein, 387 aa, Synechococcus elongatus PCC 7942
MDIQLGRGKTVRRAYGIDEIALVPGDRTVDPAVTDTRWTIGGIEREIPILASAMDGVVDVKMAVRLSQLGAIGVINLEGIQTRYEDPEPILDRIASVGPTEFVPLMQELYAVPVQESLIRKRIAEVKSQGGIAAVSATPAGAAKFGPVVAEAGADLFFIQATVVSTDHVAPEGVEPLDLAAFCQSMPIPVILGNCVTYDVTLKLLKAGAAGILVGIGPGAACTSRGVLGVGIPQATAVSDCAAARDDYERETGRYVPIIADGGLITGGDICKCIACGADAVMIGSPFARAAEAPGRGFHWGMATPSPVLPRGTRIKVGTTGTLEQILRGPAQLDDGTHNFLGALKTSMGTLGAQTLKEMQQVYVVIAPSLLTEGKVYQKAQQLGMGK

SEQ ID NO: 17076 - protein, 203 aa, Pichia angusta
MNNEYDYLFKLLLIGDSGVGKSCLLLRFAEDTYTQDYISTIGVDFKIRTIELDGKTIKLQIWDTAGQERFRTITSSYYRGAHGIIIVYDVTDQESFNNVNQWLQEIDRYATSGVMKLLVGNKCDLTDKKVVDYAVAKEFADSRGIKFLETSASQSTNVEQAFIVMSKQIKSQMANSQPASNTAGKPSVNLSGTSVINQQGGCC

SEQ ID NO: 17077 - protein, 405 aa, Fragaria x ananassa
MRLASSIATMHFYMTPLLLLLALLVCVSASVENGKPVQSRFVEVVEEPRSSFNSSMADRSNDHWNEHAVDNPEEIASLVDTSIRNSSTRRELGYFSCATGNPIDDCWRCDPQWQRHRKRPANCGIGFGRNAVGGRDGKYYVVSDPGHDDPVNPRPGTLRHAVIQDRPLWIVFKRDMVITLKQELIMNSFKTIDARGVNVHIAYGGCITIQFVTNVIIHGLHIHDCKPTGNAMVRSSPSHYGWRTMADGDGISIFGSSHIWVDHNSLSNCADGLIDAIMGSTAITISNNYFTHHNEVMLLGHSDSYTRDKQMQVTIAYNHFGEGLIQRMPRCRHGYFHVVNNDYTHWEMYAIGGSADPTINSQGNRYLAPNNRFAKEVTHRVQTTGRWRHWNWRSEGDLLLNGAYF

SEQ ID NO: 17078 - protein, 109 aa, Pinus sylvestris
GHGHEGQFAREEAEQQKHTGKLHRSNSSSSSSSSDEEEEGRKKKEGGRKKKGSKDKTKEKLPGDGKQYPGEHEKQYSRQHGGEEEKKAGMLDKIKAKLPGQHNKNDGEQ

SEQ ID NO: 17079 - protein, 469 aa, Solanum tuberosum
MAPEFQKNAMYVSNELENGDVQKNFDDDGREKRTGTLLTASAHIITAVIGSGVLSLAWAIAQLGWVAGPAVLFAFSFITYFTSTLLADCYRSPGPISGKRNYTYMDVVRSHLGGVKVTLCGIAQYANLVGVTIGYTITASISMVAVKRSNCFHKNGHEASCSIESYPYMIIFAVIQIVLSQIPNFHKLSWLSILAAVMSFTYASIGLGLSIAKASGVGHHVKTALTGVVVGVDVSGTEKVWRSFQAIGDIAFAYAYSTVLIEIQDTLKSSPSESKVMKRASLAGVSTTTLFYVLCGTIGYAAFGNNAPGNFLTGFGFYEPFWLIDFANVCIAVHLVGAYQVFCQPLYGFVEGRCSERWPDSKFITSEYAMQVPWCGTYNLNLFRLVWRTTYVIVTAVIAMIFPFFNDFLGLIGAASFYPLTVYFPIEMYIAQRKIPKYSFTWVWLKILSWTCLISITCCSCWIDPGTCH

SEQ ID NO: 17080 - protein, 329 aa, Spinacia oleracea
MAAKLMHAIQYSGYGGGTDALKHVEVAVPDPKSDELLLKIEAATLNPIDWKIQKGVLRPLLPRKFPTIPGTDVAGEVVQAGSAVNRFKTGDKVVAVLSHATGGALAEYAVAKENLTVARPPEVSAAEGAALPVAALTAHQALTQFANIKLDGSGERKNILITAASGGVGHYAVQLAKLGNTHVTATCGARNLDFVKGLGADEVLDYKTPEGASLTSPSGKKYDYVVHGASGIPWSTFEPNLSEAGKVIDLTPGPTAMMTFAWKKLTFSKKQLVPLLLIPKIPNFEYVVNLVKEKKLKTVIDSKHPLSKGEDAWSRIMGGHATGKIIIEP

SEQ ID NO: 17081 - protein, 1004 aa, Shewanella oneidensis MR-1
  misc_feature (194)..(194): Xaa can be any naturally occurring amino acid
MNRRQFFKLCAAGAATSAISALGLMSEKAYAAVREFKLLGAKETRNNCPYCSVGCGLLMYSQGSGGKNSEHAIFHIEGDADHPVNRGALCSKGAGLVDYVNSPHRLQYPEYRAPGSNKWERISWQDAFKRIARLMKDDRDANLIEKNADGVTVNRWLTTGMMTSSGMANESGLATQKFARALGLVAIDTIARNXHSPTVASLAPTFGRGAMTNHWIDIKNSNVVIIMGGNAAEAHPVGFGWVTEAMQHNNAKLIVVDPRFNRSASLADHYAPIRSGTDIAFLLGVIRYLISTNQVNFDYVKAYTNASYLVRDDFDFHDGLFSGFDEAKGEYNKESWFYQLDEDGYAIVDETLEHPRCVWNLLKQHVERYDFATVSNITGTPTEDYQVVCDAIASTHTKDRVATFMYALGWTHHSKGAQNIRSMAMIQLLLGNIGQLGGGVNALRGHANVQGSTDMGLLAQSLPGYLKLPNDKEPTLAAHLAANTPKPLRPGQTNYWQNYPKFYVSLLKAFWGENATPENEFGYQWLPKWDQMYDFGKHLDMMYRGKVNGCIVQGVNAINSMPNRNKNIKALSNLKFLVVLDNLSSETATFWQNEPGFNEVDTASIQTEVFRLPATVFAEEEGSIVNSGRWMQWHYKWANPPGEAMSDSEIVSGLLLELRKLYREEGGKLPEPIQAINWNYTDPHNPSSIELTKELNGYDVATKRQISSFAELKADGSTASACWVYAGSWTEAGNQMARRDNHDPSGKGITPGWAFAWPLNRRVLYNRASCDVNGKPWDEHRKIVEWKDGKWEGIDVPDFNAKLNPQESAHPFIMQADGVGRFFALKLLKEGPFPEHYEPVESPIGTNPLHPNVVHSPVLRWFEGVKDTIGTKEEYPYACTTYSLTEHFNFWTTHCRLAAIAMPETFVEMNEQLAAEKGIKNGDWVKVSSKRGHILTKALVTKRMRPLQVNGQTVHTLGIPRHGSHNALTRKSYSCNVLTTEMGDANTGVPEYKAFLVNVEKAEV

SEQ ID NO: 17082 - protein, 513 aa, Shewanella oneidensis MR-1
MADGLNRVHYNPSTAQLVEFALLRGEGELTANGALVAKTGTRTGRSPGDRFIVKEPGSAADIEWGPVNQAFEPGAFEGLWARVEAFLADKELFVSDLEVGADPEHYQPVRVTTQYAWHQLFARNLFIIPEEFNRQNKPVWQIINAPDFVCMPERDGTNSDAAVILNFAERKVLLAGLKYAGEMKKSMFSVQNFLLPAQGVLPMHCSANVGKDGDTTLFFGLSGTGKTTLSADPKRFLIGDDEHGWAPGGVFNIEGGCYAKCIDLSQKNEPVIWDAIRFGTVLENVVMDEHRVPNYKDSSLTENTRAAYPLEHIAQRKEDNRGAEPHAVVFLTCDVSGVLPPVSILSKEQAAYHFLSGYTAKVGSTEIGSTSAIQSTFSTCFGAPFFPRPAGVYAELLMKRIESFGSQVYLVNTGWTGGPHGIGKRFDIPTTRAIIDAIVSGELKNVETVHLDTLNLAVPVAVSGVDSNLLNPVNTWSDKALYAEYAQKLAAAFTKNFAKYQVSDAIRNAGPKA

SEQ ID NO: 17083 - protein, 225 aa, Shewanella oneidensis MR-1
MRPFLIAPSILSADFARLGDDVKAVLDAGADVVHFDVMDNHYVPNLTIGPMVCKALRDYGITADIDVHLMVKPVDRIVPDFAKAGASIITFHPEASEHIDRTLQLIKESGCKAGLVFNPATPLHYLDHVMDKLDVILLMSVNPGFGGQSFIPSTLDKLRQVRERIDASGFDIRLEVDGGVKVDNIAEIAAAGADMFVAGSAIFGKPDYKAVVDEMRVELAKVEAK

SEQ ID NO: 17084 - protein, 337 aa, Shewanella oneidensis MR-1
MRAVGYQTAGAINALENITLAKPTPTGFDLLVEVKAISVNPVDTKIRASSSAPAGEYKILGWDAVGVVKAIGDKVSLFKVGDEVWYAGDISRSGSYAEYQLVDERIVAHKPQTLSYAQAAALPLTSITAWELLFDRLGLPQDGSATDARILIIGAAGGVGSIITQLAVKLTGAEVIGTASRPESATWVQTLGADVVINHNQPLSQELAKLDIADVTHVISLTQTDKHFDEIVKVLRPQGKLALIDDPVGPLDVMKLKRKSLSLHWELMFTRSLYQTEDMIAQHHLLNRIAELIDTGKVKSTFGEHYGTINAQNLLKAHAQIESGKAIGKIVLEGFSQ

SEQ ID NO: 17085 - protein, 475 aa, Shewanella oneidensis MR-1
MSNEIKTQVVVLGAGPAGYSAAFRAADLGLETVIVERFSTLGGVCLNVGCIPSKALLHVAKVIEEAKAVAAHGVVFGEPTIDLDKLRSFKQKVISQLTGGLGGMSKMRKVNVVNGFGKFSGPNSLEVTAEDGTVTVVKFDQAIIAAGSRPIKLPFIPHEDPRIWDSTDALELKEVPGKLLVMGGGIIGLEMGTVYSSLGSEIDVVEMFDQVIPAADKDVVRVFTKQIKKKFNLILETKVTAVEAREDGIYVSMEGKSAPAEPVRYDAVLVAIGRTPNGKLIDAEKAGVKIDERGFINVDKQLRTNVPHIYAIGDIVGQPMLAHKGVHEGHVAAEVIAGMKHYFDPKVIPSIAYTDPEVAWVGLTEKEAKEQGIAYETATFPWAASGRAIASDCSEGMTKLIFDKDTHRVIGGAIVGVNGGELLGEIGLAIEMGCDAEDLALTIHAHPTLHESVGLAAEIYEGSITDLPNPKAKKK

SEQ ID NO: 17086 - protein, 111 aa, Shewanella oneidensis MR-1
MTELEIIDLVVGDGKEAVKGALITTQYRGFLQDGTQFDSSYDRGQAFQCVIGTGRVIKGWDQGIMGMKVGGKRKLLVPAHLAYGERQVGAHIKPNSDLTFEIELLEVLTRD

SEQ ID NO: 17087 - protein, 499 aa, Shewanella oneidensis MR-1
MAQDLSSLPTALFTQEQVRDAELLAVSEGKTTLYQLVERAGRAAFDCLATQIARQPRLESMPLLVLAGSGNNGADALVCARLALEAGHKVMVFLLKTKGTPEFEQALSAYLNQGGIADSPNIDAILQAPMLIDGLLGTGVHGGVREEVAALIQAINQSDAWVLSLDLPSGIVADTGVVAQAAVMADLTLCFGGLKQGLLTSKARHYCGDLDFADLGLTPFFKTPNATRVGGEILKSYFAARARDSHKGQSGKVTLIGGDFGMAGAIRLASEACLRAGAGLVTVISRPEHQLTVNVSRPELMFWGCELVDMEVYLRLGWAQVVVLGPGLGKHDWGYNLFKAAGLSDKPCVLDADALNLLSNEPRRQTNWVLTPHPGEAARLLGCNVAEIEQDRFAAVRALQQKYGGVVLLKGAGTVIFDGKQMVVAPVGNPGLASGGCGDVLSGIIGALMAQGMDNMQATVVGVVVHGCAADLAAVQGERGMLASDLMPFIRQLVNSDLL

SEQ ID NO: 17088 - protein, 405 aa, Shewanella oneidensis MR-1
MSVDMKLNRAQFDAVMVPNYAPAAVIPVRGEGSRVWDQEGNEFIDFAGGIAVNCLGHCHPALVNALKTQGEKLWHLSNVMTNEPALELATKLVNSTFAERVYFANSGAEANEAALKLARRYALEKHGVEKDEIIAFDKAFHGRTFFTVSVGGQAAYSDGFGPKPQSITHLPFNDVAALEAAVSDKTCAIMLEPLQGEGGIIDADPAFLKAVRELANKHNALVIFDEVQTGVGRTGELYAYMGTDIVPDILTTAKALGGGFPIAAMLTTTEIAEHLKVGTHGSTYGGNPLACAIGNAVLDVVNTPEVLNGVKHREQLLRDGLNKINEKYHVFSEVRGKGLLLGAVLNEQYQGRSRDFLVASVAEGLMSLMAGANVVRFAPSLVIPEADIAEGLARFERAVASIAAA

SEQ ID NO: 17089 - protein, 332 aa, Shewanella oneidensis MR-1
MSDLPNDYAHIHIEQPGAPEVMQLSRSSLPVVGAGQVLIRVSAAGVNGPDLKQRAGAYPPPPGASLILGLEVAGEICALGEGVTQWQLGDKVCALVPGGGYGEYTLTYAAHCLPIPKGFSMVQAAALPETFFTVWGNLFMRAGLKAGETVLIHGGSGGIGSTAIALANRLGAKVIATTGQDEKRDYCLGLGADLVVNYNSQNFVEEVMSFTQGKGVNVVFDIAGGDFINLNLQSLALDGRMVSVSTQRSPKAEVNILQLMAKRIVWTGSTLRPQTVEAKAEIARQLRERVWPLLDSQQIVPHIFATYPLIDAPKAHRLMQSGEHRGKVVLTL

SEQ ID NO: 17090 - protein, 349 aa, Shewanella oneidensis MR-1
MTSTLNLHQVHSDYQGQQILKGLDLTLAQGEILALLGPSGCGKTTLLRAVAGLQAISQGEIQINGKTVSGAGQFVPSEQRGIGMIFQDYALFPHLTVAENILFGVAKLTTAQRKARLDDMLALVKLEGLAKRYPHELSGGQQQRVSIARALAYEPQLLLLDEPFSNIDAQVRHSMMAEIRSILKQRNVSAVFVTHSKDEAFVFADTLAIFSQGVIVQHGRAEDLYAAPNSRYVADFLGSGNYLPAEVVDGHSVTTPIGQLRSLTPLSQSHAFNGQVFLRPQQLALSADDAGVGTITERRFLGAFCHYWVKVEAASHAYYLEVRSQIMQFNVGQRVGLSTEPHSLVLFES

SEQ ID NO: 17091 - protein, 408 aa, Shewanella oneidensis MR-1
MTVSELRFALDTFYFLISGALVMWMAAGFAMLEAGLVRSKNTTEILTKNVVLYAIACVMYLLVGYNIMYVDNAEGGWLPSFGTLIGSQAADANHALESDFFFQVVFVATAMSIVSGAVAERMKLWAFLVFSVVMTGIIYPVEGYWTWGKGFIASLGFVDFAGSGIVHMTGAAAAIAGVLLLGARKGKYGPNGQVNPIPGSNLPMATLGMFILWMGWFGFNGGSQLMVSDAANASAVAKVFVNTNTAAALGAISALIVCKMIWGKADLTMILNGILAGLVAITADPLSPSLLMAGVIGLVAGGLVVFSIVGLDRIKIDDPVGAISVHGVAGFLGLMCVPLSNANATITAQLTGAAIIFAWVFSASFAVWFVLKMTMGIRVSEEEEYNGMDASDCGIDAYPEFVTVKSAG

SEQ ID NO: 17092 - protein, 304 aa, Shewanella oneidensis MR-1
MSERYLENGIRQLVSEFIAAGCPSVREQSLEERRQGYIASTVLAGEPEAVFEVKSVSLEGIELTLFKPSADNNLPVVIYYHGGCFVSGGIATHNQQLRKIANDSGALVVAVSYRLAPEHVYPAAHDDAFNAANLVQQHCHQWGGDNTNITLMGDSAGGHLALVTCLRLKAKGEWLPKKQVLIYPMLDATAKSQSYIDNGDKYIITRDTLLTGFDMYLDWHPRTDVEASPLRSHDLAGLPETHIITAEFDPLLDEGEQLFRHLLAAGVDAHCRRYLGVIHGFFQLAGVSQSARDAMAQVTHIIRA

SEQ ID NO: 17093 - protein, 409 aa, Shewanella oneidensis MR-1
MAKHSLDKDKIKILLLEGVHQSAVDVFERAGYTNIEYHKASLGDEALHESIKDAHFIGIRSRTQLSADVLKRAEKLIAIGCFCIGTNQVDLATAESLGIPVFNAPFSNTRSVAELVLGEIIMLMRGIPERNAIAHRGGWMKTAAGSYEVRGKTLGVIGYGHIGTQLGILAETLGMRVVFFDIEDKLPLGNAQQIHSMEQLLAQADVVSLHVPETPQTKDMISTAEFAAMRKGSIFINASRGTVVDIDALTVALKERHLAGAAIDVFPVEPQSNDDEFISPLRGLDNVLLTPHVGGSTAEAQENIGIEVAGKLAKYSDNGSTVSAVNFPEVSLPMHKGTSRLLHIHQNRPGVLIKINKAFSEKGINIAAQYLQTTAEIGYVVMEVDTHQAEEALVELKAIDGTLRTRVLF

SEQ ID NO: 17094 - protein, 346 aa, Shewanella oneidensis MR-1
MEYRRIPHSNLEVSKICLGTMTWGEQNTQAEAFAQLDYAIGSGINFIDTAEMYPVPPKPETQGETERILGQYIKARGNRDDLVIATKIAAPGGKSDYIRKNMALDWNNIHQAVDTSLERLQIDTIDLYQVHWPDRNTNFFGELFYDEQEVEQQTPILETLEALAEVIRQGKVRYIGVSNETPWGLMKYLQLAEKHGLPRIVTVQNPYNLLNRSFEVGMSEISHREELPLLAYSPLAFGALSGKYCNNQWPEGARLTLFKRFARYTGSQMALDATAAYVDLAREFNLSPAQMALAFVNSRKFVGSNIIGATDLYQLKENIDSLKVSLSPELLSRLNALSDQFRLPCP

SEQ ID NO: 17095 - protein, 391 aa, Shewanella oneidensis MR-1
MAIINMSDLDLQGKRVLIREDLNVPVSNGVVTSDARLRASLPTIELALAKGAAVMVMSHLGRPTEGEYNSEFSMQPVVDYLAKALSCPVRLATDYLDGVEVAVGEVVVFENVRFNKGEKKNDEALSKKMAALCDVYVMDAFGTAHRAEASTNGVGLYAPIACAGPLLAQELDALGKALDNPARPLVAIVGGSKVSTKLTVLESLSGIVDQLVVGGGIANTFIAAAGHNVGKSLYEADLIDEAKRLVANAQSRGGDIPVPTDVVVAGEFSPTAAATLKAVSDVGDSDMIFDIGPDSAEALAKIIESAGTIVWNGPVGVFEFDQFGEGTKRIAHAIADSKAFSIAGGGDTLAAVDKYGIADKVSYISTGGGAFLEFLEGKELPAVAMLKKRGA

SEQ ID NO: 17096 - protein, 329 aa, Shewanella oneidensis MR-1
MRIGFFSAKHYDMQHFNRTNAAFDAQIEYFDYRLCMQTVKLAEGFEVVCAFVNDSLCEEVLVELAKGGTKIIAMRCAGFNNVDLVAAKRLGMQVVNVPAYSPESVAEHTVALMLTLNRKIHKAYQRTRDANFSLEGLVGFNMFGKTVGVIGTGKIGVATIKVLLGFGCKVIAFDPYPNPAVEALDVEYQDLDTIYATSDIISLHCPLTPDNHHLLNKDSFAKMKPGVMVINTSRGGLLNAFDAMEALKLGQIGALGLDVYENEKELFFEDKSNQIIQDDVFRRLSACHNVIFTGHQAFLTEEALGAIANTTLSNVQAVLAGKRCGNELF

SEQ ID NO: 17097 - protein, 1428 aa, Shewanella oneidensis MR-1
MIELRIDNKIVSAEPSDNLLHAARKAGIAIPSLCDPTDASRQLDTQAHAEKQDCNLCLVQIENSDASLRCVKACETPAQTGMKVITQSAFLTKQRQAALNAILSDHFADCEAPCQQACPAGVDVQRYLYHIAQGDHTQAVKVIKETLPLPLSIGRVCPAFCETECRRGLIDDPIAIRQLKRHAADLDLADDEHGNSYQPPRLADTGKKIAIIGSGPAGLSAGYYLSNQGHNIEIFEAMPKAGGWLRYGIPEYRLPKAILDKEIELLCRNGLTIHTQMRLGHEIHLNQLITDFDAVCLAIGAQKAVPMHYKGSELAGCYLGVDFLKDHCLDKQLKLGKKVAVIGGGNTAIDCARTAVREGCDVTLIYRRTRAEMPAEAYEVHEAEVEGVKFHFLTNPLENHSDADGRVQSVTFSKMTLGEADASGRRAPVDTGETFTEAFDTVIAAVSQAPDLSFMQDPKGQLSHGELALSRWNTLMGCEQTMSSGVEKLFVMGDARRGPATAVAAIGDGRKAAKAIDKMLQIGLSCDLHAHEFNSVKTIPGSLKQAEVKSAEASSPLYPHTKRQPRLKMPELTALQRLLNYSEVELGFPADAAMQEAARCLECACQANTDCKLRDYATDYGVESKSLATENARYFSVDKSSPFIQFDANRCISCGKCVDVCQQQSGHCAIQFAKDSYQVLPQSISPADERRAPRVGFSASMADSHCVQCGNCVQVCPTGALVDARDKRQGDCTELTTASTICTYCGVGCRLDLKIDPSTNRIRHIEGNKDSVVNQGMLCVKGRFGFDFIHSDKRLTTPLIRKNGKLQPCSWPEAIDYVAKRLTEIKQKDGSNAFASLASAKATNEDNFVLQKFVRSVLGTNNIDHCARLCHSSTVTGLQQSIGSGAMTNDILSIKDSDVIFILGSDTTCAHPIIASKIQQAVNLYGARLIVADPKRVGIAEKAELYVAHRPGTDVMLLNAIMAEIIRNNWQDKDYIAKRTEGIEALYAELAKEDYSLEKAALITGVKAENIARIARTIGTAQKTAVYYAMGITQHTTGHDNVTAISNLQLLCGNIGVSGAGINPLRGQSNVQGACDMGALPNYFTGYQKVTDIHARMRFESHWQTPLSGEIGVTATHMMHDIAKGKINALYVMGENPVLSDPDQAHVLNALSQIEFLVVQDIFLTETAELAHVVLPAAAFVEKRGHFTNTERRVQRLEQALASPGEALPDWQIVQAIANAMGANWDYKDEAAIWAEINALTPQYRGILWERLTAGEDGQIPQGIQWPCPDEKHPGTPIMHQGQFTRGLGLFTPVSYRLPAEMPCNEYPLTLSTGRLLEQFHTGTLTRKTPGLDLLGAPKVMISVYDAEQLGINNGDKIRLTTRRGEIEIDAFVTKRAQAGVLFLPFHFVEAAANKLTINALDPVAYIPEYKVCAVRVEKVTKQMCEPT

SEQ ID NO: 17098 - protein, 241 aa, Shewanella oneidensis MR-1
MINITNLHKSYGDNAVLKGINEHIRQGEVVSVIGPSGSGKSTFLRCINLLENPTQGDIEIEGQSITAKDACVDKLRQKVGMVFQNFNLFPHKTVLQNITLAPVSLKLMTQAEADNKALALLTQVGLQDKANAYPSSLSGGQKQRVAIARALAMEPDLMLFDEPTSALDPEMVGDVLDVMKDLAQKGMTMVIVTHEMGFARDVSDRVIFMDGGYVVESNIPEELFTRPKEARTQSFLSKVLR

SEQ ID NO: 17099 - protein, 429 aa, Shewanella oneidensis MR-1
MLEKLFKLKQNQTSLKQEAMAGLTTFMTMAYIIFVNPMMLADAGMDHGAVFVATCLATAVGCIVMGLMANYPIALAPGMGLNAFFTYTVVGEMGYSWETALGAVFLSGICFLILSLVRIREWIVNSIPMSLRIGIAAGIGLFLALIGLKSAGIVVASPATLVTMGDITAFPAVMAVLGFFLIIAMVQRGMKSAVILSILIITGLGLLFGDVHYNGIVSMPPSIAPTFMQMDLSQVFEVTMLSVVFAFLFVDLFDTSGTLVAVAQRGGFLDENNRLPRLNRALTADSLATIAGAALGTSTTTSYIESTAGVSAGGRTGLTAVVVGLLFILALFVSPLAGMIPAYATAGTLFYVAILMMSGLVHVEWEDLTEAAPVVIVCILMPLTFSIATGIALGIISYAAIKLLTGRFSDLNIGVLVLAAMFVAKFIYA

SEQ ID NO: 17100 - protein, 378 aa, Shewanella oneidensis MR-1
MSKRDYYEVLGVGRDASEREIKKAYKRLAMKFHPDRNPGDKAAEASFKEVKEAYEILTDANKKAAYDQFGHAGVDPNRGGGGGYGGAGDFGDIFGDVFGDIFGGGRRGGGQRQAARGSDLRYNLELSLEEAVKGLTKELRIPTLASCDVCDGSGAKKGTSATTCTTCHGQGQVQMRQGFFTVQQPCPTCHGRGKIIKDPCAKCHGDGRVEKTKTLSVKIPAGVDTGDRIRLAGEGEAGEFGAPAGDLYVQVSVREHAIFVRDGNNLYCEVPISFSKAALGGEIEVPTLDGKVSLKIPAETQTGRMFRLRGKGVKSVRSHAVGDLLCKVVMETPVNLNERQKELLREFEATLTGESKKHSPKAEGFFDGVKKFFQDLNS

SEQ ID NO: 17101 - protein, 205 aa, Shewanella oneidensis MR-1
MSDKFSTVEQQASYGVGRQMGEQLAANSFEGVDIPAVQAGLADAFAGLESAVSMQELQVAFTEISRRIQAAQEQAAAEASAEGEAFLVENANREGVIVTESGLQYEVLVQGNGAKPTYEDTVRTHYHGSFINGDVFDSSVVRGQPAEFPVSGVIAGWTEALQLMPVGTKLKLYVPHHLAYGERGAGASIPPYSTLVFEVELLDIV

SEQ ID NO: 17102 - protein, 260 aa, Shewanella oneidensis MR-1
MALRRPMVAGNWKMNGSAALAQELFKKFASKLQNDSAEVVLCPPSIYLESVRQLLEANKEALDGSLVRMGAQNLSQHDFGAYTGEVSGQMLKDCGCRYVIIGHSERRRMYGETSNIVAEKFAAAQKHGLTPILCVGESGPAREARRTFEVIAEELDIVIQKNGTMAFDNAIIAYEPLWAVGTGKSATPEQAQEVHAFIRKRLSEVSPFIGENIRILYGGSVTPSNAADLFAQPDVDGGLIGGASLNSTEFLSLCTIAMSA

SEQ ID NO: 17103 - protein, 454 aa, Shewanella oneidensis MR-1
MAKNKTAYVCNECGQDFPRWQGQCSACHEWNTITEVRLGAASPGRGTKFAGYAGAGSSEVKTLDQIDLNALPRIVSHFGELDRVLGGGIVPGSAILIGGHPGAGKSTLLLQTLCHLAEQMPALYVTGEESLQQVAMRAHRLGLPTNKLRMLSETSVEQICEIALQESPKVIVVDSIQVMHMSDVASSPGSVSQVRESASYLTRFAKQHGIAVIMVGHVTKDGSLAGPKVLEHCIDCSVMFEGDSDSRYRTLRSHKNRFGAINELGVFAMTERGLKEVANPSAIFLSRGEEESSGSLVMVVWEGTRPLLVELQVLVDNSAMSNPRRVAVGMDANRLAMLLAVMHRHGGLQMSDQDVFVNVVGGVKVTETSADLTLLLAMVSSFRGDILPSDLVVFGEVGLSGEIRPVPNGQERLVEAAKHGFKRAIVPRANVPKKPPVGMEVVGVSKLSEALEAI

SEQ ID NO: 17104 - protein, 450 aa, Shewanella oneidensis MR-1
MSEQLSSTAVPSGSFLNRFFSIQQRGSTVRQEVIAGLTTFLAMVYSVIVVPNMLGKAGFDPGAVFVATCLIAAFGSLLMGLWANLPMAIGCAISLTAFTAFGLVLGQGMSIPVTLGAIFWMGVIFTIVSVTGIRQWVLANLPKGIAHGTGIGIGLFLLLIATNSVQLIVANDAGLPVKLGDINSLPVIATVVGLAATIGLERRGVPGGILLVIIGLSLFGLVFDPSVKYQGLFALPNLTSEHSLIGQLDIMGALNPVVLPIVLALVMTAIFDATGTIRAVAGQANLLDKDDNIVGGGKALTSDSVSSMFAGVVGGAPAAVYIESAAGTAAGGKTGLTATIVGVLFLLMVFLAPLSYLVPAYATAPALMYVGLLMLSNVTKLDFNDKVDAMAGLTCAVFIILSCNIVTGIMLGFVTLVIGRIFSGEWRQLKLGVLAITLGLVVFYMGGWAI

SEQ ID NO: 17105 - protein, 451 aa, Shewanella oneidensis MR-1
MNKLIAFLKERKITEVECVICDMTGIARGKIAPVDKFLDEKGMRLPESVLLQTVTGDFVDDDIYYSLLDDADIDFVCVPDENAVFMLPWTIEATAQVIHDCYDRMGNPIELSPRNVLKKVLSLYDEKGWEPVIAPEMEFYLTSRSDDHDLPLKPPIGRSGRPEAGRQSFSIDAANEYDPLFEDMYDWCEIQGLDIDTLIHEDGPAQMEINFSHGNPLSLADQVFVFKRTLREAALKHNVCATFMAKPVTDEPGSAMHIHQSVINKETGKNIFTNEDGTQSALFLSYIAGLQKYIPEFLPLMAPNANSFRRFLPGTSAPVNLEWGIENRTCGLRIPESSPQNRRIENRIPGADANCYLAFAAGLLCGYIGMVEGLKPSTPVQGKANESRSNNPHCLPLTLEEALVAMEESDACKEYLGESFTTGFVAVKQAELENFRRVVSSWEREFLLLSV

SEQ ID NO: 17106 - protein, 482 aa, Shewanella oneidensis MR-1
MLLNDPSLLRQQCYINGQWCDANSKETVAITNPATGAVIACVPVMGQAETQAAIAAAEAALPAWRALTAKERGAKLRRWFELLNENSDDLALLMTSEQGKPLTEAKGEVTYAASFIEWFAEEAKRIYGDTIPGHQGDKRIMVIKQPVGVTAAITPWNFPAAMITRKAAPALAAGCTMVVKPAPQTPFTALALAVLAERAGIPAGVFSVITGDAIAIGNEMCTNPIVRKLSFTGSTNVGIKLMAQCAPTLKKLSLELGGNAPFIVFDDANIDAAVEGAMIAKYRNAGQTCVCANRIYVQAGVYDEFAEKLSMAVAKLKVGEGIIAGVTTGPLINAAAVEKVQSHLEDAIKKGATVLAGGKVHELGGNFFEPTVLTNADKSMRVAREETFGPLAPLFKFNDVDDVIKQANDTEFGLAAYFYGRDISLVWKVAESLEYGMVGVNTGLISTEVAPFGGMKSSGLGREGSKYGIEEYLEIKYICMSV

SEQ ID NO: 17107 - protein, 425 aa, Shewanella oneidensis MR-1
MSTTNDSLMARRQAAVAGGVGQIHPIFTARAENASVWDVEGREFIDFAGGIAVLNTGHLHPKVKAAVAAQLEDFSHTCFMVLGYESYIQVCEKLNQLVPGDFAKKTALFTSGSEAVENAVKVARAYTKRAGVIAFTSGYHGRTMAALALTGKVAPYSKGMGLMSANVFRAEFPCALHGVSDDDAMASIERIFKNDAEPSDIAAIILEPVQGEGGFYAVSPAFMQRLRALCDREGIMLIADEVQTGAGRTGTFFAMEQMGVSADITTFAKSIAGGFPLSGITGRAQVMDAIGPGGLGGTYGGNPLACAAALAVLEVFEEEKLLERANAIGDRIKSALNTMQVEHPQIADVRGLGAMNAIELMEDGKPAPQYCAQILAEARNRGLILLSCGTYGNVLRILVPLTVSDTQLDAGLGILKTSFNAVLKG

SEQ ID NO: 17108 - protein, 430 aa, Shewanella oneidensis MR-1
MTRSEALFEQAKKTIPGGVNSPVRAFNGVGGSPLFIEKADGAYIYDADGKAYIDYVGSWGPMILGHNHPKIREAVLAAVHNGLSFGAPTELEVQMAEKVIAMVPSIEQVRMVSSGTEATMSAIRLARGFTNRDKILKFEGCYHGHADCLLVKAGSGALTLGQPSSPGIPEDFAKHTLTAVYNDLDSVRSLFEQYPTEISCIIIEPVAGNMNCIPPIPGFLEGLRSLCDEFGALLIIDEVMTGFRVSKSGAQGHYGVTPDLTTLGKVIGGGMPVGAFGGRKDVMQFIAPTGPVYQAGTLSGNPIAMSAGLAQMEALCEEGLYEALSAKTKRIAEGFKAAADKHGIPMAINYVGGMFGFFFTEQEHITRFDQVTKCNIEHFRTFYHGMLDEGVYLAPSAYEAGFLSMAHGEEELRLTLEAADRVLARMKAAN

SEQ ID NO: 17109 - protein, 229 aa, Shewanella oneidensis MR-1
MSQKMAAEFLGTLWLVLGGCGSAVLAAAFPEVGIGLLGVSLAFGLTVLTMAFAIGHISGCHLNPAVSFGLWAGGRFPTSELLPYIIAQVAGGIAGAGVLYLIASGQEGFSLAAGFASNGFGEHSPGGYSMISVMICEIVMTLFFLLVILGSTDERAPKGFAPIAIGLCLTLIHLISIPISNTSVNPARSTGPALFVGDWAVSQLWLFWAAPIIGAILAGVIYRYFNAAK

SEQ ID NO: 17110 - protein, 468 aa, Shewanella oneidensis MR-1
MSNDFQFIEVGRKDPTKHPAAKRSTQFIEIYQPFAQAQVSEQADRCLDCGNPYCEWKCPLHNYIPNWLKLAQQGRIMEAADLVHETNTLPEICGRVCPQDRLCEGACTLNADFGAVTIGNVEKYITDTAIAQGWRPDMSKVTPRKEKVAIVGAGPAGLGCADILARNGVKAVVFDKYPQIGGLLTYGIPAFKLDKAVMATRRTVLEGMGIEFKLGVTVGKDVAFNQLLEEYDAVFLGMGTYTAMKAGLEGEDAQGVYQALPYLIGNTHHLMGSTSPDMPYLNLAGKRVVVLGGGDTAMDCVRTAVRQGASSVICAYRRDEANMPGSRREVQNAREEGVNFLFNRQPVAIKTQDGKVLGVECVETQMGKADASGRQRAEAIVGSEQLLEADAVIIAFGFQPSPAPWFADYGIELDQWGRVKASKQADNPFQTTNPKVFAGGDMVRGSDLVVTAIAEGRDAAQGILNYLD

SEQ ID NO: 17111 - protein, 174 aa, Shewanella oneidensis MR-1
MIDSDGFRANVGIIICNRYGQVMWARRFGQHSWQFPQGGVDDGESAEEAMYRELYEEVGLRPEHVTVLTSTRSWLRYRLPKRLVRQDSKPVCIGQKQKWFLLQLKSQDSAINLSSSGHPEFDDWRWVSYWYPVRQVVSFKRDVYRKVMKEFAVTALSFQTQEIPKKRVRQKTTG

SEQ ID NO: 17112 - protein, 156 aa, Shewanella oneidensis MR-1
MKMLLAVVVIAGVIFYFFTTMNNQKAAQENIRLGNEFLAQNKTKEGVVTTASGLQYQVLNQGSGTIHPKASDTVTVHYHGTLIDGTIFDSSVERGDPIAFPLNRVIKGWTEGVQLMVEGDKYRFFIPSDLAYGNRSTGKIGGGSVLIFDVELLKIN

SEQ ID NO: 17113 - protein, 162 aa, Shewanella oneidensis MR-1
MTSTIYRHNAIDIQGNPTPLTQYQGKVILIVNTASECGFTPQYKGLEALYQEYKARGFVVLGFPCNQFGAQEKANEQGIKSFCELNFGVSFPLFSKIEVNGEHTHPLYQYLKKAAPGMLGTERIKWNFTKFLINRQGEAVARFAPTTKPEDIRDKIESLLNK

SEQ ID NO: 17114 - protein, 300 aa, Shewanella oneidensis MR-1
MSTVAFIGLGNMGGPMAANLLKAGMTVRVFDLVHTAMQTLAEQGALVSSTACGAAAGANVVITMLPAGKHVKNLYLGSGSEKGLLDVVASDTLLIDCSTIDAQSAQLVATQAAKNGLEFMDAPVSGGTSGAAAGTLTFICGGSDTAFERAQPVLNAMGKNIFHAGGPGAGQIAKICNNMLLSVLMVGTSEALQMGIDHGLDPKVLSNIMKVSSGGNWTLEKYNPCPGVMENVPSSKGYQGGFMVDLMVKDLGLSFEAALLSNSSTPMGALARSLYVSHARQGNGHRDFSSIFEQFAPLKK

SEQ ID NO: 17115 - protein, 397 aa, Shewanella oneidensis MR-1
MQDKSSKMWKAATQAIHAGHEREAFGSLVTPLYQTATFVFDSAQQGGERFAGNEPGYIYTRLGNPTVAELERKMAILERAEAAAATASGMGAVSAALLANLQIGDHLVASNAVYGCTFALMTNQFARFGIEVTLVDFSDVELIERAIKPNTKVIFCETPVNPHLQVFDLSAIAAIAKRHSLTSIVDNTFMTPLLQQPIALGIDVVVHSATKYLNGHGDVIAGIVCGSEAQLHRVKYEILKDIGAVMSPHDAWLILRGLKTLDVRLQRHCESAQRVAEFLEQHPAVTRVYYPGLKSHSGHRFIGQQMRRAGGVIAFELAADFTQAMAFVGNLKLFSIAVSLGDAESLIQHPASMTHSPYSPEARAAAGIGDNLLRISVGLEDCDDIIADLSQALAALV

SEQ ID NO: 17116 - protein, 234 aa, Shewanella oneidensis MR-1
MAGLNKVVSSYEEALTGLSDDMTIMVGGFGLCGIPEGLINQMVKMGVKGLTAISNNAGVDDFGLGLLLKHRQISTMIASYVGENATFEQQMLSGELNVILTPQGTLAEKIRAGGAGIPAFFTATGYGTPVAEGKETREIKGRHYVLEESLTADFALVRAWKADTMGNLVFRKTAANFNPMMATAGKITVVEAEFIVEPGELDPDHIHTPGIYVDRVIQGKFEKRIEQRTVKAAK

SEQ ID NO: 17117 - protein, 508 aa, Shewanella oneidensis MR-1
MQNHSNLNDIGVIGLGVMGKNLALNIADNQYRVSVFDLDPVKVNGVLQQEKQERVGQELRITGCANLSEMLASLTKPRILVLSVPAGAPVDGVCAALISAGIEADDIVIDTGNSLWTDTVEREQHYQGQFIFFSSAVSGGEVGARFGPSLMPSGDLGAWQHVAPIWKAIAAKVNPQTGLPIERFEPGNPVTEGEPCTTYIGPAGAGHYVKMVHNGIEYADMQLICEAYQLLHDGLGMSAAEVGEVFERWNQGSLNSYLMGISAEVLKQADPLTGKPLVEMILDKAGQKGTGLWTAVSSLQIGCPAPTIAEAVYARAVSTQKSLRVELSKKLAGPLSPAMDENQKANLIDALESALYCAKVCCYAQGFQLMAMTALEQKWQLDFAEIAKIWRAGCIIRATFLQSITQAYQADANLSCLLMADTFASTLSEKQTEWRIAVAAAIMQGIPVPCISSALAYYDSYRSETLPANLLQGQRDFFGAHTFERLDKPAGEKYHLDWSAQERVLIKL

SEQ ID NO: 17118 - protein, 214 aa, Shewanella oneidensis MR-1
MRIILLGAPGAGKGTQAQFIMEQYGIPQISTGDMLRAAVKAGTPLGLEAKKVMDAGQLVSDDLIIGLVKERIAQDDCAKGFLLDGFPRTIPQADAMAANGISIDHVIEIDVPDEEIVKRMSGRRVHPGSGRVYHVVFNPPKVEGKDDVTGEDLAIRPDDEEATVRKRLGIYHEQTKPLVEYYGKVAAAGNTQYHKFDGTQSVAAVSEQLASVLK

SEQ ID NO: 17119 - protein, 379 aa, Shewanella oneidensis MR-1
MSNEKPQFIKSKAAVAWGPRQPLKIEEVDVMLPKAGEVLVRIVATGVCHTDAFTLSGDDPEGVFPAILGHEGGGIVEQVGEGVTSVQVGDHVIPLYTPECGECKFCLSGKTNLCQKIRATQGKGLMPDGTTRFYKDGQPIFHYMGCSTFSEYTVLPEISLAKVNKTAPLKEICLLGCGVTTGMGAVMNTAKVEAGATVAIFGLGGIGLSAIIGATMAKASRIIAIDINESKFELARKLGATDCINPKNFDKPIQEVIVEMTDGGVDYSFECIGNVNVMRSALECCHKGWGESVIIGVAGAGQEISTRPFQLVTGRVWRGSAFGGVKGRSQLPKIVEQYLAGEFKLDDFITHTMGLEQVNEAFDLMHEGKSIRSVIHFDK

SEQ ID NO: 17120 - protein, 211 aa, Shewanella oneidensis MR-1
MSTQTNTKSDFSELDWDKQDGLIPAVIQNHLSGKVLMLGYMDKAALEQTLATGDVTFFSRSKQRLWTKGETSGHTLKLVAIDKDCDNDSLLVQVLPNGPTCHKGTESCWLDGNAHPFLNNLAELIASRKGQSPESSYTASLFARGTKRIAQKVGEEGLETALAAATHDKEELVNEASDLMYHLLVLLEDQALSLSDITANLLARHQKAQRK

SEQ ID NO: 17121 - protein, 174 aa, Shewanella oneidensis MR-1
MNYFELFKFPPTFDIDTAVLADRYRELQRAVHPDKFANDTEQQRLLSVQRTAQVNDGYQTLKDPIRRAEHMLSLRGIDLSHETTTVKDTAFLMQQMEWREALEDIRESIDHQAIINELYDSFAAYRLKLTKLLAAQLSSGSDEDALLAADQVRKLKFMAKLQDELTRIEDALLD

SEQ ID NO: 17122 - protein, 459 aa, Shewanella oneidensis MR-1
MKHSGFQAKRLIQLALPVLIAQVTQTMMGFIDTVMAGRVSAVDMAAVAVGTSLWLPAILFVQGLLMAFTPLFAHHNGANNQKAIQPLAFQGAYLALIGGLGVMVFLASAPLVLSHMNLEPQLYNLTIGYIDGILWGAPAFVLYQVLRGCSEGISYTLPTMVIGFVGLAVNIPANYIFIYGHFGIPAMGGAGCGIATALVFWAMLIAMAIYMQFHKKFAALAPFSQFHRPDFATMKKMTKLGLPIAMALFFEVSLFAIIALLLAPLGATVVASHQIALNFSAIVFMLPLSIGIAVSIRIGYYLGRDRADISAVVAKVGLLLALSLALSTAILTVLFRFQIAELYNSDPEVVVLAGSLMLMAALYQLSDSVQVVAAGALRGYKDTRSAFYITLFSYWGIGMSLGYTLAYTDFIVPAMGAHGFWTGLIAGLTSAALLFFIRLRYIQKHRVHLSLIEGDSVHH

SEQ ID NO: 17123 - protein, 314 aa, Shewanella oneidensis MR-1
MEQHQVWAYQTKTHSVTLNSVDIPALAADDILVQNQAIGINPVDWKFIKANPINWSNGHVPGVDGAGVIVKVGAKVDSKMLGRRVAYHTSLKRHGSFAEFTVLNTDRVMTLPDNLSFERAAALPCPLLTAWQAFEKIPLTKQREVLIVGFGAVNNLLTQMLNNAGYVVDLVSASLSQALAAKRGVRHLYREPSQVTQKYFAIFDAVNSQNAAALVPSLKANGHIICIQDRIPAPIDPAFTRTISYHEIALGALHDFGDRQDWQILMQQGEALLTLIAQGKMEIAAPDIFRFEQMIEALDHSEQTKLKTVLTLNE

SEQ ID NO: 17124 - protein, 362 aa, Shewanella oneidensis MR-1
MFKAFKGHALETKNRIVMAPMTRSRSTHPGDVPNEMMANYYRQRASAGLIITEGAPVSAVARGYSMTPGIYTPAQIEGWKKVTEAVHQEGGKIFIQLWHVGRRSHSSVSGAEPLAPSAIKIPDQVFGPLPEGGFGMIETQQPKAMSEQDIQATISDFVQAAQNAMLAGFDGVEVHAAHGYLFDTFLRLESNQRQDRYGGSQENRLRFLVDTLQALTQTIGSGKVAVRISPHIGEGFTGDNPEIIQLTLALLQKLQPMNLAYVHFSENISRYVEVSDAFRQQVRRVYQHPIMVAGKLTKQSAQRLLDQHYADFVAFGTPFVTNPDLVARFTHDWPLTEFDADARLTLYGGGEAGYIDYPAYQA

SEQ ID NO: 17125 - protein, 365 aa, Shewanella oneidensis MR-1
MTQSLFQPITLGALTLKNRIVMPPMTRSRASQPGDVANHMMAIYYAQRASAGLIVSEGTQISPTAKGYAWTPGIYTPEQIAGWRIVTEAVHAKGCAIFAQLWHVGRVTHPDNIDGQQPISSSTLKAENVKVFVDNGSDEPGFVDVAVPRAMTKADIAQVIADYRQAALNAMEAGFDGIELHAANGYLINQFIDSEANNRSDEYGGSLENRLRFLDEVVAALVDAIGAERVGVRLAPLTTLNGTVDADPILTYTAAAALLNKHRIVYLHIAEVDWDDAPDTPVSFKRALREAYQGVLIYAGRYNAEKAEQAINDGLADMIGFGRPFIANPDLPERLRHGYPLAEHVPATLFGGGEKGLTDYPTYQA

SEQ ID NO: 17126 - protein, 404 aa, Shewanella oneidensis MR-1
MRPIIKSNKLDTVCYDIRGPVHKEARRLEDEGHRILKLNIGNPAPFGFEAPEEIVRDVILNLPSAQGYCESKGLFSARKAIVQHYQAQGIYDVDIEDVYIGNGVSELIMMAMQGLLNTADEILIPSPDYPLWTAAANLAGGKAVHYRCDEEADWFPDLDDIKSKISSRTRGIVLINPNNPTGAVYSKELLLQVVELCREHNLILFADEIYDKILYDEAKHIPAASLSDDILTVTFNGLSKAYRAAGFRIGWMMLSGNLKAAKSYIEGLDMLASMRLCANVPNQHAIQTALGGYQSINELILPSGRLTVQRDTCYELLNQIPGVSVKKPKGALYAFPKLDMKKFNLRDDERLVLDLLRDKKILLVHGTAFNWPEPDHLRVVFLPYKEDLTKALTEFGNFLETYKQ

SEQ ID NO: 17127 - protein, 479 aa, Shewanella oneidensis MR-1
MFRRTKIVTTLGPATDRDDNLRRIIAAGANVVRLNFSHGSPEDHLKRATQAREIAKELGVHVAILGDLQGPKIRVSTFKDNKKIQLKLGQTYILDAELAKGEGDENQVGIDYKQLPDDVNVGDILMLDDGRVQLRVERVEGRKVHTTVTVAGPLSNNKGINKQGGGLSAAALTEKDKADILTAAMIQVDYLAVSFPRSGADLEYARSLAQQAGSNALIVAKVERAEAVASDEAMDDVILASDVVMVARGDLGVEIGDAALVAVQKKLIARSRQLNKIVITATQMMESMISSPMPTRAEVMDVANAVLDGTDAVMLSAETAAGDFPEETVKAMANVCVGAESHPSVKVSKHRLDARFTSVEETIALSTMYAANHLEGVKAIIALTESGATPKLMSRISSSLPILGLSRHDTTLAKMALYRGVLPIYFDSTIYPADELAQKALESLTKAGYLHSGDLVLMTKGDAMETIGGTNTCKVLIVA

SEQ ID NO: 17128 - protein, 164 aa, Shewanella oneidensis MR-1
MLDLLPDLFDHYPSKLTLLPLAFRAFGGKRLFWGEVVTVKCFEDNSKVKEVLAQPGHGKVLIVDGGGSSRRALLGDLIAQSAMDNGWQGVIINGYVRDAARLSSFNLGVYALGAMPMKTEKLDQGQINVPIELGCVTVKPGMMVYVDENGIAISEESLNFAFLN

SEQ ID NO: 17129 - protein, 291 aa, Shewanella oneidensis MR-1
MAKVAFIGLGVMGYPMARHLLNKGHEVTVYNRTFAKAQTWVDTYGGRCCPTPKEAAIGQDIVFTCVGNDNDLREVVLGDDGVIHGMALGTVLVDHTTASADVARELHKVLGEKGIDFLDAPVSGGQAGAENGVLTVMVGGEQAVFERVKPVIEAFARCAERLGEVGAGQLTKMVNQICIAGVVQGLAEALQFARKAGLDGEKVVEVISKGAAQSWQMENRYKTMWAQNYDFGFAVDWMRKDLGIALEEARRNGSHLPLTALVDQFYSEVQAMGGNRWDTSSLLARFEKNTK

SEQ ID NO: 17130 - protein, 322 aa, Shewanella oneidensis MR-1
MSKIFEDNSYTIGNTPLVRLNRVSQGKVLAKVESRNPSFSVKCRIGANMIWDAEKKGLLTKDHELIEPTSGNTGIALAYVAAARGYKLTLTMPNTMSLERRKLLKALGANLVLTEGAKGMKGAIDKAEEIRQSAPEKYILLQQFNNPANPEIHEKTTGPEIWNDTDGAVDVFVAGVGTGGTITGVSRYLKKVAGKAITSVAVEPADSPVITQTLAGLPVQPGPHKIQGIGAGFIPGNLDIELIDRVETVTNDEAIEMARRLMQEEGILVGISSGAAVVAANRIAALPEFADKTIVVVLPSAAERYLSSVLFQGQFGDEENIQ

SEQ ID NO: 17131 - protein, 278 aa, Shewanella oneidensis MR-1
MNSISNQTIPHQASRYQAAFSRLKAEGRGAFVPFVTLGDPSPELSLKIIDTLVQNGADALELGFPFSDPLADGPVIQGANLRALAAGTTPTACFELLAKIRAKYPELPIGLLLYANLVFANGIDAFYAKAQQAGVDSVLIADVPVEEAAPFIQAAKAHGIAPIFIAPPNADSDTLAKVSQSGEGYTYLLSRAGVTGADTKAGTPVEEILAKLQEFNAPPPLLGFGIAEPAQVSAAIKAGAAGAISGSAVVKIIETHQQDEVKLLAALGEFTRTMKAAT

SEQ ID NO: 17132 - protein, 376 aa, Shewanella oneidensis MR-1
MKIVVDENMPYVEPLFGDLGEIIPVNGRTLTPEQVQDADVLLVRSVTRVNAALLEANQKLKFVGSATIGTDHVDLAYLATRGIVFSNAPGCNATAVGEFAFIAMLELAARFNSPLRGKVVGIVGAGNTGSATAKCLEAFGIKVLLNDPIKEAEGDPRDFVSLETLLQEADIISLHVPITRTGEHKTLHLFDEARLMSLKANIWLINCCRGDVIDNQALIKVKQQRDDLKLVLDVWEGEPNPMPELVPFAEFATPHIAGYSLEGKARGTFMLYQKLCELLAIPATKGLSDLLPRFNIKAVELEQLPDEKALLQLARFVYDLRDDDAVFRNCFAKENGFDIMRKNHKHRREFSALALAYRGQSEVDWLSNLGFSGVGR

SEQ ID NO: 17133 - protein, 488 aa, Shewanella oneidensis MR-1
MLRLIKEALTFDDVLLVPAHSTVLPNTAILKTRLTNTIELNIPLVSAAMDTVTEARLAIAMAQEGGLGFIHKNMSIEKQAEEVRKVKIYEAGVVQQPVTVTPSTTLADLKVLTAKNGFAGYPVVNDANELIGIITGRDVRFVTDWSKTVEEVMTPKARLVTVAEGTKLDEVQKLMHSHRIEKVLVVDDNFKLKGLITVKDFEKAERKPNACKDELGRLRVGAAVGAGAGNEERVDALVKAGVDVLLIDSSHGHSEGVLQRIRETRAKHPDLQIIGGNVATAEGALALVEAGVNAVKVGIGPGSICTTRIVTGVGVPQITAVSDAAEAVKGLGIPVIADGGVRFSGDLAKALAAGASCIMAGSMFAGTDEAPGETELYQGRAYKSYRGMGSLGAMSQGSSDRYFQSDNAADKLVPEGIEGRVPYKGKLKEIIHQHMGGLRSCMGLTGCATIQELNEKAQFVKVTSAGMGESHVHDVTITKEAPNYRSGS

SEQ ID NO: 17134 - protein, 177 aa, Shewanella oneidensis MR-1
MMKFPLFILTSLMSTSVFAATCPSYLDVEVRKLHSEQSVNLCELTQGKPVLLINTASNCGYTSQFKALEALHKEYKDKGLVVIGFPSDDFFQEENDEKDTAKVCYINYGVTFTMLATSPVRGSDVNSVFKYLGDKAGAPKWNFYKYVVSGDGNTVMQFNSKVKPDSTELKQAIESVL

SEQ ID NO: 17135 - protein, 304 aa, Shewanella oneidensis MR-1
MPETALLEEVVDRVRPLLGQGKVANYIPALANIDPGKLGIAVTTIDGETIGAGDYLEPFSIQSISKVFSLTLALTLYEETEIWSRVGKEPSGHSFNSLVQVELERGKPRNPFINAGALVIADLLQSRLGAPKHRMLELVRALSQNDKVCFDKQVADSEYQHSARNAAIAYLMKSFGNFQGDVDTVLRTYFHYCALKMNCADLSKAMLYLANRGKTLDGTELISQVQTRQLNALLATSGLYDGAGEFAYRVGMPGKSGVGGGIIAVIPGELSVCVWSPELDTQGNSLAGTAMLEQLSQRLGRSIF

SEQ ID NO: 17136 - protein, 355 aa, Shewanella oneidensis MR-1
MTIENTVNSVENLFDTYKLNDTITLKNRILMAPLTRCMADANLVPTDDMVAYYARRAEAGLIISEATIIRPDAQGYPNTPGIFTQAQIAGWRKVTDAVHANGGKIFVQLWHTGRVAHPHFFGGGDVLAPSAQKIEGSVPRMRELTYVTPKAVTVEDIQGLVRDYAKAAENAIEAGFDGVEIHGANGYLIDQFLHHDSNRRTDEYGGTPVNMSRFALEVVDAIIARIGHDRTGLRISPGAYFNMASDSRDRVVFDYLLPELEKRDLAFVHIGIFDDSIEFDYLGGTASSYVRAHYGKTLVGVGSYSAETASKAIAEDKFDLIAIGRPFIANPDYVAKVRNSEELVAYSDEMLASLI

SEQ ID NO: 17137 - protein, 398 aa, Shewanella oneidensis MR-1
MAAAPSGASTGSREALELRDGDKSRYLGKGVLTAVANVNGPIRTALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLAGEGKVFDSNGFSDFLKSLTEQYPIVSIEDGLDESDWDGWAYQTQIMGDKIQLVGDDLFVTNTKILTRGIENGIANSILIKFNQIGSLTETLAAIRMAKAAGYTAVISHRSGETEDATIADLAVGTAAGQIKTGSLCRSDRVAKYNQLLRIEEQLGEKAPYRGLKEIKGQA

SEQ ID NO: 17138 - protein, 498 aa, Shewanella oneidensis MR-1
MSTPKTRSDWENLAVSLAINGKAFINGEYRDASSGNTFDCISPIDGRLLAPVASCDLMDANIAVANAREVFDSGVWSKAAPVKRKQVMIRFAELLEENANELALLETLDMGKPIRFSKAVDVAGAARAIRWSGEAIDKLYDELAPTAHNEIGMITREPVGVVAAIVPWNFPLLMACWKLGPALVTGNSVILKPSEKSPLTAIRIAELAVQAGIPKGVLNVLPGYGHTVGKALALHMDVDTLVFTGSTKIAKQLMIYAGESNMKRVWLEAGGKSPNIVFNDAPDLKAAAVAAAEAIGFNQGEVCTAGSRLLVESGVKDELVGLIAEELASWQPGHPLEPTTVSGAVVDKQQLDTILSYIKAGQNEGASLVYGGQQVLAETGGVYVQPTVFSNVKNQMKIASEEIFGPVLSVIEFNGMEEAIAIANDTIYGLAAGVWTADISKAHKTAKALRSGMVWINHYDGGDMTAPFGGYKQSGNGRDKSLHSFDKYTEIKATWIVL

SEQ ID NO: 17139 - protein, 446 aa, Shewanella oneidensis MR-1
MADSPNNLAHEHPSLEHYWMPFTANRQFKASPRLLAQAEGMYYTDINGNKVLDSTAGLWCCNAGHGRREISEAVSKQIRQMDYAPSFQMGHPIAFELAERLTELSPEGLNKVFFTNSGSESVDTALKMALCYHRANGQASRTRFIGREMGYHGVGFGGISVGGLSNNRKAFSGQLLQGVDHLPHTLDIQHAAFSRGLPSLGAEKAEVLEQLVTLHGAENIAAVIVEPMSGSAGVILPPQGYLKRLREITKKHGILLIFDEVITAFGRVGAAFASQRWGVIPDIITTAKAINNGAIPMGAVFVQDYIHDTCMQGPTELIEFFHGYTYSGHPVAAAAALATLSIYQNEQLFERSFELERYFEEAVHSLKGLPNVIDIRNTGLVAGFQLAPNSQGVGKRGYSVFEHCFHQGTLVRATGDIIAMSPPLIVEKHQIDQMVNSLSDAIHAVG

SEQ ID NO: 17140 - protein, 288 aa, Shewanella oneidensis MR-1
MTIEACIGQTPLVRLQRLDCGSSTVLLKLEGNNPAGSVKDRAALNMINQAELRQEIAPGDTLIEATSGNTGIALAMAAAIKGYKMILIMPSNSTQERKDAMQAYGAELLLVDNMEAARDLALALQAEGKGKVLDQFNNQDNANAHFLTTGPEIWQQSQGKITHFVSSMGTTGTIMGVSKYLKSRNPDITIVGLQPADGSSIPGIRRWPQEYLPGIFDAARVDLMMDIEEQDAKAMARALAREEGICAGVSSGGAVYAALELARQYPGSVVVAIVCDRGDRYLSSGLFS

SEQ ID NO: 17141 - protein, 376 aa, Shewanella oneidensis MR-1
MSIRLTNISKKFGQFQALSPLNLDIQEGEMIGLLGPSGSGKTTLLRIIAGLEGADSGHIHFGNRDVTQVHVRDRRVGFVFQNYALFRHMTVADNVAFGLEVIPKKQRPSAAEIQKRVSHLLEMVQLGHLAQRYPEQLSGGQKQRIALARALATQPEVLLLDEPFGALDAKVRKELRRWLRSLHDELKFTSVFVTHDQDEALELSDRVVVMSNGNIEQVNTPIELYAQPNSRFVFDFLGNVNRFEANWQQNRWTNGDAFIVPPEQTPLQQNGALYVRSHELALADKPNSQAHIPFTIVAITPIGAEVRVELAPIGWQSEELWEAKFTHHHLQELGLQKGSVVYATPRTGYFFGKQGDGSPIRQSWPFLPPGSLAFDI

SEQ ID NO: 17142 - protein, 318 aa, Shewanella oneidensis MR-1
MKIVVLDGETLNPGDLSWQAISDLGKFSCFARTPDAEIIPRAQDAEIVFTNKTPLDAKTLAQLPKLKYVGVLATGTNVVDIAAAKDLGIVVTNVPAYGHDAVAQMVFAHILHHTQAVAAHHQAVAAGQWTSCSDFCFTLMPLQSLKGKTLGLIGYGDIGQQVAKLALAFGMKVLVNTRTEPAHLPQGVSWTSRDKVLKESDILSLHCPLTPETNELINAQTLELMKPQALLINTARGGLIDEAALAVALTQGRVFAGVDVLSTEPPSMDNPLLSAPNISTSPHNAWATKEARQNLLNIATENLKSFLQGNIRNCVNSK

SEQ ID NO: 17143 - protein, 474 aa, Shewanella oneidensis MR-1
MNMATDPTQISPLTELLQRQRASYLAAPNPDYAIRKERLTRLKTALLNYQQPLVEALSQDYGHRSTDDSLISDIMPVVNNINYSLKNLKKWLKPSRRHAGILLAPAQVKVHYQPLGVIGIIVPWNFPVMLSIGPLVTAIAAGNHAMLKLSEFTPATNKVIKQLLTEVFDESHVAIVEGEADVAAQFSALPFDHLLFTGSTTVGRHVMRAAANNLTPVTLELGGKSPVIIAPDMPLEIAVERMIYGKCLNAGQICVAPDYVLCPNAKVNDFIQAYQAKFLAMYGEVAKNKDYGSIINARQFDRLMAVLEDAKTKGAKIISASNEAIDSLNRKIPTQLITHTTEDMQLMQEEIFGPLLPIIGYDTLDEAIRYINLRARPLALYVMSFDEANQQKILQQTHSGGVCINETVFHVAADDAPFGGIGPSGMGHYHGKEGFLTFSHAKTVLSRGRFNTGKFVHPPYGTFIQRMLMKLFLR

SEQ ID NO: 17144 - protein, 1059 aa, Shewanella oneidensis MR-1
MFKASEVLAGRYDSANLDELFKAVTDNYIVDEEQYLSELIKLVPSSDEAIERVTRRAHELVNKVRQFEKKGLMVGIDAFLQQYSLETQEGIILMCLAEALLRIPDAATADALIEDKLSGAKWDEHLSKSDSVLVNASTWGLMLTGKIVSLDKKIDGSSSNLLGRLVNRLGEPVIRQAMMAAMKIMGKQFVLGRTMKEALKNSEDKRKLGYTHSYDMLGEAALTRKDAEKYFTDYANAITELGAQSYNESESPRPTISIKLSALHPRYEVANEDRVLTELYDTVIRLIKLARGLNIGISIDAEEVDRLELSLKLFQKLFNSEATKGWGLLGIVVQAYSKRALPVLVWLTRLAKEQGDEIPVRLVKGAYWDSELKWAQQAGEAAYPLYTRKAGTDVSYLACARYLLSDATRGAIYPQFASHNAQTVAAISDMAGDRNHEFQRLHGMGQELYDTILSEAGAKAVRIYAPIGAHKDLLPYLVRRLLENGANTSFVHKLVDPKTPIESLVVHPLKTLTSYKTLANNKIVLPIDIFGSDRKNSKGLNMNIISEAEPFFAALDKFKSTQWQAGPLVNGQPLTGEHKTIVSPFDTTQTVGQVAFADKAAIEQAVSSAHAAFGSWTRTPVEVRASALQKLADLLEENREELIALCTREAGKSIQDGIDEVREAVDFCRYYAVQAKKLMSKPELLPGPTGELNELFLQGRGVFVCISPWNFPLAIFLGQVSAALAAGNTVVAKPAEQTSIIGYRAVQLAHQAGIPTDVLQYLPGTGATVGNALTADERIGGVCFTGSTGTAKLINRTLANREGAIIPLIAETGGQNAMVVDSTSQPEQVVNDVVSSSFTSAGQRCSALRVLFLQEDIADRVIDVLQGAMDELVIGNPSSIKTDVGPVIDATAKANLDAHIDHIKQVGKLIKQMSLPAGTENGHFVAPTAVEIDSIKVLEKEHFGPILHVIRYKASELAHVIDEINSTGFGLTLGIHSRNEGHALEVADKVNVGNVYINRNQIGAVVGVQPFGGQGLSGTGPKAGGPHYLTRFVTEKTRTNNITAIGGNATLLSLGDSDA

SEQ ID NO: 17145 - protein, 176 aa, Shewanella oneidensis MR-1
MKHTTEVMISAEEISKKLDQMAEQINAHYANSERLLMVGLLKGSVVFMADLCRRIKGHVEIDFMSVSSYGNAMTSSRDVKVLKDVQSDIADRDVLIVEDLIDSGNTLNKVREMLLLREPKSLALCTLLDKPERREVDVKVDFIGFTIPDEFIVGYGIDYAEQYRNLPYIAKVVPLE

SEQ ID NO: 17146 - protein, 272 aa, Shewanella oneidensis MR-1
MTQEQTPLVEIRHLGFRRGQRVIYEDISLSIPRGKVTAIMGPSGIGKTTLLKLIGGQLTPDSGQVLFDGQDVHAASRNELFELRKRMSMLFQSGALFTDINVFDNVAFALREHSGLPEEIIRTIVLMKLEAVGLRGAAQLMPSELSGGMQRRAALARAIALEPEMVMYDEPFAGQDPISMGVLVKLIRELSDALNLTSVVVSHDVDEVLGIADYVYVVADKKVIAHGTPEELKHADNPQLKQFIEGAPDGPVPFHYPAKDYQQELLAKGVGK

SEQ ID NO: 17147 - protein, 378 aa, Shewanella oneidensis MR-1
MSVFTAYESGALTLQNRIVMAPMTRARTTQPGNIPNDLMVQYYAQRSSAGLIITEATQISNDSQGYSFTPGVYTEAQIDGWKKVTAAVHEAGGKIFNQIWHVGRVSHPIFQQGNAPIAPSAIAPVGTKVWIVDEAHPEGQMVDCPEPREMTQADIDRVVADFAKAGANAIAAGFDGIEIHGGNGYLIDQFLRTNSNHRTDAYGGSPEKRIRFLLEVVEAVSAQIGADKVGVRLAPYVTFKDMACPEIVETILLAAKQLSAFGVAYLHLSEADWDDAPQIPESFRIELRNVFKGSIIVAGRYDVERANDVIEKGYADLVAFGRAFIANPDLPYRLANQLPLSPFDKGPLFGGSAAGYTDYPSYQAALRAVIRSSDDEVA

SEQ ID NO: 17148 - protein, 161 aa, Shewanella oneidensis MR-1
MEYNTSELCDMYLDVVDVVEPMFSNYGGCSSFGGSISTIKCFEDNGLITDVLQEDGQGKVLLVDGGGSLRRALIDGTIAELAVSNNWEGIIVYGSVRDVDALEELDIGIQALASIPVGADGNSVGEVDIPVNFGGVTFLPGDHIYADNTGIILSPEPLDIE

SEQ ID NO: 17149 - protein, 506 aa, Shewanella oneidensis MR-1
MIYAQPGTAGALVNFKEKYANFIGGKWVAPVNGKYFDNRSPVNGQNFCKIPRSDAQDIELALDAAHAAKDAWGKTSVTERSNILLRIADRVEQNLEYLAVAETWENGKAVRETLNADLPLFVDHFRYFAGCIRAQEGSAADIDGNTVSYHFPEPLGVVGQIIPWNFPLLMAAWKIAPALAAGNCVVLKPAEQTPVSILVLLELIEDLLPPGVLNVVNGFGAEAGQALATSKRIAKLAFTGSTEVGFHILKCAAESLIPSTVELGGKSPNLYFADVMDQEDEYLDKAVEGMLLAFFNQGEVCTCPSRVLIQESIYDRFIEKVLARAQTIKQGNPLDTATQVGAQASQEQFDKILSYLAIGKDEGAQVLLGGSLCQLEGEQSKGYYISPTIMKGHNKMRIFQEEIFGPVISVTTFKDEAEALAIANDTEYGLGAGVWTRDMNRAQRMGRGIQAGRVWINCYHAYPAHAAFGGYKKSGIGRETHKMMLNHYQNTKNLLVSYDINPLGFF

SEQ ID NO: 17150 - protein, 308 aa, Shewanella oneidensis MR-1
MVNVNRLFPLFALLGAVTAYLMPAWFVVFKNSIVPLLVVIMLSMGLTLDLQDFANAFKQKRAVITGLILQFTLMPLSALAISLLLGLDRELTIGMVLVGSVAGGTASNVICYLAKGDVALSITMTALSTLAGVVLTPLIIQLLIGEMVAIPLMDMLLSLVKIVLIPVTVGVVLNHFFKPQVAKLSPALPLISIVAIVMAISIIVALNAGQFAQVGPVILLAVFLHNGLGLTLGYLCCRLLGFSHTVCKTISIEVGLQNSGLATALCIKFFSPISAIPSAIFSIWHNLSGAMLAGYWASRVQKQTEALE

SEQ ID NO: 17151 - protein, 464 aa, Shewanella oneidensis MR-1
MRISPLHSAALTFPEQTAVKCNGQDISYASLSQMVLGLGEQLTRIGIRQGQPLACISRNNLEMICLYWACIDIGAIFFPISPRFPLAQVQGLIDSHQIPCYWSETELGLTGCTQLSLDVAQISTTPAKTVDIQRPCNVILTSGSSGFPKAAVHNLANHIANAEGARSLIPLIKGDAWLLSLPLFHIGGLAILNRCALVAAIVVLPESNLALQEQVERDALTHISLVPTQLLNLLADKQASLTSIKALLLGGGAVSIDLLKQLEQRHIASFTSYGMTEMGSQITTGPALSDGTSGKLLPRRELKIVDDVIWVRGECLFMGYLTENGIEKPLDADSWFYTKDKGEWDANGNLKILGRVDNMFICGGENIQPEEIEAALKLHPLIDEAIVFPQPDITYGQLPAAIIRGNIIRGNTSQDMSTIEKQLEQFLADKIARFKRPRRYYPWPENAEQIGLKVNRQLIIKLAI

SEQ ID NO: 17152 - protein, 354 aa, Shewanella oneidensis MR-1
MSIHIQQVNKHFGNFVAVDSVNLEIKTGELTALLGPSGSGKTTLLRIIAGLEQADSGIVKFNGEDITTQHVSERGVGFVFQHYALFKHMTVFENVAYGLTVRPRKTRPSKAEIAEKVHSLLKLVQLDWTADRYPSQLSGGQRQRIALARALAVEPKVLLLDEPFGALDAKVRAELRRWLRRLHDEINVTTVFVTHDQEEALEVADKIVVMNKGRIEQQGTPEEVYDTPSNPFVYEFLGNVNLFHARVKHGHSTIGNIHIPSPEHAGGEEQQGLAYVRPHEIEVLTQPTENAIKVNLDLVTIVGPVARLEVLTEIDEQLIHVELSKVQFKQLGISKGDNAWIQPRYSKVFLGEGI

SEQ ID NO: 17153 - protein, 341 aa, Shewanella oneidensis MR-1
MKALSKLKAEKGIWLVDAPKPEMGHNDLLIKIKKTAICGTDMHIYNWDEWSQKTIPVPMVVGHEYVGEVVDIGQEVRGFNIGDRVSGEGHITCGHCRNCRAGRTHLCRNTSGVGVNREGSFAEYLVIPAFNAFKIPDDISDDLASIFDPFGNAVHTALSFDLVGEDVLITGAGPIGIMAAAVCRHVGARHVVITDVNEYRLELARKMGATRAVNVAQENLKDVMKELGMTEGFDVGLEMSGVPSAFRAMLDTMNHGGKIAMLGIPGGEMAIDWSKVIFKGLVIKGIYGREMFETWYKMASLIQSGLDISPIITHHYKIDDFQKGFDAMGSGQSGKVILSWD

SEQ ID NO: 17154 - protein, 451 aa, Shewanella oneidensis MR-1
MAQHFDYICLGAGSGGIASANRAAMRGAKVLLIEAKHVGGTCVNVGCVPKKVMWYGAHIAEAMNLYAKDYGFDVSVNKFDWNTLVNSREAYIGRIHEAYGRGFTNNKVTLLNGYGRFVNGNTIEVNGEHYTADHILIATGGAPTIPNIPGAEYGIDSDGFFALREQPKRVAVVGAGYIAVEVAGVLHALGSETHLFVRKHAPLRNFDPMLIDALVDAMKTEGPTLHTNSVPQSVVKNADDSLTLNLENGESVTVDCLIWAIGRSPATGNIGLENTEVQLDSKGYVITDAQQNTTHKGIYCVGDIMAGGVELTPVAVKAGRLLSERLFNAMSDAKMDYSQIPTVVFSHPPIGTMGLTEPEARAQYGDGNVKVYTSSFTSMYTAVTSHRQACKMKLVCAGKEDKVVGIHGIGFGMDEILQGFGVAMKMGATKADFDAVVAIHPTGAEEFVTMR

SEQ ID NO: 17155 - protein, 376 aa, Shewanella oneidensis MR-1
MTAQILKSKAAVAWAVGEPLSIEIVDVMPPQKGEVRVKMIATGVCHTDAFTLSGDDPEGIFPCILGHEGGGIVESIGEGVTSVQVGDHVIPLYTPECGECKFCKSGKTNLCQKIRETQGKGLMPDGTSRFSKDGQIIYHYMGTSTFSEYTVLPEISLAKVNPDAPLEEVCLLGCGVTTGMGAVMNTAKVEEGATVAIFGMGGIGLSAVIGATMAKASRIIVIDINESKFELAGKLGATDFINPKDYDKPIQDVIVELTDGGVDYSFECIGNVNVMRSALECCHKGWGESVVIGVAGAGQEISTRPFQLVTGRVWKGSAFGGVKGRSELPEYVERYLAGEFKLSDFITHTMSLEQVNDAFDLMHQGKSIRTVIHFDK

SEQ ID NO: 17156 - protein, 180 aa, Streptococcus mutans UA159
MLEQNIKKVLYSEEEIIVKTKELGAQLTKDYAGKNPLLVGVLKGSVPFMAELMKHIDTHIEIDFMVVSSYHGGTTSSGEVKILKDVDTNIENRDVIFIEDIIDTGRTLKYLRDMFKYRQANSVRIATLFDKPEGRVVDIDADYVCYKVPNEFIVGFGLDYAENYRNLPYVGVLKEDVYSK

SEQ ID NO: 17157 - protein, 449 aa, Streptococcus mutans UA159
MLENSITYEKPLYIIKMNQRKKIVQIALPAMAENLLQMLMGVVDNYLVAQIGLVAVSGVSVANNIITIYQAIFIALGAAVSSLVAKSLGEDNQARVRFYQSESVAITLMLSVVLGFISFVFGSNMLHLLGTTDSVTQAGGIYLAIVGGLVVSLGLQTTLGAILRAQGKARLPMYVSFLTNIVNVILATTAIYIGHWGIVGVAAATVLSRFLGTFVLACQLPIKAILRSMRIKIDKAFLAIALPSAGERLMMRAGDVVIIAIIVKFGTAAVAGNAIGETLTQFNYMPGMGVATATVILVAHNLGQGKKKVIKEVVRESYIISTVFMLLVGACIFFGGRQLTYLFTENKAALQASLVVLFYSFIGGPATSGTLVFTAVWQGLGKAKLTFYATTVGMWLIRIVLGYYLGVSLNLGLAGVWLATLADNVFRWLFLYCLYRKYMQGFNNNLSSS

SEQ ID NO: 17158 - protein, 377 aa, Streptococcus mutans UA159
MNNQEYYDRLGVSKDASQDEIKKAYRRMSKKYHPDINKEPGAEEKYKEIQEAYDTLGDEQKRAAYDQYGPAGANGGFGDGSGFSGFDSSGFGGFEDIFSSFFGGGASRNPNAPRQGDDLQYRVNLQFEEAVFGTEKEVHYNREASCHTCNGSGAKPGTSPVTCSKCHGSGVINMDTQTPLGMMRRQVTCDVCHGTGQEIKEPCPTCHGTGHEKQSHKVSVKIPAGVETGQQIRLAGQGEAGFNGGPYGDLFVIINVLKSDKFERDGSTIYYSMDINFVQAALGDTVEVPTVHGNVELAIPAGTQTGKTFRLKGKGAPRLRGNGQGDQHVTVNVVTPTKLNDAQKEALQDFAKASGINPVHPKKKGFFNKVKDAFDEM

SEQ ID NO: 17159 - protein, 372 aa, Streptococcus mutans UA159
MNTIKTRAAVAWAPNEPLKIEELDLMMPQKGEVMVHITATGVCHTDAYTLSGKDAEGVFPCVLGHEGAGIVEAVGEGVTEFQVGDHVIPLYTAECGKCEFCLSGKTNLCSAVRETQGRGVMPDGTVRFFKDGQPIYHYMGTSTFAEHTVVSEYSLVKIQDNAPLEEVCLLGCGVTTGMGAVLNTAKVEEGATVAIFGLGGIGLAAIIGARMAKASRIIAIDINPDKFDKARKLGATDLVNPNNHAKPIQEVIIDITNGGVDYSFECIGNVEVMRAALECCHKGWGESTIIGVAPAGAEIHTRPFQLVTGRVWRGSAFGGVKGKTQLPGIVGQYMAGEFALSDFITHTMPLEQINDAFDLMHEGKSIRTVIHY

SEQ ID NO: 17160 - protein, 442 aa, Streptococcus mutans UA159
MTDLTKGSELKTILYFSIPILLGNLCEQLYNVTDTAIVGNLVGTKGLAAVGASTQVVTLTVALSTGVSIGASVLISQLYGAKHFQKMKSVLDTNLMFTSILAFVLTLFGIYYANPFLKQLNVPQPLLPEADGYLKIILLGLVPLFAYNTLANCLRGIGDSKTPTFILISSICLNASLDIIFIAVFHQGSAGAAMATVFAQLFSFLICLIYMKKKYPQLSPDLFHLKWQLKTLQKSLAIGLPAMMQQVFISFGFLVIQFLVNSFGTSAIAAYTAASKVDSFAEMPAVNLGQALMNFTAQNEGAGKGKRITKGGNHTLLFSIGLSVSISVIIYIFAPVLISIFNRDATVVQIGQQYLHIVSVFYPIFGAMQVLNGILLGYGKSLLPLIASITTFCILQVPLAVLLSHTSLGFNGIWMAAPFGWTAGFLMRLIYFRYLLKRKNQG

SEQ ID NO: 17161 - protein, 431 aa, Streptococcus mutans UA159
MTLACNLAAAGKKTALIEARDWGGTTVNRGSTPKKALLALAELHHHQESFLHRGLETVSHVKWEDALLTRDWLVSDESARAKERAIKAGVETYEAYAFFEDAHHLKVNGQVLSTATIVLATGSVPRKIDIEGASYIDSSANLMRLHQQPKVIALIGAGVIAMSLISSFTELGTKVHVIQHNDRVLGNFDSELVDILVNRLKSRGAEFHMEAEAERVERSTSGYQVTLTNGEIVIVDGIYDVAGRIANIGGLQLEKAGIEYTERGISVDDHLTTSQPHIFAMGDCCDAPVPKLNSYADFQAKYLSQLLNDESKEAIQYPIAPAATVYSIPKIGQVGVSVNQARQHPQDYDVTQLNMSNWQNYKRVHDDLAVIKLVVSKSDQHVAGAEIVSDTADILVNYLAILLNRRVSFQELQDIIFAYPSLATDLYGLWK

SEQ ID NO: 17162 - protein, 139 aa, Streptococcus mutans UA159
MTRSVDVNLINGIALAFEGDAIYSTYIRKHLIFQGLTKPNQLHHKTTRYVSAKAQAMLITKMLEAQLLSEKEEDIYRRGRNANSHTKAKNTDVVTYKMSTGFEAVMGYLHMTEQIKRLEELIDWCIQTVENEYSELNKG

SEQ ID NO: 17163 - protein, 246 aa, Streptococcus mutans UA159
MTDIILEIDHLKKSFGKNEVLKDISLTVKKGEVISIIGSSGSGKSTFLRSINLLEKPTGGKILYRGQNVLEKNYDLTKYRENLGMVFQSFNLFNNLNVLENAIVAQTTVLKRNRTEAEKIAKDNLNKVGMTEQYWKAKPSQLSGGQKQRVAIARALSVNPEAILFDEPTSALDPEMVGEVLKTIKDLAKSGLTMLVVTHEMDFARDVSDRVIFMDQGVIAESGKPEQIFENPQEERTKVFLQRFLK

SEQ ID NO: 17164 - protein, 449 aa, Streptococcus mutans UA159
MTHIKFDYSKVLGKFLASHELDYIQMQVTAADEALRKGTGPGAEMTGWLNLPQNYDKEEFARIKKAAEKIKSDSEVLVVIGIGGSYLGARAAIDFLNSSFVNLENKEERKAPQILYAGNSISSNYLADLVDYVADKDFSVNVISKSGTTTEPAIAFRVFKDLLVKKYGQEEANQRIYATTDRVKGAVKVEADANGWETFVVPDSVGGRFTVLTAVGLLPIAASGADLDQLMAGAEAARQDYSSAELSENEAYQYAAIRNILYRKGYVTEVLANYEPSLQYFSEWWKQLAGESEGKDQKGIYPTSANFSTDLHSLGQFIQEGNRNLFETVIRVEKARKNILVPEAAEDLDGLAYLQGKDVDFVNKKATDGVLLAHTDGGVPNTFLTIPEQDEFTLGYVIYFFELAIGLSGYLNGVNPFDQPGVEAYKKNMFALLGKPGFEELGAELNARL

SEQ ID NO: 17165 - protein, 466 aa, Streptococcus mutans UA159
MADCWNSNERRITIAKKKTTFVCQECGYNSPKYLGRCPNCSSWSSFVEEVEVAEVKNARVSLTGEKTRPVKLNQVTSSQATRVKTNMEEFNRVLGGGVVPGSLVLIGGDPGIGKSTLLLQVSTQLANKGTVFYVSGEESAEQIKLRSERLGDIDNEFYLYAETNMQSIRAEIEKIQPDFLIIDSIQTVMSPEISSVQGSVSQVREVTAELMQLAKTNNIATFIVGHVTKEGTLAGPRMLEHMVDTVLYFEGERQHTFRILRAVKNRFGSTNEIGIFEMRSGGLVEVLNPSQVFLEERLDGATGSAIVVTMEGTRPILAEVQALVTPTVFGNAKRTTTGLDFNRVSLIMAVLEKRCGLLLQNQDAYLKSAGGVRLDEPAIDLAVAVAIASSYKEKPTTPQECYIGEIGLTGEIRRVNRIEQRLNEASKLGFTKIFVPKNSLSGLTIPQGIQVIGVTTVSEVLKKVFN

SEQ ID NO: 17166 - protein, 219 aa, Streptococcus mutans UA159
MLLNQIAPSILAADYANFESELKRIEETGVKYVHIDIMDGQFVPSISFGAGVVASMRKHSKLVFDCHLMVVNPERYVDDFSQAGADIMTVHVEATHHIHGALQKIKDAGMKAGIVINPGTPVADLESVLSLADQILIMTVNPGFGGQAFIPEMLEKVRTVAKLREEKGLSFDIEVDGGIDNETIKLAKQAGANIFVAGSYLFKENLAAQVETLKAALND

SEQ ID NO: 17167 - protein, 398 aa, Streptococcus mutans UA159
MAKLTVKDVDLKGKKVLVRVDFNVPVKDGVITNDNRITAALPTIKYIIEHGGRAVLFSHLGRVKEEADKKGKSLAPVAADLAKKLVQEVVFPGVTRGEQLEAAINALKNGEVLLVENTRFEDVDGKKESKNDPELGKYWASLGDGIFVNDAFGTAHRAHASNVGISANVDKAVAGFLLENEIAYIQEAVDNPVRPFIAILGGSKVSDKIGVIENLLKKADKVLIGGGMTYTFLKAQGIEIGDSLVEEDKLDIAKDLLAKANGKLILPVDSKEANAFADYTEVKDTEGAAVDPGFLGLDIGPKSIAKFDDELTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 17168 - protein, 448 aa, Streptococcus mutans UA159
MAITAADIRREVKEKNVTFLRLMFTDILGTMKNVEIPATDEQLDKVLSNKAMFDGSSIEGFVRINESDMYLYPDLNTWTVFPWGDENGAVAGLICDIYTAEGEPFAGDPRGNLKKALRHMESLGYKSFNLGPEPEFFLFKMDEFGNPTTEVNDKGGYFDLAPTDLADNTRREIVNVLTKMGFEVEASHHEVAIGQHEIDFKYADVLTACDKIQLFKLVVKTIARKHGLYATFMAKPKFGINGSGMHCNMSLFGSDGKNAFFDPQDPKGMQLSEVAYQFLGGLVKHAYSYTAIMNPTVNSYKRLVPGYEAPVYIAWAGRNRSPLIRVPASRGVSTRLELRSVDPTANPYLALAVLLESGLDGIENKIEAPAPVESNIYVMTVEERKEAGIADLPSTLHNALKALQEDEVVKAALGNHIYTSFLEAKRIEWSSYAAFVSQWEVDNYLDLY

SEQ ID NO: 17169 - protein, 478 aa, Streptococcus mutans UA159
MADPFGFLKYERKDNPYRPVNERIKDFEELQTTLSVEERQKQAARCMNCGIPFCHEGTFYGGGRAVSGCPNDNLIPEWNDLIYKGDFRRAFERLTRTNPLPEMTGRVCPAPCEKACTEGLNGSGVTIHDNERFIIDNAFEEGWVADSGRPIERTGFKVAVVGSGPAGLSAAWRLNQLGHSVTVFERSDRFGGLLMYGIPNMKLDKKIVQRRIDTMASIGINFVANTEIGRDITAEELLEKFDRVILATGASVPRDLDIPGRDLKGIRFAVDFLTETTKNLLDSDTHELPPLLEGKHVLVIGGGDTGNDCIGTAVRLGAASVRQLEITPQLPEKRLPTNPWPQYPMINRTGYGQEEADFVQQTDLTDYITSTVEFLGENGQVTAVKTIKVGPGFKAIEGTEEVIKADLVLLAMGFTGAEKALFDQFRVECVYDDYSTRNEKVFVAGDARRGPSLVIWGIREGRKTAEKIDQNLRMMVTE

SEQ ID NO: 17170 - protein, 284 aa, Streptococcus mutans UA159
MVYDIIKASLQGRINWLDTAEYYGHGNSEKFIGSILKLLAKEGSLTETIYIADKWFPLLRSAKTIAQTFSGRLSNLQRPFIDLYQIHHPTSISSLKKQAEELANLQEKGLIKAIGVSNFSAHQMVKMDELLKSFGLRLDSNQVKYNLLHRKPERNGVLDVAKERGISLIAYSPLQQGVLTGRFHAESDSIKKISMLRRLNSELSSRSLKKTQPLIELLQKLADKYHKTPAQISLNWLIHAHVSTIFAIPGASSLKQAQSNLEAQNFKLTKTDLQKLSVDSEKLN

SEQ ID NO: 17171 - protein, 348 aa, Streptococcus mutans UA159
MNSPYTRSPRTIKHAFVTGATGLLGNNLVRALLKQGIKVTALVRSMEKARLQFGDLPIQYVKGDILNPEAFRSAFTDCDTLFHTAAFFRDSHKGGKHWQELYDTNVTGTTHLLKAAYEEGIRQMIHTSSIAVLKGERHQLIDETMSRDPSTKLDYYRSKILSENAVSNFLKEYPDLFLCYVLPGSMYGPGDMGPTATGQLILDYMQQKLPGIITKASYSVVDTRDVADIHILALKYGRRNERYLAAGRHMTMESIVKTLEEITGIPAPKRHIPIFLVQALAQWNELYHKITGKPVLVSKEIADITAEEYLRTYFSHKKTEQELGGQFRPFEETLLDTVRWYRNHGYLN

SEQ ID NO: 17172 - protein, 476 aa, Streptococcus mutans UA159
MKKFFKLKENKTTVRTEVLAGITTFFAMSYILFVNPSILSQTGMPSQGVFLATIIGSIAGTLMMGLYANIPYAMAPGMGLNAFFTYTVVFSLGYTWQEALAMVFICGIISIVITLTRVRRMIIDEIPDSLKKAISAGIGIFLTYIGLKNAGLLNFAIDPGTYSVSGKGAAKGLASITANSSATPSLVNFNNPAVLVAVIGIIITAFFIIKNIKGGVILSIIVTTVIALLAGVVDLSKIDFSANNPVAAVKDLGTIFGAALGNKGLGALFSDAGRIPEVLMTILAFALTDIFDNVGTLIGTGAKAGIFDVTSESTSSGLQNKMDKALFSDMVGTTVGAVAGTSNVTTFVESAAGIGAGGRTGLTAVVVALLFAVSSFFSPLLAIVPTQATAAVLLIVGIMMLSSLKDIEWSDMSQAIPAFFATVFMGLAYSITQGIATGFLFYTFSKLIKKEAKDIHPIIWVLDVLFILNFISLAVL

SEQ ID NO: 17173 - protein, 247 aa, Streptococcus mutans UA159
MIRISNLTKEFSGQKVLDGLNLDIEKGEVVALVGASGAGKSTFLRSMNYLEQPDSGSIEIDDFKINFDTISKEEILTLRRKLAMVFQQFNLFERRTALDNVKEGLKIVKKLPDDEATKIAKEELAKVGLSDRENHYPRHLSGGQKQRVALARALAMKPDVLLLDEPTSALDPELVGEVEKSIADAAKSGQTMVLVSHDMSFVRQVADKVLFLEKGHILEQGTPDQLFNHPQEKRTEEFFASYKKTFI

SEQ ID NO: 17174 - protein, 486 aa, Streptococcus mutans UA159
MYKDDSLTLHTDLYQINMMQVYFNQGIHNKRAVFEVFFRKEPFANGYAVFAGLERMIAYLQGLSFSETDIAYLEELGYPADFVAYLKEFKLELSVKSAKEGDLVFANEPIVQIEGPLAQCQLVETAILNIVNFQTLIATKAARIRSVIEDEPLLEFGTRRAQEMDAAIWGTRAAVIGGANATSNVRAGKLFGIPVSGTHAHALVQAYGNDYDAFMAYAGTHKDCVFLVDTYDTLRLGVPAAIRVASELGDKINFLGVRIDSGDMAYLSKKVRKLLDEAGYPHAKIYASNDLDENTILNLKMQKAKIDIWGVGTKLITAYDQPALGAVYKIVSIEDDNGVMQDTIKLSNNAEKVSTPGKKQVWRITSRAKGKSEGDYITFTDTDVNSLDEIDMFHPTYTYINKKVRDFDAVPLLVDIFDQGKLVYTQPSLSDIQDYARREFDKLWDEYKRVLNPQDYPVDLACDVWQNKVNLIDRIRKEAYEKGDVK

SEQ ID NO: 17175 - protein, 308 aa, Streptococcus mutans UA159
MAKIYNNITELIGNTPIVKLNNVVPEDAADVYVKLEAFNPGSSVKDRIALSMIEDAEKRGLIKPGDTIVEPTSGNTGIGLSWVGAAKGYNVIITMPETMSVERRKIIQAYGAKLVLTPGSAGTKGAIDKAHEIAKEVGGWVPLQFDNPANPKIHELTTGPEILEAFGSHGLDAVVAGIGTGGTITGISRALKKDNPDIKIYGLEADESAVLSGDKPGPHKIQGISTGFIPAALDTHSYDEVIRVKSDDALATGRYFGGKEGFLLGISASAAVWAALEVAKKLGKGKKVLAIAPDNGERYLSTALYEFN

SEQ ID NO: 17176 - protein, 260 aa, Streptococcus mutans UA159
MTKTLTKHLQAIKAEGKGLFIPYIMAGDHDKGLDGLFDTISFLEAQGVSAIEIGIPWSDPVADGPVIELAGQRSLVKGTSLASIIARLQEKKTQVPLVIMTYFNPVFQYGVETFVADLQNTSVKGLIIPDLPHEQESFIKPYLENLDLALVPLVSLTTGLERQKELIEDARGFVYAVAINGVTGKTGNYRDDLDKHLKHLTEIAQIPVLTGFGVSTLADIKRFNQVSDGVIVGSKIVKGLHEGMQEEIKDFIYAGSHYQK

SEQ ID NO: 17177 - protein, 244 aa, Streptococcus mutans UA159
MSETLISIKNLHKHFGKNEVLKGIDLDIKQGEVLVIIGPSGSGKSTFLRTMNLLEVPTKGSITFEGVDITDKSNDIFKMREKMGMVFQQFNLFPNMTVLENITLSPIKTKGLSKAEAEEKAYQLLDKVGLRDKAAAYPQSLSGGQQQRIAIARGLAMDPDVLLFDEPTSALDPEMVGEVLSVMQDLAKSGMTMAIVTHEMGFAHEVADRVIFMDDGIIVEEGAPEEVFKNAKEERTRDFLGKVL

SEQ ID NO: 17178 - protein, 277 aa, Streptococcus mutans UA159
MIIDDLLTKKIIKPRPLNSHKGTFGRVLLIGGNYPYGGAIIMAALACVNSGAGLVTVATHKDNITALHSHLPEAMAFDMVEKDRLSEQITAADVVLMGPGLAEDDLAQTTFDVVWQAIEPKQTLIIDGSAINLLAKRKPAIWPTKQIILTPHQKEWERLSGLTIPEQIEAATQTALAHFPKETILVAKSHQTKIYQGQKIGHIQVGGPYQATGGMGDTLAGMIAGFVAQFHTDRFEVAAAAVFLHSYIADQLSKEAYVVLPTRISAEITRVMKEMSE

SEQ ID NO: 17179 - protein, 230 aa, Streptococcus mutans UA159
MVKLVFARHGESEWNKANLFTGWADVDLSEEGTQQAIDAGKLIKEADIKFDLAFTSVLTRAIKTTNLALEYSDQLWVPVEKSWRLNERHYGGLTGKNKAEAAEKFGDEQVHIWRRSYDVLPPAMAKDDPYSAHTDRRYANLDDTVIPDAENLKVTLERALPYWEDKIAPALKDGKNVFVGAHGNSIRALVKHIKQLSDDDIMGVEIPNFPPLVFEFDENLNVTAEYYLGK

SEQ ID NO: 17180 - protein, 316 aa, Streptococcus mutans UA159
MESLTQFSKKLSKWFTLVVVIWAVFNYFLPTTSRWVIPNTSYLLGIILFGMGLTLTTEDFVRISKRPVPVALGTVAHYVIMPSLAWLLCLIFHLKGATAAGVILVGSCPSGTSSSVMAFLSGGDVALDVSIEILSTLLAPVMLPLLLSVLAGQYIAVPALSLFLSTLRIVVVPIILGVLIHTFFGKKIAAVIKLMPLISQVAILLIIGAVVSANHANIFTAATALVIPVVMLHNLCGYSLGYAFAKLLHLEEPQQKAITFEVGMQDSSLGATLAMKYFVPQAAIPSTIFSIWHNISGSILSSWWKNHSQSHLTERK

SEQ ID NO: 17181 - protein, 322 aa, Streptococcus mutans UA159
MKAVYIQKTGGPATIIVGSLPVPKVRPKSVLIKVIAASINYVDLFIRSGIYQTDLPNPYILGRDAIGQVVEIGKDVIQFKVGDCVWTNSMGYDGRQGITSEYALIPEERLFLTPKNADSLKLIGAVHSAATATIVLQDIMELKPKQKLLIEGAAGHVGSKLVYLANEMGAEVVTTASLKDFSRLKQLSDAICFDYRDKSLFKKLKSAYPDGFDHIIDTSGEIPLQFNCDLLAPKGVISLITAPKDSQFDSRQFYMNCQQMKGFVISHASLKQLKKAGRILNDAFRQGQLLEEDMVIKKFDKAAEAHDLMETKKENRKIILVP

SEQ ID NO: 17182 - protein, 379 aa, Streptococcus mutans UA159
MSNLFQNYTRADLEFIKAEGNYLFDTQGKKYLDFSTGIGVTNLGFHPQVQVALQKQAEQIWHTPNLYQNSLQEEVAAKLMAGKDYLAFFCNSGAEANEAAIKIARKATGKQEIITFQNSFHGRTFGSMSATGQDKIKVGFGDAVPHFHYAVFNDLNSVKALVTENTAAVMLELVQGESGVLPAEQDFVTALADYCQKNGLLLIIDEVQTGMGRTGKLYAFQHYGIEPDIFTLAKGLANGVPVGAMLAKKQFGSAFGPGSHGSTFGGNKLAMAASSAVLDIMTKAGFLEQAWENAHYLQEQLTSALQVADTVTQVRGLGYMIGIETTADLGQLVKATRDRGLIVLTAGTNVIRLLPPLTLTKDEIDQGIMILQEVFEQHN

SEQ ID NO: 17183 - protein, 475 aa, Streptococcus mutans UA159
MTKQYKNYVNGEWKLSENEIKIYEPASGAELGSVPAMSTEEVDYVYASAKKAQPAWRSLSYIERAAYLHKVADILMRDKEKIGAVLSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFTGSTGIGERIGKMAGMRPIMLELGGKDSAIVLEDADLELTAKNIIAGAFGYSGQRCTAVKRVLVMESVADELVEKIREKVLALTIGNPEDDADITPLIDTKSADYVEGLINDANDKGAAALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 17184 - protein, 252 aa, Streptococcus mutans UA159
MSRKPIIAGNWKMNKTAAEAREFIDAVKNNIPSNNLVDTVIGSPALFLEGMKKGVKGTELQVAAQNCYWEDFGAFTGETSPAALAALGVDYVIIGHSERRDYFHETDQEINKKAHAIFKHKMTPILCCGESLETYEAGKTAEWIEGQITADLKGLSAEQVSSMVIAYEPIWAIGTGKSADANIADDICGVVRATVEKLYGKEVAQAVRIQYGGSVKPENVAEYMAKENVDGALVGGASLQADSFLALLDFVK

SEQ ID NO: 17185 - protein, 294 aa, Streptococcus mutans UA159
MKGIEIVNYGGPEVAKVRTFSSPVRRSGEVMIQVVASSINPVDIKYMTPETIQKIPSFPAILGWDIAGIIIEADKNSNFSAGERVVAFHPQGSWQQLVTASENQVVKLPDNIDFISGGSIPLAASTALQALRRLRLEPGERLLVTGAAGSVGYYALQFALKMGVKASGLVRNKNQKMSINLLDTEIYTNDDPIPEFDAVFDTAGVLNRIDVIHKGGRLVTVSDEQIDPQVLKHTSFAEHNYVRVNKEDLEEIVHLVSEAKIETRVAKIYSFNNVQEALAQAIKSGNNGKVMLIF

SEQ ID NO: 17186 - protein, 274 aa, Streptococcus mutans UA159
MKIAYLGPSGSFTHNVALHAFPAADLLPFENITEVIKAYESKQVCFAIVPVENSIEGSVHETFDYLFHQAKIEAVAEIILPIKQQLMSTSADKTIETIFSHPQAIAQGKQYIRSHYPDVKIEMTASTAYAARFVAEHPEENYAAIAPYAAADEYHLSIIAKDIQEIDENYTRFWVLGDETPTIHLKEEDQKISLALTLPDNLPGALYKALSTFAWRGIDLTKIESRPLKTILGEYFFIIDFENHNEKLVSFALEELTSIGIHYKILGKYAVYRL

SEQ ID NO: 17187 - protein, 246 aa, Streptococcus mutans UA159
MTDLKIDVQDLHKSFGKNEVLKGIDVQFNEGDVVCIIGPSGSGKSTFLRTLNLLETVTSGKVIVDGYKLSDPSTNVDKARENIGMVFQHFNLFPHMTVLDNVTFAPIELGRESKEEAQKHGMELLEKVGLSDKAQAYPNSLSGGQKQRVAIARSLAMNPDIMLFDEPTSALDPEMVGDVLNVMKDLAEQGMTMLIVTHEMGFARKVANRVIFTDGGQFLEDGSPEEIFDNPQHPRLKDFLDKVLNV

SEQ ID NO: 17188 - protein, 450 aa, Streptococcus mutans UA159
MTKQYDYIVIGGGSGGIASANRAAMHGAKVILFEGKQVGGTCVNVGCVPKKVMWYGAQVAETINNYAADYGFDVTTQAFHFDVLKQNRQAYIDRIHDSYERGFDSNGVERVYGYATFVDAHTVEVAGEHYTAPHILIATGGHALLPDIPGSEYGITSDGFFELDAIPKRTAVVGAGYIAVEISGILHALGSETHLFVRRDRPLRKFDKEIVGTLVDEMKKDGPHLHTFSVPKEVIKNTDNSLTLILENGEEYTVDTLIWAIGRAANTKGFNLEVTGVTLDSRGFIATDAFENTNVEGLYALGDVNGKLELTPVAVKAGRQLSERLFNHKPQAKMDYKDVATVIFSHPVIGSIGLSEEAALDQYGEENVTVYRSTFTSMYTAVTSHRQACKMKLVTVGEDEKIVGLHGIGYGVDEMIQGFAVAIKMGATKADFDNTVAIHPTGSEEFVTMR

SEQ ID NO: 17189 - protein, 255 aa, Streptococcus mutans UA159
MSIKVIVAGFKGRMGSTAVDMIKNDSELELAALLDPFAAEKEIDGVPVFTDKSDLVGLDAEVWVDFTIPKVAYENTHFALENGFRPVVGTTGFTQEQIADLMTLSADKKLGGLIAPNFAIGAVLLMEFAAKASKYFPDLEIIELHHDKKKDAPSGTAVKTAELIREARAYKKQGAADEEETLVGARGAEFDGFRIHSVRLPGLVAHQEVIFGAQGEGLTLRHDSYDRISFMSGVNLGIKEVVQREQLVYGLEHLL

SEQ ID NO: 17190 - protein, 254 aa, Streptococcus mutans UA159
MLEIKNLSKQFGDKLVLDNVSLTVNKGDVVVILGPSGSGKTTFLRCLNHLEKADKGHLTLDGQSYDLATLNRKEILTIRQKTAFVFQHYNLFANKTALENILEGLMTARKIPKEQAIQIAEQALEKVGLLSYKDYYPSQLSGGQQQRIGIARAIAVKPDLIFFDEPTSALDPELIGDVLGVMKQLAEEGVTMIVVTHEMSFAKDVANHVIFMDGGHIIEEASPKEFFSKPKEDRTRRFLARILSDDSYSVDYIL

SEQ ID NO: 17191 - protein, 458 aa, Streptococcus mutans UA159
MENHNFENEGQFKRKMTSRHLFMLSLGGVIGTGLFLSSGYTIAQAGPLGAVISYLVGAIVVYLVMLSLGELAVAMPVTGSFHTYATKFISPGTGFTIAWLYWICWTVALGTEFLGAGMLMGRWVPYVPTWVFAALFALLIFGLNALSVRSFAEAESFFSSIKVLAILVFIILGFGAMLGLVSFNGKHEVFLFSHLTAHGALPKGLPALMSVMLAVNYAFSGTELIGIAAGETNNPKEAVPKAIKTTIGRLVIFFVLTIVVLASFLPMKEAGVSSAPFVDVFDKMGIPFAADIMNFVILTAILSAGNSGLYASSRMLWSLANEGMISPRVVKINEHGVPMRALLLSMAGAVLSLFSSIYAADTVYLALMSIAGFAVVVVWLSIPMAQINFRKEWLKSHAQEDLFYKTPFTPILPYITIMLLLISIIGIAWDASQRAGLYFGIPFILLCYLYYYWRHKTL

SEQ ID NO: 17192 - protein, 384 aa, Streptococcus mutans UA159
MTKPIIAFKNVSKVFEDNGTVVLKNINFELEEGKFYTLLGASGSGKSTILNLIAGLLEASSGGIFLDGKRINDIPINKRDVHTVFQSYALFPHMTVFENVAFPLKLRKVAKKEIEKRVTEALNMVRLAGFEKRSIGKLSGGQRQRVAIARAIINQPKVVLLDEPLSALDLKLRTEMQYELRDLQQRLGITFVFVTHDQEEALAMSDWIFVMNDGEIVQSGTPVDIYDEPINHFVATFIGESNILPAVMIEDYLVEFNGKRFEAVDGGMRPNEAVEVVIRPEDLQITLPEEGKLQVKVETQLFRGVHYEIIAHDELGNEWMIHSTHKAIEGEIIGLDFTPEDIHIMRLNETEAEFDARIEEYVETEEHEEGLINAIEEERHEEES

SEQ ID NO: 17193 - protein, 479 aa, Streptococcus mutans UA159
MMSYTFPENFLWGGATAANQFEGAYNQDGKGLSVQDVTPKGGVTQSGSSSPLITEKPTEDNLKLVGIDFYNRYKEDIALFAEMGFKVFRLSIAWTRIFPNGDDLEPNEAGLAFYDKVFDELAKYDIEPLVTLSHYETPLHLARKYNGWANRELIAFYERYARTVFTRYKDKVKYWLTFNEVNSVLHAPFMSGGIITDPEQLSKQDLYQAVHHELVASALATKVGHEINPDFKIGCMVLAMPAYPMPADPLDQLAVREFENQNYLFSDLHARGKYPNYIKRYFKDNNIDIQMAEGDKELMLENTVDFISFSYYMSVAAAHNPEDYNSGRGNVLGGLSNPYLQASEWGWQIDPVGLRLVLNDFYDRYQLPLFIVENGLGAKDVLVQGPDGPTVEDDYRIDYLQKHLMQVGEALQDGVDLLGYTTWGPIDLVSASTAELSKRYGFIYVDRNDDGSGSLVRYKKKSFAWYKKVIETNGASLYE

SEQ ID NO: 17194 - protein, 320 aa, Streptococcus mutans UA159
MKAVLVEQPGSSEQLKVVEREIPKIKEGWSLVKIKGFGINRSEIFTRKGYSPSVVFPRVLGIECVGIIEETSDKNHFFHGQKVVSIMGEMGRAFDGSYAEYVLLPNEQIYPIKTNLTWDKLAAAPESYYTAYGAYKNLKLKKQDLVLVRAGASGVALAFLNLLKASLPEIKVTASVRSLAKKQQLLDSGYDEVIIDRDSCLQTKQKFDKVLDLIGPACIDDTLNHVADGGIICLVGLLGGQWTLDNFDPIMALQNNIYLTTFYSGNINLNKLQELFDFIAKYAVPIKVEKIFTIDHIKEAHDYLESPQAFGKVIVLNGVA

SEQ ID NO: 17195 - protein, 478 aa, Streptococcus mutans UA159
MIKLKPFPQGFLWGGATAANQCEGAYNVDGRGLANVDVVPIGEDRFPIIAGKKKMFDFEEGYFYPAKDSIDMYHHFKEDIALFGEMGFKTYRLSIAWTRIFPQGDELEPNEAGLQFYEDLFKECHKYGIEPLVTITHFDCPMHLIEEYGGWRNRKMLEFYERLCRTLFTRFKGLVKYWLTFNEINMILHAPFMGAGLYFEEGENEEEVKYQSAHHELVASAIATKLAHEIDAENQVGCMLAAGQYYPNTCNPNDYWKAMKEDRSNYFFIDVQARGEYPNYAKKQFERDGLNIIMTQEDLQLLKENTVDFVSFSYYSSRVASADPKINDETQGNIFASIKNPYLSSSEWGWQIDPLGLRITLNTIWDRYQKPMFIVENGLGAIDKPDKNGYVEDDYRIDYLREHIKAMNAAINEDGVQLLGYTTWGCIDLVSAGTGEMKKRYGFIYVDRDNAGNGTLKRSKKKSFDWYKKVIASNGTDL

SEQ ID NO: 17196 - protein, 457 aa, Streptococcus mutans UA159
MSKIVIVGANHAGTAAINTILDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMTKAALKAK

SEQ ID NO: 17197 - protein, 437 aa, Streptococcus mutans UA159
MELINNKRRASMTREFSFETLQLHAGQSVDPTTKSRAVPIYQTTSYVFNDAQDAEDSFALRTPGNIYTRITNPTTAVFEERMAALEGGVGALATASGMAAVTYIALALAHAGDHIVSAATVYGGTFNLLKETLPRYGITTSFVDVANFAEIEAAITDKTKFIIAETLGNPLGNIADLEKLAEIAHRHAIPLVIDNTFGTPYLLNVFSYGVDIAVHSATKFIGGHGTSIGGVIVDSGNFDWEKSGKFPQFVEPDPSYHDISYTRDIGKAAFVTAVRTQLLRDTGACLSPFNAFLLLQGLETLSLRVERHVENAKKIAYYLENHPKVTKVNYASLPSSPYYDLAQKYLPKGASSIFTFNVAGSAKAAREVIDSLEIFSDLANVADAKSLVVHPATTTHGQMTEEDLRACGIEPEQIRVSIGLENADDLIEDLRLALEKI

SEQ ID NO: 17198 - protein, 500 aa, Streptococcus mutans UA159
MNKRVKIVATLGPAVEIRGGKKFGEDGYWGEKLDVEASAAKIAELITEGANVFRFNFSHGDHAEQGERMATVRRAEELARQKVGFLLDTKGPEMRTELFADGVKEYEYKTGDKLRIATKQGIESTKDVIALNVAGGLDIYDDVAVGQTILIDDGKLGLTVTAKDITTREFEVTVENDGIIAKQKGVNIPNTKIPFPALAERDNADIRFGLEQGLNFIAISFVRTAKDVNEVRQICKETGNEHVKLFAKIENQQGIDNIDEIIDAADGIMIARGDMGIEVPFEMVPVYQKMIITKVNAAGKSAITATNMLETMTDKPRATRSEVSDVFNAVIDGTDATMLSGESANGKYPVEAVRTMATIDKNAQTLLNEYGRLNSDNLPRTNKTEVVASAVKDATKSMDIKLVVTITESGNTARLISKYRPDADILALTFDEKVQKSLMINWGVIPILTEKPASTDDMFEIAEKAALKSGLVESGDNIVIVAGVPVGSGGTNTMRVRTVQ

SEQ ID NO: 17199 - protein, 432 aa, Streptococcus mutans UA159
MSIITDVYAREVLDSRGNPTLEVEVYTESGAFGRGMVPSGASTGEHEAVELRDGDKSRYGGLGTQKAVDNVNNIIAEALIGYDVRDQQAIDKAMIALDGTPNKGKLGANAILGVSIAVARAAADFLEIPLYSYLGGFNTKVLPTPMMNIINGGSHSDAPIAFQEFMIVPAGAPTFKEALRWGAEIFHALKKILKERGLETAVGDEGGFAPKFDGTEDAVETIIKAIETAGYKPGEEVFLGFDCASSEFYDNGVYDYTKFEGEKGAKRSAAEQIDYIEELVNKYPIITIEDAMDENDWDGWKALTARLGDRVQLVGDDFFVTNTDYLARGIKEGAANSILIKVNQIGTLTETFEAIEMAKEAGYTAVVSHRSGETEDSTIADISVATNAGQIKTGSLSRTDRIAKYNQLLRIEDQLGEVAEYRGLKSFYNLKK

SEQ ID NO: 17200 - protein, 109 aa, Streptococcus mutans UA159
MTDLSLDFKKQGGLLPVIVTDFQTGQVLMLAYMNEEAYQKTLDSKEMYYWSRSRNELWHKGDTSGHYQYVKSIKTDCDQDTLLIAVEQVGAACHTGAYSCFFNEIYNPE

SEQ ID NO: 17201 - protein, 445 aa, Streptococcus mutans UA159
MAKYDLLIIGAGPGGYIAAEEAARLGKKVAVVEKKDIGGTCLNVGCIPSKAYLQHSHWLLSMQEANKYGISTNLESVDFAKLVNRKDQVVSTLQGGIHTTFKSLKIDYYEGQAQFLKDKSFMVNGEKISGKDVILATGSHPFIPQIHGINSVNYLTTDSFFNLKVLPEKLVIIGGGVIAIELAFAMQPLGVNVTVIEIAPQILLTEDKAARAIIRKKLKTMGAHIFEAAKIEEVHAQSVILEGDGAQEFDQLLVATGRKPNTELAQEMGLKLTERGFVKVDDYYETSTPHVYAIGDLTESYMLAHVASMEGIKAVRAICRQAQDPVDAQGVPRSLYTNPEVASFGLSEEEAKEQGYDVLVEQLPFSFNGRAIASTETQGFVKLISERRYHQILGAVIVGEHGTDLLQQLILLRQAEGTFDQVVDAVYAHPTISELIQEVAKRIVQ

SEQ ID NO: 17202 - protein, 465 aa, Streptococcus mutans UA159
MSHQNAKNTTQNPKELENGMVRGLQNRHVQLIAIAGTIGTGLFLGAGRSISLTGPSIIIVYLLTGLFMFWMMRAMGEMLYHDPDQHTFINFITKYIGKEWGYFAGWSYWVSVIFLGMAEITAIAKYVQYWFPSWPAWIIQIVFLLILGSVNLIAVRVFGEAEFWFAMIKIIAILALIATAIFMLLTGFKTSQGPVSFANISKGFEMFPNGWMKFLMSFQMVFFAYQAIEFVGITVSETQNPRKVLPKAIQEIPMRIVIFYVGALIAIMTIFPWRALPSDTSPFVMVFKLAGIKWAAALINFVVLTSAASALNSTLYSTGRHLYQLANEAPNQFMKRFKIGTLSKTGVPSKAIIFSAIVIAISAFINVLPGIKDAFALITASSSGVYIAIYVLTMLAHLKYRKSNDFMADGYLMPHYKILNPITIIFMVFVFITLFLQDSTYIGAIGATIWIAAFGFYSKFKFKKQ

SEQ ID NO: 17203 - protein, 468 aa, Streptococcus mutans UA159
MSKTLPKDFIFGGATAAYQAEGATHADGKGPVAWDKYLEDNYWYTAEPASDFYHQYPVDLKLAEEFGVNGIRISIAWSRIFPKGYGAVNPKGLAFYHNLFAECHKRHVEPFVTLHHFDTPEALHSNGDFLNRENIEHFVNYAEFCFKEFPEVNYWTTFNEIGPIGDGQYLVGKFPPGIQYDLAKVFQSHHNMMVAHSKAVKLFKDGGYSGEIGVVHALPTKYPYDPNNPADIRAAELEDIIHNKFILDATYLGKYSEKTMEGVNHILAVNGGQLDLREEDFAALEAAKDLNDFLGINYYMSDWMRAFDGETEITHNAKGEKGSSKYQIKGVGRREAPVNVPKTDWDWIIYPQGLYDQIMRVKQDYPNYKKIYITENGLGYKDEFVNHTVYDDARIDYVKKHLEVLSDAIADGANVKGYFIWSLMDVFSWSNGYEKRYGLFYVDFDTQERYPKKSAYWYKKLAETQIID

SEQ ID NO: 17204 - protein, 477 aa, Streptococcus mutans UA159
MSKLPENFLWGGAVAAHQLEGGWQEGGKGISVADVMTAGRHGVAREITAGVLEGKYYPNHEAIDFYHHYKEDVKLFAEMGFKCFRTSIAWTRIFPKGDEAEPNEAGLQFYDDLFDECLKYGIEPVVTLSHFELPYHLVTEYGGFTNRKVIDFFVHFAEVCFRRYKDKVKYWMTFNEINNQANYQEDFAPFTNSGIVYKEGDDREAIMYQAAHYELVASARAVKIGHAINPNLNIGCMVAMCPIYPATCNPKDILMAQKAMQKRYYFADVHVHGFYPEHIFKYWERKAIKVDFTERDKKDLFEGTVDYIGFSYYMSFVIDAHRENNPYYDYLETEDLVKNPYVKASDWDWQIDPQGLRYALNWFTDMYHLPLFIVENGFGAIDQVEADGMVHDDYRIDYLGAHIKEMIKAVDEDGVELMGYTPWGCIDLVSAGTGEMRKRYGFIYVDKDDEGKGTLKRSPKLSFNWYKEVIASNGDDI

SEQ ID NO: 17205 - protein, 258 aa, Streptococcus mutans UA159
MKRILSLVLVSFVLLVGCENIDRAIKGDKYVNHHIAKQKAKNKLKQLNKADFPQLSKKVAKNEAEVTIATSKGDITVKLFPKYAPLAVENFLTHAKNGYYNNLTFHRIISDFVIQGGDPKGDGSGGESIWKGKDRSKDSGKGFANETSKYLYHLRGALSMANAGPNTNASQFFIVQNKDNQSKQLTTTRYPQKIINGYKDGGTPKLDGNYTVFGQVIKGMKIVDKIAAIKTDQSGKPQEKVTIKAIKIIKDYKFDKKK

SEQ ID NO: 17206 - protein, 393 aa, Streptococcus mutans UA159
MVYSVKTFNNINQVGLKELGNKFQVDGDLAENPDAYIIRSQNLHGVDFPKNLKAIARAGAGTNNIPITEATEAGIVVFNTPGANANAVKEAVIASLLFSARDYISANGWVNTLTGDDVPKQVEAGKKQFAGSEIAGKTLGIIGLGAIGARIANDARRLGMNVLGYDPYVSIETAWNISSHVKRVNDLKDIFENSDYITIHVPLNDETKNTFNADSFALMNKGTTIINFARGELVDNEALFEALETGTVKRYITDFGTEELLNKKGITVFPHVGGSTEEAELNCAIMAGKTIRRFIETGEITNSVNFPNMHQTLTAPYRITLINKNVPNIVARLSTAVSNLDINIANILNRSKGDYAYTILDLDETDKAKIDDLVANFEASDNIVRVRLIKGKK

SEQ ID NO: 17207 - protein, 364 aa, Streptococcus mutans UA159
MTEDYKLDTILAHAGINTDKTTGALTAPIHLSTTYQHPQFGQSTGFDYTRTKNPTRTVLEETLAKIEKAKYALVTSSGMAALVLLFTGFPIGSKVVAARDLYGGSFRWFNEQEKAGRFSFVYTNTETDMIAAISDETDYVFIETPTNPLMIEFDISKVAQAAHKHGAKVIVDNTFYSPIYQNPLVLGADVVLHSATKYLSGHNDVLAGVLMTSDQEIYDKLFYDQNTTGPTLSPLDTYLLMRGLKTLKLRMEKATQNAKTVVAYLEKSPAVKEVLYTGKGGMISFKVVDEKKIPQILNHLQLFTFAESLGGVESLITYPATQTHLDIPEEVRHSYGLTDDLLRLSIGIEDAEDLIDDLKAALEA

SEQ ID NO: 17208 - protein, 212 aa, Streptococcus mutans UA159
MNLLIMGLPGAGKGTQAAKIVEKFGLAHISTGDMFRAAMANQTEMGTLAKSFIDKGELVPDEVTNGIVKERLSESDITKKGFLLDGYPRTIEQAHALDEILSKLNLKLDGVINIDVDPACLVERLSGRIINRKTGETYHKVFNPPADYNEDDYYQREDDKPETVKRRLDVNIAQGHPIIEYYRNKGLVYDIEGNQDINLVFETIAKVLANLS

SEQ ID NO: 17209 - protein, 493 aa, Streptococcus mutans UA159
MSNWDTKFLKKGYTFDDVLLIPAESHVLPNEVSMQTKLAKNLTLNIPIITAAMDTVTDSKMAIAIARAGGLGVVHKNMSIKEQAEEVRKVKRSENGVIIDPFFLTPEHKVSEAEELMQRYRISGVPVVETLDNRKLIGIITNRDMRFISDYETPISEHMTSEKLVTAPVGTDLETAERILHEHRIEKLPLIDEKGRLSGLITIKDIEKVIEFPNAAKDEFGRLLVAGAVGVTSDTFERAEALFEAGADAIVIDTAHGHSAGVLRKIAEIRAHFPDRTLIAGNIATAEGARALYEAGVDVVKVGIGPGSICTTRVVAGVGVPQITAIYDAASIAREYGRTIIADGGIKYSGDIVKALAAGGNAVMLGSMFAGTDEAPGETEIFQGRKFKTYRGMGSIAAMKKGSSDRYFQGSVNEANKLVPEGIEGRVAYKGAAADIVFQMLGGIRSGMGYVGAANLKELHENAQFIEMSGAGLIESHPHDVQITNEAPNYSVQ

SEQ ID NO: 17210 - protein, 486 aa, Gluconacetobacter diazotrophicus
MAKKAPSSAPTTTPSPSAEAVAKVFSLIQEHSVELVDLRFTDPRGKWHHTTQHISTIEQDTFRDGFMFDGSSIVGWKAINESDMVLLPDPTTAVMDPFSAKPQLILICDIIEPSTGQFYNRDPRATAKLAEAYLKSTGLGDTAFFGPEAEFFVFDSVKFGTGPNFGIYQLDSIEGPGASLKDYPEGNMGHRPTVKGGYFPVPPVDSENDLRAEMLSTMGEMGLPIEKHHHEVAQSQHELGTKFATLVKSADFMQIYKYCVHNVAHSYGKSATFMPKPIYGDNGSGMHVHQSIWKSGKPVFAGNGYADLSDQALYYIGGIIKHAKALNAFTNPSTNSYKRLIPGFEAPVLLAYSARNRSASCRIPYATSPKAKRVEVRFPDPTANPYLAFAAMLMAGLDGIKNKIHPGDAMDKDLYDLPPDELKQIPTVCGSLREALEALTADHEFLLAGGVFTKDQIESYIDIKWQEVFKFEHTPHPAEFEMYYSV

SEQ ID NO: 17211 - protein, 323 aa, Rhodobacter capsulatus
MSYAMVVTAPGGVENFRLLERDVPQPGPGEVLLRQTAIGLNYIDVYFRTGLYPWGVPADLITGGEAAGVIEAVGPGVDLPVGQRVAYTVRNGAYASHRVIAAEDLVPIPEGISDEIAAAVMLKGLTVHYLIHHSYPAAAGDCVLVHAAAGGVGLLAGQWLKHKGVRALGTAGTAEKCALALAHGYDAVIDYKTRDFVAETMRLTEGKGVKAVYDSVGAVTVKKSVEVLETFGTLVSFGQSSGPALDFRITDLSRGSLRLTRPTLFHHTAQPGWLRKASAEMFDLILKGTIRVEIGQRYDLKDVAAAHTALESRKTTGCTILTP

SEQ ID NO: 17212 - protein, 219 aa, Arabidopsis thaliana
MALPLSGTRHLTRALLSNVTLMAPPRIPSSVHYGGSRLGCSTRFFSIRCGANRSGSTYSPLNSGSNFSDRPPTEMAPLFPGCDYEHWLIVMDKPGGEGATKHEMIDCYIQTLAKVVGSEEEAKKRIYNVSCERYLGFGCEIDEETSTKLEGLPGVLFVLPDSYVDPENKDYGAELFVNGEIVQRSPERQRRVEPQPQRAQDRPRYNDRTRYSRRRENTR

SEQ ID NO: 17213 - protein, 322 aa, Streptomyces coelicolor A3(2)
MQYVKLGSTGLDVSRICLGCMTYGVPDRGTHEWTLDEAASRPLIRQALEAGVTFFDTANVYSDGTSEEIVGKALADFARRDDIVLATKVNGRMRPGPNGAGLSRKAVMTEIDHSLRRLGTDYVDLYQIHRFDPHTPVEETMEALHDLVKAGKVRYIGASSMYAWQFSKMQYTAERHGWTKFVSMQNHYNLVYREEEREMLPLCADQGVGVLPWSPLARGRLTRDWDTATGRSATDTFGSTLYQEGDRAVVEAVTRIAGERGVPRARVALAWLLHQDTVTAPIVGASRPGHLEDAVAAVELTLSETEIEELERPYAPHPIAGH

SEQ ID NO: 17214 - protein, 511 aa, Streptomyces coelicolor A3(2)
MHNPGNATPDRFPAQDRFADGAQYIAGRLTKGTSGRTHTVVDPATGEDVLTYDLAGPDDVDAAVAAARAAFPGWAGATPGERSDALHRFAAVLAERAEDFARAESLQCGKPLKLTREFDVPGTVDNAAFFAGAARHLQGQSAGEYSGDHTSYVRREPIGVVGSIAPWNYPLQMAAWKILPAIAAGNTIVLKPAEITPLTSLMFAQAATEAGIPDGVINVVSGTGREAGEHLVAHPDVAMTSFTGSTAVGKRVAEVATATVKRLHLELGGKAPFLVFDDADLDAAVHGAVAGSLINTGQDCTAATRAYVQRPLYEAFVEKTAALMDTVRVGDPFAPGTDLGPLVSHVQRDRVAAFVDRARSYARVVTGGEVPQGDLKDGAYYRPTLVADAAQDSEVVQSEIFGPVLVVLPFDTDDEGIRLANDTPYGLAASAWSRDVYRANRATREIKAGCVWINDHIPIISEMPHGGYKASGFGKDMSAYSFEEYTQVKHVMFDNTAVAAKDWHRTVFGDR

SEQ ID NO: 17215 - protein, 1033 aa, Streptomyces coelicolor A3(2)
MAKVRVYELAKEFGVESKVVMAKLQELGEFVRSASSTIEAPVVRKLTDAFQQGGGNGRSAGRPAAPKKAAPRPSAPSPAQAGPSQAAPAAGDRAAAPRPSAAPKAPAAQQPAAPSAPAPAPSQGPRPTPGPKPAPRPAPAAPEFTAPPAAPAAPSTPAPAPSGPKPGGARPGAPKPGGARPSGPGQDRGQQGGQGRPGGQRPGAPAQRPGGRPGGPRPGNNPFTSGGNAGMARPSAPRPQGGPRPGGPGGAPGGGPRPQGPGGQGGGPRPQAPGGNRPSPGSMPRPQGGGAGPRPGGGPRPNPGMMPQRPAAGPRPGPGGGGRGPGGAGRPGGGGGRPGGGGFAGRPGGGGGGRPGGGGGFAGRPGGGGGFGGGGGRPGFGGRPGGPGGRGGTQGAFGRPGGPARRGRKSKRQRRQEYEAMQAPSVGGVMLPRGNGETIRLSRGASLTDFAEKINANPASLVAVMMNLGEMVTATQSVSDETLHLLAGEMNYTVQIVSPEEEDRELLESFDLEFGEDEGSEEDLVVRPPVVTVMGHVDHGKTRLLDAIRKTNVIAGEAGGITQHIGAYQVATEVNDEERKITFIDTPGHEAFTAMRARGARSTDIAILVVAANDGVMPQTVEALNHAKAAEVPIVVAVNKIDVEGADPTKVRGQLTEYGLVAEEYGGDTMFVDISAKQGLHIDSLLEAVVLTADASLDLRANPVQDAQGISIESRLDRGRGAVATVLVQRGTLRVGDTMVVGDAYGRVRAMLDDNGNNVAEAGPSTPVQVLGLTNVPGAGDNFIVVEEDRTARQIAEKRAARERNAAFAKRTRRVSLEDLDKVLKAGEVQQLNLIIKGDASGSVEALESSLLQLDVGEEVDIRVLHRGVGAVTESDIDLAMGSDAIVIGFNVRAAGRAAQMAEREGVDVRYYSVIYQAIEEIEAALKGMLKPEYEEVELGTAEIREVFRSSKLGNIAGVLIRSGEVKRNTKARLLRDGKVIAENLNIEGLRRFKDDVTEIREGFEGGINLGNFNDIKVDDVIATYEMREKPRV

SEQ ID NO: 17216 - protein, 468 aa, Streptomyces coelicolor A3(2)
MTGTPQRSHPQPERTFVTIDFAALPDDFLWGTATSAYQIEGAVAEDGRSPSIWDTFSHTPGKIDNGDHGDVACDHYHRTHEDIELMRRLGTNAYRLSVAWPRVVPGGDGPVNAKGLAFYDRLVDDLLAAGITPSVTLYHWDLPQVLQDRGGWPERDTAEHFAAYAAVVAERLGDRVAHWATLNEPLCSAWIGHLEGKMAPGQTDLTAAVRASYHLLLGHGLAMQAIRAAAPDAQVGIVNNLSTIHAATDREEDLAAARRMDGHTNRWWLDPVHGRGFPQDMREVYGVELPERPGDMRLIGAELDWLGLNYYFPQTVAADPTGPAPQVRTVRRAGVPRTGMDWEIDAGGIEELLLRLTEEYGPRKLYVTENGSSFPDLVRPDGSVDDPERQEYLTAHLAACASAARKGAPLAGYFAWSLLDNFEWAYGYDKRFGLVHVDYATQVRTIKGSGHHYADIIGRARGRERKAA

SEQ ID NO: 17217 - protein, 422 aa, Streptomyces coelicolor A3(2)
MTALSPHLRQATPVVAVRGEGVHIEGEDGRRYLDFTAGIGVTSTGHCHPRVVAAAQEQVATLVHGQYTTVMHPPLRRLVDKLGEVLPQSLDSLFFTNSGSEAVEAALRLARQATGRPNVLVCHGGFHGRTVAAASMTTSGTRFRSGFSPLMSGVVVTPFPTAFRYGWDEETATRFALQELDYTLQTISSPADTAAVIVEPVLGEGGYVPANRAFVEGLRERADRHGFLLILDEVQTGVGRTGRFWGHEHFGVAPDILVTAKGLASGFPLSAIAAPEELMRKAWAGSQGGTYGANAVACAAACATLDVVRDEKLVENAEAMGARLRHGLEAVASRNPAVGDVRGMGLMLASEFVTADGEPDPETAARVQRAAVDEGLLLLLCGAWNQVVRMIPALVIDETAVDEGLRAWAAAVEAGTSGAAGR

SEQ ID NO: 17218 - protein, 479 aa, Streptomyces coelicolor A3(2)
MTDTPTQLFLGGAWADAADGAVMPVDDPATGEILAHVADAGPKDARLAEEAAVQAQEEWARAAPRARSEILRRAYEIVLERTDALARLMTSEMGKPLAEARGEVAYAAEFFRWFSEEAVRIDGGHGVLPDGRNRMLLSRRPVGPCLLITPWNFPLAMGTRKIGPAVAAGCTMVLKPAPQTPLSSLALAAILKEAGLPDGVLNVVTTSRAGEVCEPLLRGGRIRKLSFTGSTAVGRLLLAQCADTVVRTSMELGGNAPFVVFDDADLDAAVDGAMVAKMRNMGEACTAANRFFVHRSVAGEFADRLARRMGALVVGPGTGDGVDVGPLIDAAGRAKVEELVADAVERGARVLVGGTTPEGPGCFYPPTVLTDVAPESRLMATEIFGPVAAILTFDDEDEVVRRANDTPWGLVGYVFTEGLDRALRVSERLDVGMVGLNTGLVSNPAAPFGGVKQSGLGREGGRVGIEEFLEYQYVALPTG

SEQ ID NO: 17219 - protein, 488 aa, Streptomyces coelicolor A3(2)
MSRAARCSLGDMNESPRTPFPTPSHWIDGRAVTGSGPLIDVVNPADESVIAHLHEATADDVDMAVDAAVAAIPGWAATPPRHRADVMRRLAEGLQKRSEELAATITLEMGAPIAFSRQAQVGFPVASTLAAIAAAERFEWSERIENSLVVREPVGVVGAITPWNFPLQQLVTKVVPAMLAGNTVVLKPSELSPLSARMFAEIATEAGLPNGVFNVVQGTGPVVGEALSRHPKIDMISFTGSTRAGKSVSSAASVTVKRVALELGGKAAHIVLPEADLDSAVARGLAFAWANAGQACGAYVRMLVPEDLQTAVVDRLRTAAQEYVVGDPADEATRIGPLASETQRRRVDDYIRRGIADGATLVTGGPGRPEGFETGAYVRPTIFSDVAPESVIAQEEIFGPVLVVIPYTDDEHAVEIANGTVYGLNAAVTGDEDHAMAIAVRLRVGQVDVNGGRHNFQAPFGGYKQSGNGREMGRAGLEEFLETKAITS

SEQ ID NO: 17220 - protein, 384 aa, Oryza sativa (japonica cultivar-group)
MAWQLLAGVLLLQLAASAAGQQQCLSATFQNGQTFLKCNPLPVLGASLHWTHHAENGTADVAFRAPQQSSGWVAWGINTRGTTMPGSSVFIASQDGSGSVSVLMTVLENTSPSLTNGSLSFDVLSPPTADYTNGVYTIFATIALPNNSTTQNTVWQAGPGSTGNVGQHATSGPNVQSMLRLDFSSGQSTGTASNSRLHRRNIHGILNAVSWGILIPMGAMIARYLRVFEAADPAWFYLHITCQLSGYILGVAGWALGLKLGSESKGITYSAHRNIGIAIFCLATLQVFALLLRPDKKNKYRFYWNIYHHSVGYSAIVLAAVNIFKGLDILKPASGWKRSYIAILATLAGVALLLEAITWVIVLRRKKSDKSSSPYGATNGNGRA

SEQ ID NO: 17221 - protein, 228 aa, Synechococcus elongatus PCC 7942
MKLLDWWALLHPAIAVVVIYPILGVVLRQAWLTRQRRFSPADQKSKIPVSVGQDHSQAGRWLTTGVVVVSLLGIGYPIFSKFVEAGPTGFDGGTPRLITLLLAWIGSLAAIASLFLLRPKTPRELRLPRALFAILTGFGVVALGQQSEVFKRDYEALVSQYYYGIAVVLLMILALATLPEIQRFPRWRILHIVMNIAAAVLFLGQGVTGARDLLEIPLSWQKPTIVPM

SEQ ID NO: 17222 - protein, 369 aa, Synechococcus elongatus PCC 7942
MKSRAAIAWAAGQTADDREVDVQAPQAGEVMVKLVATGVCHTDAFTLSGADPEGIFPCILGHEGAGIVVEVGEGVTSVAVGDHVIPLYTPECGECKFCKSGKTNLCQAIRATQGKGLMPDGTSRFSLNGQPIYHFMGTSTFSEYTVLPEIAIAKINPAAALDKVCLLGCGITTGIGAVLNTAKVEPGSTVAVFGLGGVGLSVIQGAVLAKASRILAIDINPDKAEFAKQLGATDFINPKDYDRPIQEVIVELTDGGVDYSFEAIGNVNTMRAALESCHKGWGESTIIGVAGAGQEISTRPFQLVTGRVWRGSAFGGVKGRSQLPGYVEQYLNGQIKVDEFVTETRPLEEINEAFEDMHAGKVIRTVITF

SEQ ID NO: 17223 - protein, 491 aa, Synechococcus elongatus PCC 7942
MPRGVAPAFAGRKPKGWAWASTAVPDFQGGFKRLINRFQGSKLWLACVPLAATIAVFWGVAANAQGSADPVPSAQFLVNNLWLMVATVLVIFMNAGFAMVETGLCRQKNAVNVLAKNLIVFTLAATAYWFIGYSLMYGSPVVDGFLYFGKGGPLGFFFDPTVSAETIKNDGLISSLDFLFQAAFAGTAATIVSGSVAERIKFVDFIIFSLILTAVIYPIAGSWQWNVGSGWLNKAGFIDFAGSTVVHSVGGWAALIGAITLGPRMGKFQDGRPGALPGHNLAIATLGALILWIGWYGFNGGSVLAFNTAVPYVAVTTTLGGAAGGISATITSWSTSGKPDLSMVINGILAGLVGVTAGCDGFGMGGSFIVGLIAGVLVVFSVYTFENLKIDDPVGACSVHLVCGIWGTLAVGLFNLEKGLFYGGGFGQLGSQILGIISYGVWTVVASVIIWNILKALLGLRVSLKKSYKAWILANTGWKPTLALPRMHLTP

SEQ ID NO: 17224 - protein, 396 aa, Brucella melitensis
MMFRTLDDANVQSKRVLVRVDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAIVGWHFAADTPHQTYGVDSVPGDAMILDAGELSTDLIASAIDDAATLVWNGPLGAFELRPFDTATVKVARHVAKRTKEGKLVSVGGGGDTVAALNHAGVADDFTYISTAGGAFLEWMEGKPLPGVDVLKK

SEQ ID NO: 17225 - protein, 392 aa, Neisseria meningitidis serogroup B
MAFLKLTEQNVQGKTVLIRADMNVPFKDGKISDDTRIRASLASIKYCVDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIADVAEDEMILDIGPKSAAALADLLKAAGTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 17226 - protein, 322 aa, Streptomyces coelicolor A3(2)
MSSNETPRGPVDSSRIPRYAGPATFARLPRLDEVGAADVAVVGVPFDSGVSYRPGARFGGNAIREASRLLRPYNPAQDASPFALAQVADGGDIAVNPFNIHEAVETIEAAADDLLGTGARLMTLGGDHTIALPLLRSVAKKHGPVALLHFDAHLDTWDTYFGAEYTHGTPFRRAVEEGVLDTSALSHVGTRGPLYGKKDLTDDEKMGFGIVTSADVYRRGADEIADQLRQRIGDRPLYISIDIDCLDPAHAPGTGTPEAGGMTSRELLEILRGLASCNLVSADVVEVAPAYDHAEITSVAASHTAYELTTIMSRQIAEARTK

SEQ ID NO: 17227 - protein, 217 aa, Streptomyces coelicolor A3(2)
MRIVLVGPPGAGKGTQATRLAETLHIPHISTGDLFRANISQQTELGKLAKSYMNAGNLVPDEVTIAMAKDRMEQPDAEGGFLLDGFPRNVSQAEALDELLETEGMKLDAVLDLEAPEDEVVKRIAGRRVCRNEPKHVFHVTYTPPKKEGVCDVCGGELYQRDDDSEETVRKRLEVYHTQTEPIIDYYKSQGLVATIAATGPVDEVTRRALEALKRDQ

SEQ ID NO: 17228 - protein, 427 aa, Streptomyces coelicolor A3(2)
MTRDLFARHRAVLPDWLALYYEDPLEITHGEGRYVWDAAGNKYLDFFGGILTTMTAHALPEVTKAVAEQAGRIVHSSTLYLNRPMVELAERVAQLSGIPDARVFFTTSGTEANDTALLLATAYRRSNAILAMRNSYHGRSFSTVGITGNRGWSPTSLSPLQTLYVHGGVRTRGPYADLDDRDFIDACVTDLKDLLGHSRAPAALIAEPVQGVGGFTSPPDGLYAAFREVLHERGILWISDEVQTGWGRTGEHFWGWQAHARSGPPDIVTFAKGIGNGMSIGGVVARAEIMNCLDANSISTFGGTQVTMAAGLANLNHLLEHDLQGNARRVGGLLIERLRAVAAQVPHVREVRGRGLMIGVELTRPGTDEAAPEAASTVLEEARAGGLLVGKGGGHSTSVLRIAPPMSLTVAEAEEGAAILERALRSI

SEQ ID NO: 17229 - protein, 497 aa, Spinacia oleracea
MAFPIPARQLFIDGEWREPIKKNRIPVINPSTEEVIGDIPAATAEDVEVAVVAARRAFRRNNWSATSGAHRATYLRAIAAKITEKKDHFVKLETIDSGKPFDEAVLDIDDVASRFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFSNDLERCERITKALEVGAVWVNCSQPCFVQAPWGGIKRSGFGRELGEWGIQNYLNIKQVTQDISDEPWGWYKSP

SEQ ID NO: 17230 - protein, 416 aa, Claviceps purpurea
MTDIPGRRAFKCFNQEFVVDERYTVTKELGQGAYGIVCAAVNNQTKESVAVKKVTNVFSKKILAKRALREIKLLQHFRGHRNITCLYDMDIPRPDVFNETYLYEELMECDLAAIIRSGQPLTDAHFQSFIYQILSGLKYIHSANVLHRDLKPGNLLVNADCELKICDFGLARGFSADPEQNAGYMTEYVATRWYRAPEIMLSFQSYTKAIDVWSVGCILAELLGSRPFFKGRDYVDQLNQILHVLGTPNEETLSRIGSPRAQEYVRNLPVMPKKNFATLFPQANPHALDLLDKMLAFDPSSRISVEQALEHPYLQVWHDPADEPNCPTIFNFDFEVLDDVGEMRKVILDEVIRFRQMVRTASSAEPTTGQAQTAAAGQVPMPQAGGQWKAEDPRPQENTPQGNGLEQDLQAGLDAA

SEQ ID NO: 17231 - protein, 502 aa, Nicotiana sylvestris
MEHSLMATRSYFLLFSSFTFLLILLSFPVEKSHALEAKETIESHFHTLQLTSLLPSSSCNTATKGKRRGASLEVVNRQGPCTQLNQKGAKAPTLTEILAHDQARVDSIQARVTDQSYDLFKKKDKKSSNKKKSVKDSKANLPAQSGLPLGTGNYIVNVGLGTPKKDLSLIFDTGSDLTWTQCQPCVKSCYAQQQPIFDPSASKTYSNISCTSTACSGLKSATGNSPGCSSSNCVYGIQYGDSSFTVGFFAKDTLTLTQNDVFDGFMFGCGQNNRGLFGKTAGLIGLGRDPLSIVQQTAQKFGKYFSYCLPTSRGSNGHLTFGNGNGVKTSKAVKNGITFTPFASSQGATFYFIDVLGISVGGKALSISPMLFQNAGTIIDSGTVITRLPSTVYGSLKSTFKQFMSKYPTAPALSLLDTCYDLSNYTSISIPKISFNFNGNANVDLEPNGILITNGASQVCLAFAGNGDDDTIGIFGNIQQQTLEVVYDVAGGQLGFGYKGCS

SEQ ID NO: 17232 - protein, 507 aa, Manihot esculenta
MMIFLTILAVNIFRMTSFLERLLLLTRSKVKQLQRVDHLVFGTYFPRNRIIDGRNGDVAVDFYNRYIEDIKNVKKMGFNAFRMSISWSRVIPSGRRHEGVNEEGIQFYDDVINEIISNGLEPFVTIFHWDTPQALQDKYEGFLSRDIVYDYDQYADLLFERFGDRVKRWMTFNEPSAYVGFAHDDGVFAPRRCSSWVNRQCLAGDSATEPYIVAHNLLLSHAAAVHQYRKYYQGTQKGKIGITLFTFWYEPLSDSKVDVQAAKTALDFMFGLWMDPMTYGRYPETMVDLAGDRLIGFTDEESQLLRGSYDFVGLQYYTAYYAKPNITVDPNFRTYKTDSGVNATPYDNNGNLIGPRAYSSWFYIFPKSIRHFLNYTKDTYNDPVIYVTENGVDNYNNESQPNGEALQDDFRISYYKKHMWNALGSLKNYSVNLKGYFAWSYLDNFEWNIGYTSRFGLYYVDYKNNLTRYPKESALWFTKFLNISVNANNIFECPSKDSRKVGKFYVM

SEQ ID NO: 17233 - protein, 249 aa, Medicago sativa
MPIRNIAVGTPQEATHPDTLKAGLAEFISTFIFVFAGSGSGIAYNKLTNDGAATPAGLISASIAHAFALFVAVSVGANISGGHVNPAVFGAFVGGNITLLRGIVYIIAQLLGSIVCSALLVFVTASSVPAFGLSEGVGVGPALVLEIVMTFGLVYTVYATAVDPKKGNIGIIAPIAIGFIVGANILVGGAFTGASMNPAVSFGPAVVSWSWSNHWVYWAGPLIGGGIAGLVYEVLFINSTHEQLPTTDY

SEQ ID NO: 17234 - protein, 265 aa, Arundo donax
AESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNANRFEEAKKFGCTEFLNPKDHSKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHTVPFSEINKAFDLMAKGEGIR

SEQ ID NO: 17235 - protein, 212 aa, Eragrostis japonica
KSRFSINGKPIYHFVGTSTFSEYTVMHVGCLAKINPEAPLDKVCVLSCGISTGLGASINVAKPPKGSTVAVFGLGAVGLAACEGARIAGASRIIGVDLNPNRFEEARKFGCTEFVNPKDHNKPVQEVLAEMTNGGVDRSVECTGNINAMIQAFECVHDGWGVAVLVGVPHKDAEFKTRPMNFLNERTLKGTFFGNFKPRTDLPNVVELYMKK

SEQ ID NO: 17236 - protein, 262 aa, Muhlenbergia setarioides
WPCSSCVHWGMQGVRPLQVVWEQPVWSAQDQHRPGCDDWCRQLTVSIDGKPIYHFVGTSTFSEYTVIHVGCLAKINPEAPLDKVCVLSCGISTGLGASINVAKPPKGSTEAVFGLGAVGLAAAEGARIAGASRIIGIDLNTSRFEEAKKFGCTEFVNPKDHDKPIQEVLAEMTNGGVDRSVECTGNINAMIQAFESVHDGWGVAVLVGVPHMDAEFKTKPMNFLNERTLKGTFFGNFKPRTDIPNVVELYLKKELVLEKFIN

SEQ ID NO: 17237 - protein, 188 aa, Anomochloa marantoidea
VIHVGCLAKINPEAPLDKDCVLSCGISTGLGAALNVAKPPKGSSVAIFGLGAVGLAAAEGARLAGASRIIGVDLNPNRFELAKKFGCTEFVNSKDLDKPVQEVLAEMTNGGVDRSIECTGNINAMISAFECVHDGWGVAVLVGVPRKDAEFKTNPMNVLNERTLKGTFFGNYEPRTDLPNVVEMYMRK

SEQ ID NO: 17238 - protein, 188 aa, Joinvillea ascendens
VIHVGCVAKINPEAPLDKVCVLSCGISTGLGATLNVAKPPKGSTVAIFGLGAVGLAAAEGARLAGASRIIGIDLNPNRFEQAKNFGCTEFVNPKDHNKPVQEVLAEVTNGGVDRSVECTGHIDAMVSAFECVHVGWGVGVLVGVPHKDAVFKTNPMNLLNERTLKGTFFGNYKPRSDLPSVVEMYMNK

SEQ ID NO: 17239 - protein, 188 aa, Lithachne humilis
VMHVGCVAKINPAAPLDKVCVLSCGISTGLGASINVAKPPKGSTVAIFGLGAVGLAAAEGARIAGASRIIGVDLNPNRFEEARKFGCTEFVNPKDHNKPVQEVLAEMTNGGVDRSVECTGNINAMIQAFECVHDGWGVAVLVGAPHKDAEFKTHPMNFLNERTLKGTFFGNYKPRTDLPNVVELYMKK

SEQ ID NO: 17240 - protein, 188 aa, Anomochloa marantoidea
VIHVGCLAKINPEAPLDKVCITSCGVSTGLGATLNVAKPKKGSTVAIFGLGAVGLAAVEGARLAGASRIIGVDLNPAKFGQAKKFGCTDFVNPKDYNKPVQEVLIAMTNGGVDRSVECTGHIDAMISAFECVHDGWGVAVLVGVPHKEALFKTHPMNFLNEKTLKGTFFGNYKPRSDLPNVVEMYMKK

SEQ ID NO: 17241 - protein, 280 aa, Bambusa multiplex
  misc_feature (97)..(97): Xaa can be any naturally occurring amino acid
IVESVGEGVTDLAPGDHVLPVFTGECKECPHCKSAESNMCDLLRINTDRGVMIGDGKSRFSINGKPIYHFVGTSTFSEYTVMHVGCVAKINPEAPLXKVCVLSCRISTGLGASINVAKPPKGSTVAIFGLGAVGLASAEGARIAGASRIIGIDLNPSRFEEAKKFGCTEFVNPKDHSKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSV

SEQ ID NO: 17242 - protein, 338 aa, Moraxella sp. TAE123
MKAAVLHEFGQSLQIEEVDIPTPGAGEIVVKMQASGVCHTDLHAVEGDWPVKPSPPFIPGHEGVGLITAVGEGVTHVKEGDRVGVAWLYSACGHCTHCLGGWETLCESQQNSGYSVNGSFAEYVLANANYVGIIPESVDSIEIAPVLCAGVTVYKGLKMTDTKPGDWVVISGIGGLGHMAVQYAIAMGLNVAAVDIDDDKLAFAKKLGAKVTVNAKNTDPAEYLQKEIGGAHGALVTAVSAKAFDQALSMLRRGGTLVCNGLPPGDFPVSIFDTVLNGITIRGSIVGTRLDLQESLDMAAAGKVKATVTAEPLENINDIFERMRQGKIEGRIVIDYTM

SEQ ID NO: 17243 - protein, 372 aa, Comamonas sp. NCIMB 9872
MKKVFDLFDLKGLKLRNRVVMAPMSRARILDSTPDSSTALYYGQRAGAGLIIAEGANVSPQACGTMGTAGIYLPEHVAGWRLTTQAVHTAGGRIFLQLAHAGRVSHRSLQPEGAAPVSSTSKHALNTTVFGINAAGHTAPLQTSMPQCLTEQELAGIRSDFVRAARLAMQAGFDGVEIHAGNGFLFEQFINGALNDRQGLYGGAPAAHRLRFLLETLDAVASAIGPDHVGVKVTPFSRLADMPSYEGETQTWLAFANEPLLGSLAYVHAAFGDVDASFALQFRQALRGTLMRPCSPDAAAANAMLEQGLADLVVMGRPFISNPDLVERMRHGWPLSLASDTTVYGGGSAGYTDYPFYKPAQEADNSSADALV

SEQ ID NO: 17244 - protein, 482 aa, Comamonas sp. NCIMB 9872
MNSSLHYNYVGGDWVNGATERHNLNPSDLSDSIGIYVGANEAQTQAAIDAAFDARTAWACWTAEQRADALDRIGTSILASAKELGHLLSREEGKTLAEGIGEAARAGRIFKYFAAEALRCGGDLLPAIRPGVSVEVTREPEGVVGIITPWNFPLAIPAWKIAPALAYGNTVVFKPADLVPGSAWALTEIIHRVGGLPPGVFNLVMGPGSKVGNTLANAPKVRALSFTGSATTGRQVGLACMERGAKVQMEMGGKNPLVVLNDADLQSAASVAIQGSFYSTGQRCTGSSRLIVEAGIHDAFVEAMRQQMSALSIGHALKQGTDIGPVASEDQLQQDLEYIRIGVAEGGRLYCGGSQLERETEGFYLSPALLTETDNSMRINREEIFGPVASVIRVGSYEEALHTANDTVFGLSSGICTTSLKYASDFKRRSAAGMVMVNVPTAGVDYHAPFGGRKGSSYGAREQGAYAREFYTVIKTAYTSAG

SEQ ID NO: 17245 - protein, 458 aa, Pseudomonas aeruginosa
MQTRKVDVAIIGAGTAGSTAFHALKATGKQVVLIDRGPLGTTCARVGCMPSKAALHAGMHWKVAKALAASATPSTQGPQALWSHARQTRDALAGAAAERTRKAAGESLIMAEARFVAPGILQAGEQRIEASAFIVATGSRPVVPKALDGVASRILTTDTLFDLGVLPARMGILGLGAIGLELGLALSRLDVQVVAADQKDAIGGIQDPDVLERAIARFETELPMWLGAAVEVSLEGDQVRMRAGERDALVDRLLVVTGRQPNTEALDLAAAGISLDQAGRPSIDPATMQACGPSQVPIFFAGDVQPDRPLMHEAADEGQMAAQAALASLRGESWPGASRRVPITILFTDPDACAVGMTYEAAVQEGAVVGTAEGSGNGRSKILGAPENLLHIYADPGSGALLGASMLLTQGEHLAHLIAWAIQAKQTVNDLLAMPYYHPSIEEMLQSALKSASQQMRP

SEQ ID NO: 17246 - protein, 460 aa, Pseudomonas aeruginosa
MNEENNKQVLKLQEFIEKHNIDTVRLGAVDIDGVWRGKQVGAEYFLNKAALDGTQISNILFGWDVADHLVDGLAFTGWDSGYPDIALIPDLLTLSLVPWQAKTASVLCDIQHLNGQSLNLSPRNLLRKATEKAEQLGYKCHAAYEFEFYLLNDSIGSIAADQWRSINPVEKSGHCYSMLHHSSSSDIIGEVRKYMRDAGIVLEATNSEHGPGQYEINIKYDDALKAADDAIFVKNGIKEIAAKHGMTATFMAKPNAEWSGSSGHVHISLSNLITGAPAFANPENPAALSEVGYNFLAGMVELAREFSAIYLPNINSYKRTAGASWAGGNSSWGFDNRTVSHRAITSAGAAARVENRIPGADTNPYLVIAASLLSGLYGIENKLKPKDPILGNAYKVSPELARPLAASLEEATNIFRESEMARVLFPKEFVEHYSQMKVWEIKQANGFVNNWELARYLDII

SEQ ID NO: 17247 - protein, 502 aa, Pseudomonas aeruginosa
MEKTTTSPVGATYWRSRAENVEFEGRCLIDGKLIEAHSGQTFDCVSPVDGRVLTKVAEGGEADINKAVAAARAAFQDRRWAGQSPIFRKRTLQAFAALIRLHRDELALLETLDMGKPISASRSVDVEAVANCFDWYAEAIDKLYEQIAPTAENDLALITREPLGVVGAIVPWNFPMLTTAWKVAPALATGNSVVLKPAEQSPLTAIRLGQLALEAGIPEGVFNVVPGFGRSAGKALACHMDVDGIFFTGSTATGRLLTEYAAKTNLKRVCLELGGKSPNIILASYGDIEKAAVTAAESMFNNQGEVCIAPSRLIVERSIHKQVVEIVAEIARQRQPGDPLDPATRIGALVNAQHADRVMGFIERAKTDGATLAAGGTRALTETGGSYVVPTVFDNVSNDMEIAREEIFGPVLSVIPVSSVDEAVSVANDSPYGLGAGVWTDSLSDAHKISRKLRAGVVYVNCYNDCDITTPFGGVKQSGNGRDKSLYALDEYTELKTTWIRL

SEQ ID NO: 17248 - protein, 435 aa, Pseudomonas aeruginosa
MTALISSSNYPLPVVHHARGVFIYDDSGKSYIDGSGGAMTVSIGHGVPEVLSAMSRQAQQVCFTYRTHFTSTAAEELAKEIVALAPGDLNKVFFVNSGSEATELSMRTAIQYWQARGQPTKTKILGRAISYHGMTMGSLSMSGHAARRADYSNLLHQFAVAPPPYAYRFEVPNDGTFGASVWEKIIQEQGADTIAAVIVEPIVGAAGGALTPPIGYLKALREICDRHSILLISDEVITGMGRTGTWFGCEHDGIVPDIIATGKGMSSGYTPMGGVIIRDGIMEALGERVKLFGHTFSANPLSAATCLAVIRYMKEHAILDNVAARSVQLESGLKDLSVRYPWMADVRGRGLLWGFEFVKDATTKEPIDAARQPNLRFAQHCFDAGLIAYPAGIAPLNNSALLAPPLVISASETEELLSRLEIGLQRFGNEMGLPA

SEQ ID NO: 17249 - protein, 1953 aa, Saccharomyces cerevisiae
MLKNSGSKHSNSKESHSNSSSGIFQNLKRLANSNATNSNTGSPTYASQQQHSPVGNEVSTSPASSSSFRKLNAPSRSTSTEARPLNKKSTLNTQNLSQYMNGKLSGDVPVSSQHARSHSMQSKYSYSKRNSSQASNKLTRQHTGQSHSASSLLSQGSLTNLSKFTTPDGKIYLEMPSDPYEVEVLFEDIMYKRNIFQSLSEDKQEALMGYSIEKKWLIVKQDLQNELKKMRANTTSSSTASRTSMASDHHPILTANSSLSSPKSVLMTSASSPTSTVYSNSLNHSTTLSSVGTSTSKGKKLVSGSLKKQPSLNNIYRGGAENNTSASTLPGDRTNRPPIHYVQRILADKLTSDEMKDLWVTLRTEQLDWVDAFIDHQGHIAMANVLMNSIYKTAPRENLTKELLEKENSFFKCFRVLSMLSQGLYEFSTHRLMTDTVAEGLFSTKLATRKMATEIFVCMLEKKNKSRFEAVLTSLDKKFRIGQNLHMIQNFKKMPQYFSHLTLESHLKIIQAWLFAVEQTLDGRGKMGSLVGASDEFKNGGGENAILEYCQWTMVFINHLCSCSDNINQRMLLRTKLENCGILRIMNKIKLLDYDKVIDQIELYDNNKLDDFNVKLEANNKAFNVDLHDPLSLLKNLWDICKGTENEKLLVSLVQHLFLSSSKLIEENQNSSKLTKQLKLMDSLVTNVSVASTSDEETNMNMAIQRLYDAMQTDEVARRAILESRALTKKLEEIQAERDSLSEKLSKAEHGLVGQLEDELHERDRILAKNQRVMQQLEAELEELKKKHLLEKHQQEVELRKMLTILNSRPEESFNKNEGTRGMNSSLNSSEKANIQKVLQDGLSRAKKDYKDDSKKFGMTLQPNKRLKMLRMQMENIENEARQLEMTNFAEFEKDRLEPPIHIKKPKVKKMKNKDRKPLVKPQEADVNKLNDLRRALAEIQMESNDISKFNVEERVNELFNEKKSLALKRLKELETKYKGFGIDFNVDEIMDSPKKNTGDVETEEDANYASLDPKTYQKKLDEINRITDQLLDIQTQTEHEIQVEEDGESDLSSSSSDDESEEIYQDASPTQELRSEHSELSSGSGPGSFLDALSQKYGTGQNVTASAAFGENNNGSGIGPLHSKVEKTFMNRLRKSTVSSAPYLEELTQKVNKVEPYEQNEDEGLDKKSLPENSTASAASAFDKAEKDMRQHVENGKQGRVVNHEEDKTADFSAVSKLNNTDGAEDLSTQSSVLSSQPPPPPPPPPPVPAKLFGESLEKEKKSEDDTVKQETTGDSPAPPPPPPPPPPPPMALFGKPKGETPPPPPLPSVLSSSTDGVIPPAPPMMPASQIKSAVTSPLLPQSPSLFEKYPRPHKKLKQLHWEKLDCTDNSIWGTGKAEKFADDLYEKGVLADLEKAFAAREIKSLASKRKEDLQKITFLSRDISQQFGINLHMYSSLSVADLVKKILNCDRDFLQTPSVVEFLSKSEIIEVSVNLARNYAPYSTDWEGVRNLEDAKPPEKDPNDLQRADQIYLQLMVNLESYWGSRMRALTVVTSYEREYNELLAKLRKVDKAVSALQESDNLRNVFNVILAVGNFMNDTSKQAQGFKLSTLQRLTFIKDTTNSMTFLNYVEKIVRLNYPSFNDFLSELEPVLDVVKVSIEQLVNDCKDFSQSIVNVERSVEIGNLSDSSKFHPLDKVLIKTLPVLPEARKKGDLLEDEVKLTIMEFESLMHTYGEDSGDKFAKISFFKKFADFINEYKKAQAQNLAAEEEERLYIKHKKIVEEQQKRAQEKEKQKENSNSPSSEGNEEDEAEDRRAVMDKLLEQLKNAGPAKSDPSSARKRALVRKKYLSEKDNAPQLLNDLDTEEGSILYSPEAMDPTADTVIHAESPTPLATRGVMNTSEDLPSPSKTSALEDQEEISDRARMLLKELRGSDTPVKQNSILDEHLEKLRARKERSIGEASTGNRLSFK

SEQ ID NO: 17250 - protein, 438 aa, Fervidobacterium sp. YNP
MIRRSDFPKDFIFGTATAAYQIEGAANEDGRGPSIWDVFSHTPGKTLNGDTGDVACDHYHRYKEDIQLMKEIGLDAYRFSISWPRIMPDGKNINQKGVDFYNRLVDELLKNDIIPFVTLYHWDLPYALYEKGGWLNPDIALYFRAYATFMFNELGDRVKHWITLNEPWCSSFLGYYTGEHAPGHQNLQEAIIAAHNLLRAHGHAVQAFREEVKDGKVGLTNVVMKIEPGDAKPESFLVASLVDKFVNAWFHDPVVFGKYPEEAVALYTEKGLQVPDSDMNIISTPIDFFGVNYYTRTLVVFDMNNPLGFSYVQGDLPKTEMGWEIYPQGLFDMLVYLKERYKLPLYITENGMAGPDKLENGRVHDNYRIEYLEKHFEKALEAINAGVDLKGYFIWSLMDNFEWAYGYSKRFGIIYVDYNTQKRILKDSALWLKEFLKS

SEQ ID NO: 17251 - protein, 245 aa, Bradyrhizobium japonicum
MTSEILIAPSILAADFARLGEEIAAIDAAGADWIHCDVMDGHFVPNISFGADVIKAIRPVTKKVFDVHLMIAPVDPYLDAFAKAGADVITVHAEAGPHLDRTLQAVRALGKKAGVSLCPATSEGAIEYVLDRIDLVLVMTVNPGFGGQSFLESQLEKIKRIRTVIGDRPIRLEVDGGITRENAVAVAAAGADTLVAGSAVFRGKSSADYAGNIAAIRVAAEAGRVSKLQDISVQPMRAGESARLR

SEQ ID NO: 17252 - protein, 506 aa, Ruta graveolens
MDLLLLEKALLGLFAAAVVAIAVSKLRGKRFKLPPGPFGFPVFGNWLQVGDDLNQRKLANLSKKFGDVYLLRMGQRNLVVVSSPEMAKEVLHTQGVEFGSRTRNVVFDIFTGKGQDMVFTVYSEHWRKMRRIMTVPFFTNKVVQQQRFNWEDEAARVVEDVKKDPQAATTGIVLRRRLQLLMYNNMYRIMFDRRFESVDDPLFNKLKALNGERSRLAQSFEYNYGDFIPILRPFLRGYLKLVKEVKERRLKLFKDYFVEERKKLTSTKSMTEENFKCAIDHVLDAQQKGEINEDNVLYIVENINVAAIETTLWSIEWGIAELVNHPDIQKKLRAEIDRVLGPDHQITEPDTHKLPYLQAVIKETLRLRMAIPLLVPHMNLNDAKLAGYDIPAESKILVNAWWLANNPAHWKDPQVFRPERFLEEESGVEANGNDFRYIPFGVGRRSCPGIILALPILGITIGRMVQNFELLPPPGQSKIDTSEKGGQFSLFILNHSTIVLKPRSSV

SEQ ID NO: 17253 - protein, 306 aa, Streptomyces globisporus
MRTRRRWSAADVPDRTGTTAVVTGASSGIGLHLAQELARHGAHVVLAVRDPDRGVAAAARIQSRVPSAQLTVRRLDLSRLASVRAGAEELRDRFPRIHLLVNNAGVMWTDRARTPDGHELQFATNHLGHFALTGLLLDSLRAAPGARVVTISSYLHRLGRIDFSDLHGERRYSRYRAYNQSKLANLMFALELHHRLAESGAELASLAAHPGLTATGLGRDFPAPVRRLGSPLAPLFLQPAAAGMLPGLRAATDPGARGGEFYGPLGVTETRGAPGLVRPGGAAVDPRARRRLWEESEHLTGVRLRP

SEQ ID NO: 17254 - protein, 449 aa, Streptomyces globisporus
MRIDPPGPPLRALPGLLRKLAVDRLGMMRDAAGLGDAVRVSMGPKKLYIFNRPDYAKHVLADNSDNYHKGIGLVQSRRVLGDGLLTSDGETWREQRRIVQPAFKPGRINQQAAAVAEEAAKLVALLRGHEGGGPVDVLQEVTGLTLGVLGRTLLDSNLTAHESLAHSFEEVQDQAMLEMVSQGTVPAWLPLPPQARFRRARRELYRVADLLVADRRSRMADGGPGDDALSRIIVAADRRRDDPARARNRLREELVTLLLAGHETTASTLGWTLHLLERHPEVRDRVRAEARAALGDGVPGPEDLHRLTYTTMVVQEAMRLFPPVWILPRVAQQRDVVGGYTVSAGSDVLVCPYIMHRHPGLWEDPERFDPERFEPRQTADRPRYAYIPFGAGPRFCVGSNLGMMEAVFVTALVTRDLDLRTVAGHRAVAEPMLSLRMRGGLPMTVSTAR

SEQ ID NO: 17255 - protein, 366 aa, Solanum tuberosum
QMGLAENQLCFDLIQEWIVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESSNNFKVTKEALEEAYKKAQESNIKVKGLLINNPSNPLGTILDKETLKDILRFINDKNIHLVCDEIYAATAFCQPSFISISEVMNEVVGCNDDLVHIVYSLSKDLGFPGFRVGIIYSYNDVVVNIARQMSSFGLVSTQTQRLIASMLSDTIFVENFIAKSAMKLSQRHDLFTKGLGQVGITTLKSNAGLFIWMDLRRFLENSTFDNELKLWHIIINKVKLNVSPGCSFHCSEPGWFRVCFA

SEQ ID NO: 17256 - protein, 330 aa, Cryptococcus curvatus
MVNNTEYYKTLGLSKDASEADIKKAYRKESLKWHPDKNPGDKRATAEEKFKKVGEAYEVLSDPEKRKIYDQFGEEGLKGGMPAGGGGGGPGFSSFGAGGAAPASPSTPTDPNDIFNAFFSQMGSGGGGGGDEYASFGGGGFPGGGTRRRAGRGGMGGMGGMGGMGGMPGMGGMGGMGGMPGGYARPEPPTPVAEIERPLPLSLEELYKGGTKRLKITRHMRNGRTNEKILEVAYKPGWKAGTKVTFAGAGNEDEYGRGQNIKFVIQEKEHPRFNAQGDDLVVQVNLTLSQALLGPEGGGPITKQIEQLDGRRIDVSIPADTSSSPERRPS

SEQ ID NO: 17257 - protein, 143 aa, Chlamydomonas reinhardtii
LIYSVHAEQSSTIHLHRTLNMVKDLGCKAGVVLNPGTSLSTIEEVLDVVDLILIMSVNPGFGGQKFIESQVAKIRNLKRMCNEKGVNPWIEVDGGVTPENAYKVNSMTGANALVAGSAVFKAKSYRDAIHGIKVSKAPANVMA

SEQ ID NO: 17258 - protein, 1099 aa, Candida albicans
MLESLNRRNSIDSNQADNDNDNDNHSNDELSPSELYYSPSGSPPKSQLLLRKSSSPSSYSPIKSDLPNIYSHLRSNDSESPPQPSPKQQSSLSSSSSSSSSSNTKSSTTKNIFKKLLRINKSSDNIDESRSIVSNNGGSPMSDSTTVTSTLSTDTAPKRGKSIQRSQILHHTDSDSLYLENQIELRPEISKSIGNIKIPSIFTNDGMPLLKISHKSKKRILFWIDPSCFKFSWRMANSTTTTTSATTSATTSGLPQGITNTTALSNSAIISTPAIATSAIHRLSITNRTTHEFVLDDIKSIYIQNEGSGYREELNISQKLEKNWITIIYFNHKKNSLKSLHLITDNDHDFKKLISAIYNLKQLRSQLAKEFLIDLNELDENYVKMLLNKELLAGDNGNVDGNEVDIRKSHKHVREFLSFNDILKYSKRLNINVNTNHLQQIFDQVLLLSSATTEKPVSTPLFEKGLNFEQFKQFVSILKDRKDLQEIWDSLAQGKEVLQFDEIKNFIINIQKENFSDDDDNSTINLIFQKYCSNDNGWNKESLNEYLLSSYSTPYREITQTQTNYYDYPLNEYFISSSHNTYLTGRQVAGDSSVEGYIRTLQRGCRCVEIDIWNGDSNTTTTTVIGTKDDDDKNEYEPIVNHGRTFTKPISFANVIRAIKKFAFIVSPWPLILSLEIHCSPECQIKVVNILKDILGENMIIAPIDIDSVILPSPAELKHKFIIKVKKTTSFQNLIETENGSFTTSTTTTTTTTTTTTTATSLSEDNENNKSNSSSTSSFIIRRRKNKSPKIINELSNLGIYTQGIKFRNFSLPESKTFNHCFSLGEKSINRMIKDDDKKISLDKHNRRYLMRVYPSGTRLKSSNFNPLPYWSHGVQMVATNWQTYDLGQQLNEALFENKIFQGYVLKPSVLRKPTLKSSSSNVDTRTSLTTTNSKTIRFNFEIISGHQLPKFPKDDYKDQAINPYISFEIIGAQDVQWDNNDSSPIAPTTSSSPFIRTTKIIRENGFNPNFNTKFSGSIITTTNDLIFIKFVVYASTSLNYPDYGENFPIAILVTKLNYLKQGYRYIYLNDLLGEQLVYSSIFIKIEYDEDLLNEFINK

SEQ ID NO: 17259 - protein, 464 aa, Lozanella enantiophylla
GFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 17260 - protein, 401 aa, Zinnia elegans
MATTILPLILFISSLAIASSSPSRTPHAIVNEVHKSINASRRNLGYLSCGTGNPIDDCWRCDPNWANNRQRLADCAIGFGKNAMGGRNGRIYVVTDPGNDDPVNPVPGTLRYAVIQDEPLWIIFKRDMVIQLRQELVMNSHKTIDGRGVNVHIGNGPCITIHYASNIIIHGIHIHDCKQAGNGNIRNSPHHSGWWTQSDGDGISIFASKDIWIDHNSLSNCHDGLIDAIHGSTAITISNNYMTHHDKVMLLGHSDSYTQDKNMQVTIAFNHFGEGLVQRMPRCRHGYFHVVNNDYTHWEMYAIGGSASPTIYSQGNRFLAPNTRFDKEVTKHENAPESEWKNWNWRSEGDLMLNGAYFRESGGRAASSFARASSLSGRPSTLVASMTRSAGALVCRKGSRC

SEQ ID NO: 17261 - protein, 248 aa, Corynebacterium efficiens
MAIKVGVLGAKGRVGQTIVAAVNDTDDLELVAEVDHDDDLSLLVDSGAEVVVDFTTPNAVMGNLEFCINNGISAVVGTTGFDEDRLAQVRSWCASNEGVGVLIAPNFAISAVLTMVFARQAARFFESAEVIELHHPNKLDAPSGTAIHTAQGIAEARREAGMAAQPDATEQALDGSRGADVDGIPVHAVRMSGMVAHEAVIFGTQGQTLTIKQDSYDRNSFAPGVLVGIRNIAQHPGLTVGLEHYLDL

SEQ ID NO: 17262 - protein, 242 aa, Corynebacterium efficiens
MIKMTGVQKFFDDFQALTDINLEVPAGQVVVVLGPSGSGKSTLCRTINRLETIEEGTIEIDGKLLPEEGKDLAKIRADVGMVFQSFNLFPHLTIKDNVTLGPMKVRKMKKSEANEVAMKLLERVGIANQAEKYPAQLSGGQQQRVAIARALAMNPKIMLFDEPTSALDPEMVNEVLDVMASLAKEGMTMVCVTHEMGFARRAADRVLFMSDGAIVEDSDPETFFTNPQTDRAKDFLGKILAH

SEQ ID NO: 17263 - protein, 1566 aa, Ustilago maydis
MSAATPTSPGFPLTMGTGVMAAHFAAPSSNAGSPRSRPTTPLSAGLTPSGPTYDDLGRWDDADVASWLNAARLGHYASIFAEHDIRGSVILDVDQAALKEMGITMVKDRVRISAAIKLLNKRCADSAVARRPSVVSISPLLPLASHPLYAHEGEIEYLQHDHTADPSADGSGSNFGLNSMGMRRGQMRPPPLTLKQSTSRGMPGYASPAGSINQSQGFGLSAARGLTPGAARGSVWNTASSSSATSKPGTPDGALHRKVNSIGGVAAPLAVGASSSLSSSRHPYGHAVHSNRPSTATGASGYSNVPASQSLRSNHTSSSPTATSFGSNINAASARPSTATGAQSYTTNVPGTSSARDGYSPLTPISESNSLGNTPTTPSGIQQQQQSAGYAVGRGPFASSQRYAASSVPSQQQPSSGHTLRHVDSGEGYNLAGYQNPNPPTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGVGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHPSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKGGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAASASASASASPAVASTSPAPGDAETGSPTNGKSAVPPAGSTGGTPESILTVSIATARGNSTSTALSAADAAFSEEADS

SEQ ID NO: 17264 - protein, 389 aa, Schizosaccharomyces pombe
MGGIGKKRVKKRTHLKADPIQEAAIPKSMVIRSGASEVGRSLSLLTRDLRHMMEPHTAIRLKERKANKIKDYLTMAGPLGVTHLLVLSRTDNNANLRIIRAPRGPSLHFRIHEYMLNKDVRRLQKNPKSPTTEFLTPPLLVMNHFNQNSSKDSPHEALLTTTFQNMFPPISVQHTNINSVKRVLLLNRRDDGYIDLRHFIISTKPVGISRPIRHLLKGEKKDSDIPDLHNVRDISDYVLHGDGISGAASDSEIEEDATVEIDRPVPTKTEENLLSASQLLKPKQQAIKLIEIGPRMTLELIKITEDAMGGKVLYHSHVHKSKEEIKQQDNFHEQSRALKEKRKKEQDENVRRKRENKKRRKDQKKEGITSSNKNDDSGNEGSSAYSDTE

SEQ ID NO: 17265 - protein, 337 aa, Fragaria vesca
  misc_feature (33)..(33): Xaa can be any naturally occurring amino acid
NLCPLNFTFAIHRLTMAAAPSESIPSVNKAWVXSEYGKTSDVLKFDPSVAVPEIKEDQVLIKVVAASLNPVDFKRALGYFKDTDSPLPTIPGYYVAGVVVKVGSQVTKFKVGDEVYGDLNETALVNPTRFGSLAEYTAADERVLAHKPKNLSFIEAASLPLAIETAHEGLERAELSAGKSVLVLGGAGGVGTHIIQLAKHVFGASKVAATASTKKLDLLRTLGADLAIDYTKENFEDLPEKFDVVYDAVGETDKAVKAVKEGGKVVTIVGPATPPAILFVLTSKGSVLEKLKPYLESGKVKPVLDPTSPYPFTKVVEAFGYLESSRATGKVVVYPIP

SEQ ID NO: 17266 - protein, 415 aa, Magnaporthe grisea
MSDLQGRKIFKVFNQDFIVDERYTVTKELGQGAYGIVCAAVNNQTSEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMAKKPFPTLFPNANPDALDLLDRMLAFDPSSRISVEQALEHPYLHIWHDASDEPDCPTTFNFDFEVVEDVGEMRKMILDEVYRFRQLVRTAPGAGGHGAPHAPQVPIPAGAGQGQWKAEDPRPQEYVGQMNDLEAELAGGLDQRR

SEQ ID NO: 17267 - protein, 466 aa, Augea capensis
SVGFKAGVKDYKLTYYTPEYETKDTDILAAFRVTPQPGVPPEEAGAAVAAESSTGTWTTVWTDGLTNLDRYKGRCYGLEAVPGEDNQYIAYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFCAEGIYKAQAETGEIKGHYLNATAGTCEEMMKRAACARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNVIIREASKWSPELAAACEVWKEIKFEFPAMDTL

SEQ ID NO: 17268 - protein, 466 aa, Fagonia indica
SVGFKAGVKDYKLNYYTPDYETKDTDILAAFRVSPQPGVPPEEAGAAVAAESSTGTWTAVWTDGLTSLDRYKGRCYNLEAVPGEDNQYIAYVAYPLDLFEEGSVTNMLTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCTEAIFKAQAETGEIKGHYLNATAGTCEEMMKRAACARELGVPIIMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNIIIREASKWSPELAAACEVWKEIKFEFPAMDTL

SEQ ID NO: 17269 - protein, 466 aa, Neoluederitzia sericeocarpa
SVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPNSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEIIREASKWSPELAAACEVWKEIKFEFQAMDTL

SEQ ID NO: 17270 - protein, 466 aa, Seetzenia lanata
SVGFKAGVKEYKLTYYTPDYQTKDTDILAAFRVTPQPGVPPEEAGAAVAAESSTGTWTTVWTDGLTSLDRYKGRCYDIEPVPGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLASEGNEIIREASKWSPELAAACEVWKEIKFEFAAMDTL

SEQ ID NO: 17271 - protein, 466 aa, Sisyndite spartea
SVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEIIREASKWSPELAAACEVWKEIKFEFEAMDTL

SEQ ID NO: 17272 - protein, 467 aa, Zygophyllum fabago
SVGFKAGVKDYKLTYYTPDYQTKDTDILAAFRVTPQPGVPPEEAGAAVAAESSTGTWTTVWTDGLTNLDRYKGRCYGLEAVPGEENQYIAYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFCAEAIFKAQAETGEIKGHYLNATAGTCEEMMKRAACARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNTIIREACKWSPELAAASEVWKEIKFEFPAMDTLD

SEQ ID NO: 17273 - protein, 466 aa, Zygophyllum simplex
SVGFKAGVKDYKLTYYTPDYETKDTDILAAFRVTPQPGVPPEEAGAAVAAESSTGTWTTVWTDGLTNLDRYKGRCYNLEAVPGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAACARELGVPIVMHDYLTGGFTANTTLSHYCRDNGLLLHIHRAMHAVIDRQNNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNTIIREACKWSPELAAACEVWKEIKFEFPAMDTL

SEQ ID NO: 17274 - protein, 3488 aa, Planktothrix agardhii
MVQNTDYKKLIATTLTKMEVMQARITELETGQREPIAVVGMGCRFPGGITSPEEYWNYCQAGLDAITEVPKSRWDSSKFYAKEPTPGKINTAYCGFIQQDITEFDARFFSISSREATSMDPQQRLLLEVTWEALENANLPPNNLANNTVGVFVGITSVDNAITVYNSSYDQIDSFFGTGNALSAAAGRLSYFFNLRGPCLSIDAACASSLVAVHQAIRSLRNRECEVALVAGVNLILNPAITINLSQSGMLSPDGRCKTFDASANGYGRGEGCGVLVLKTLSEAQKKGDRILAILRGSAVNHNGAAAGLTVPSGPAQQELLRQAIADARITPEDVGYIEAHGTGTSLGDPIEMNAIASVYGKRSQPLYVGSVKTNIGHLEAAAGMAGIIKTILVLQKGEIPAHLHFQTPNPLINWQDNSIKIPTQTIPWPNSNKIPMAGVSSFGFSGTNAHVIVEKAPDIKITEIKQPLPSHLLTISAHNKTALQELARRFSTRLESDPEIGDICYSVAVGRAKLSERLAIVANTLPELQQRLVAFADQNPLDNLTFYQRFTEEKQPKVVFLFTGQGACYPGMGDQLYQTEPTFRQYIDQCAEILARYLEYPLPEILFGKHTDLLNQTAYAQPAIFALEYAVAMLWKSWGITPSLLIGHSVGEYVAACIAGVFSLEAGLALIVKRGQLMQTTKIGKMASIFADEATVISLIQNYSNTVAIAAINHPQQIVISGESASIEEIIINCKQQKIAAQYLSVTQAFHSPLMESILNEFEQEAPGQISYHRPQILLLSGIDGKILENAPDASYWRQQCRQPVQFLASLNTALNKGYNLFLEVGSRPILAEQGRRYQDGAIWLSSLNRGLDIWQTILSALGQLYLNGVYFNPEKFNQNYGYKQVRLPNYPFQRKRFQFQPNIVEETTQITEIYPEPETNKITELKVQNMQKHQLEIRQQLKSILALLLKENQNDIRDDETLLNLGADSIILTDFSRKVEEKFKVKVKIDQLFTDLQTIADIAEYIYNSIEPKNLEPSSEKTKLNQAEIVNFDPEINNYIEVISQLQPIATAYIIKALETLGKKLNPGETWTTESIKQTLPIAPKYQVLVTRYLQDLEQANIIQNQGNIWTVKNLPASFSLPEAIENLQKTCPSAKPELEMLQRCGENLAEVLKGNIDPLTLIFPEGSVTHAESIYGNSPVSRLMNQRVAEAINLTLNNFSPSINPYKIIEIGGGTGATSETILNNLNLNRVSYSFSELSPFLLNQARQKFQSKYNLNFHQLDIEKSPISQGISSHSYHIVVAANVLHATQNITETLTNIRELLLPGGYLILLETVENNSWLNLTFGLTPGWWRFQDKELRSDTPLLSGESWCSVLKRCGFATANSFSKQNNISIYNGQELIIACAAAEILPIPQTPKATQFQAVTSGKEALMMAQLQSLKDLKDLHEKTIIKQLEILQSVGITPNIITEKPIIQTEIIPSQNYQIETVSPAQREQTKLPQKPSSPSLNPLALKLNESKSLTEKQQDFINNLQTIYNQKTAKSKAYSQNSRQTMVDVKPTIDFRMTLKEFQYPIVSESAQGACFRDIDGNDYIDLAMGFGVNFFGHSPDFVIAAVQEQMQQGIGLGMQSNLAAETAALISEMAGVERVAFSNTGTEAIMAAVRIARSRTKRPKIVIFSGSYHGTFDGILARVGEDSTSIPVSLGTPSGMVEDVIVLSYGVEESLEIIAAHSDDLAAVLVEPVQSRKPDLQPQEFLQKLRKLTQEKGIALIFDEIITGFRIAPGGAQQWFNIEADIVIYGKAIGGGLPISMICGKADFSDTVDGGFWKYGDDSHPQTELTAFGGTFCRHPLALAACRAVLLYLKEQSPTIQERVNQLTQRLATEVNQFFQEIGIPIRIVNFGSLFRFEPFGAYSLFLQPIELPLFYYLLNLKGIYTWEKRVCFLSTCHTNEDIDKVIATVKSAIIELQQGGFFENAKLLKVNKQDKNVEREDEDGRENLNPINQQFPTSEAQRQLWLLAELDRNASASYNVTASLELRGSLDISALQEAINQVINRHESLRTQILEQGEVQEVINSVKIQLTLINLNDEQNPQAMALGLRSQFSKKPFDLSIAPLFDVILIRLNSDHYLLSLKTHHIVVDGWSLGLILNEIGQLYSTQIGATTDPLEFPMQFRQYLALREQEAQSPQMLEHRDFWLKTYQGEIPAFELPTDFPRPAIKTYTGGQESKIVTPELWQNLQTVGRQNQATLFMTMFAAYTAFLSRISGHNDLVIGIPISGRQIEGSDQLVGFCSQFLPIRIKVDITHSFVEHLQRTKQTLIAAFRHQSYTLEDLLAALQLQRDFSRSPLISVSFNIDPSLTLPDFEGLKVSLPPEPIGYTPFDVGFNFIEVNNNLIIYCNYNTELFKQETIKQFLESFEILLDGVINNANSWLHQLPLLTKLQRENLLAELIGETRELPENATIIDDFVSQVNSTPNAPALVCGETTLTYQELNQKVNRLTHYLQHQYQLGAGKIMGLMMGRNQNLIISILAIFKTGATYVPIDAEYPNNRIDFIIKDSGCHVCLTESNLISRIPQEIETICLDKIDNILAKYGNQEPNIPPDSSQIAYIFYTSGSTGNPKGVMGRHLSILNVIQSLRLTFNLDKYPEWRYIFTAAVTHDPSIRNIFLPLTIGAPLYIYEVKYIGHLVSFLQENQINALHTTPSIYREILALLEPGETISSLKYISVGGEKLDRETALALRQLFPGEIVSNVYGSTETCVGVSQYKINENLDTDVPLGQVFHNNRLFLLDEFNNPVPLHIVGEICVEGAALASGYHNLPQITKEKFKPGFFDQKTTMFRTGDLGKQTAPGVIEFMGRKDNQVKVNGYRIDPEEIEYQLNRYPQIERAIILPISVNNQTQLSAYCQTDKQIEISEIREFLANFLPVYMIPSYFIFLKQFPLTKHGKLDLNSMIALNETGKSTQVNYVAPRNNLESNLVRIWEKILTKHPIGIFDNFFEIGGHSLMLSRIVTHVHKELNVSVKLADFFKVPTIAGLAVLVSKTEYDYQEPIPTIPLQKSYPMSHGQRRLWALEFLDQNHNAYGMPSVYQFNGNLNIAAFENAFQQLIQRHEILRTTFSLIDNQPRQVVHNQMNFGIKQIDLTNYLETEQAKLIAEAISHNAKTTFDLEVGPLLRVNLLKLSQENYIVLFNMHHIISDGWSAGVLIKDFLGHYHTYRQQNSELLPPLKIHYKDYTDWQENQLKTSKLQAQRDYWLTKLTPAPQHLNLPFDYPRPAVQSFQGNTVIWKPNSELIEHFQILIKDKEASLFMGLLTLVKSFLFRYTEQNEITVGSPIAGRNHPDLESQIGFYVNTLVLRDQIRADDSFLNVLTTVKTTTLEAYENQEYPFDKIVSDLNLPRDPSRNTLFDVAVALQNNQNVDLALEGITVNSIDPEMTTAKFDLEFIFVEEGELYLKLIYNTDIFINERILLMINLLENLMEQVIKYPDKPLIKLSLESSNFGQEYSDLFAEDFNF

SEQ ID NO: 17275 - protein, 474 aa, Solanum tuberosum
DLFLLSFATILTIIIYVFFKYFFAKPKEKIPPGTFGWPIIGETIQFFISLYYGMVHEFVQERTKKYNSHVFKTSLLGQKVVIFSGPAANKFIFTQGNKLIIGWRPKSVQKLFASTSFVPIEHDTKRAHNVISYLLNSQNVERLISTMDNMSHLHLKNHWKGKNEVIVYDLVKLFTFSLSIRAFIGIKESDKILNLYEKFKIFTYGLLAVDINLPGTTFYKAMKAGNELRKQMKVIIKQRRAELSENPNLSKVDVLTQMINEQDEDGKYMTEVEIEDKVFGFIIGSYDTTATTITLTMKYLQQMPEFFNEIIQEQNEISMQMMPRKELCWNDIQKMKKTWSFVNEVLRNTPVVQGIFREVIEDFTYEDFYIPKGWKIYLSFGATQKNGEYFPNPTKFDPSRFEGNGQVPYTSVPFGGGHRMCPGKEFARILILVFLHHLLKNFRWEPKVPSEKILYPFFLLAIPTDGYPITLSAV

SEQ ID NO: 17276 - protein, 377 aa, Arabidopsis thaliana
MEAKIVKVSDSSYKDGLGKKRKHPGNYTPYDSGRSYAKLQWVLSPNSSTQKLEKRRNLDGENKVIVSENHVEKSLVRYFSYYKKTGVPKRVMFHENGEWIDLPDHILCDIRNDLEAKRATIEFNWCGRHFLLDFLHMYRLDLETGVKTQLAWIDIAGKCFFPETFDTLERDGCHHIRGEDPEQHDQREIKLHIEIDVNSGELPRLNLNVVTDESGDNMDDFQAVQRSSNGPNDEASEDSCSRELDDAVEKWDKTETDRFSGVKPAEEELDKDAVKQMFALGAATLGHVESLDVYQFSSEIAKARLSLFQKQADITKKHRGDANIRYAWVPAKKEVLSAVMMHGLGVGGAFIKKSMYGVGVHAANCPYFREYSSYYSE

SEQ ID NO: 17277 - protein, 1542 aa, Candida glabrata
MNTPDDSSVSSVDSHQPYMGFDDNVEKRIRELARSLTQQSLTSSNRSVNKEAPADGSAPLDRVSTRASSIFSADFKGVNPVFSDEEEDDYDARLDPNSDEFSSKAWVQNMAKITTGDPEFYKPYSIGCCWKDLSASGESADVSYQSTFLNLPVKLLNAVWRKARPARESDTFRILKPMDGLLKPGELLVVLGRPGSGCTTLLKSISSTTHGFQISKDSVISYNGLTPNEIKKHYRGEVVYNAEADIHLPHLTVYQTLVTVARLKTPQNRVKGVTREDFANHVTDVAMATYGLSHTRDTKVGNDLVRGVSGGERKRVSIAEVWICGSKFQCWDNATRGLDSATALEFVRALKTQAHIAKNVATVAIYQCSQDAYNLFNKVSVLYEGYQIYFGDAQHAKVYFQKMGYFCPKRQTIPDFLTSITSPAERRINKEYLDKGIQVPQTPLDMVEYWHNSEEYKQLREEIDETLAHQSEDDKEEIKEAHIAKQSKRARPSSPYVVSYMMQVKYILIRNFWRIKNSASVTLFQVFGNSAMAFILGSMFYKIQKGSSADTFYFRGAAMFFAILFNAFSSLLEIFSLYEARPITEKHRTYSLYHPSADAFASVISEIPPKIVTAILFNIIFYFLVNFRRDAGRFFFYFLINVIAVFAMSHLFRCVGSLTKTLQEAMVPASMLLLALSMYTGFAIPRTKMLGWSKWIWYINPLAYLFESLMVNEFHDRRFPCNTYIPRGGAYNDVTGTERVCASVGARPGNDYVLGDDFLKESYDYENKHKWRGFGVGMAYVIFFFFVYLILCEFNEGAKQKGEMLVFPHSVVKRMKKEGKIRDKTKMHTDKNDIENNSDSITSNATNEKNMLQDTYDENADSESITSGSRGGSPQVGLSKSEAIFHWQNLCYDVPIKTEVRRILNNVDGWVKPGTLTALMGASGAGKTTLLDCLAERTTMGVITGDVMVNGRPRDTSFSRSIGYCQQQDLHLKTATVRESLRFSAYLRQPSSVSIEEKNEYVEAVIKILEMETYADAVVGVPGEGLNVEQRKRLTIGVELAAKPKLLVFLDEPTSGLDSQTAWATCQLMKKLANHGQAILCTIHQPSAMLMQEFDRLLFLQKGGQTVYFGDLGKGCKTMIKYFEDHGAHKCPPDANPAEWMLEVVGAAPGSHANQDYHEVWRNSEQFKQVKQELEQMEKELSQKELDNDEDANKEFATSLWYQFQLVCVRLFQQYWRTPDYLWSKYILTIFNQLFIGFTFFKADHTLQGLQNQMLSIFMYTVIFNPLLQQYLPTFVQQRDLYEARERPSRTFSWKAFILAQIVVEVPWNIVAGTLAYCIYYYSVGFYANASQAHQLHERGALFWLFSIAFYVYVGSLGLFVISFNEVAETAAHIGSLMFTMALSFCGVMATPDAMPRFWIFMYRVSPLTYLIDALLSTGVANVDIRCSNTELVTFTPPQGLTCGQYMTPYLNVAGTGYLTDPSATDECHFCQFSYTNDFLATVSSKYYRRWRNYGIFICFIVFDYVAGIFLYWLARVPKTNGKIAKNGKTAKVNFIRRLIPF

SEQ ID NO: 17278 - protein, 118 aa, Cicer arietinum
VAPGYTKGDGLGAEIIGTFVLVYTVFSATDAKRSARDSHVPILAPLPIGFAVFLVHLATIPITGTGINPARSLGAAIIFNKDLGWDDQWIFWVGPFIGAALAALYHQVVIRAIPFKSS

SEQ ID NO: 17279 - protein, 471 aa, Penaea mucronata
  misc_feature (415)..(415): Xaa can be any naturally occurring amino acid
TETKASVGFKAGVKDYKLTYYTPDYETKETDILAAFRVTPQPGVPPEEAGAAVAAESSTGTWTTVWTDGLTSLDRYKGRCYHIEPVAGDENQYICYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYITGGFTANTSLAHYCRDNGLLLHIHRAMHAVIDRQKNHGMHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVXNRVALEACVQARNEGRDLAREGNEIIREASKWSPELAAACEVWKEIKFEFEAMDTL

SEQ ID NO: 17280 - protein, 484 aa, Actinobacillus actinomycetemcomitans
MSVKGDIGVIGLAVMGQNLILNMNDHGFKVVAYNRTTSKVDEFLEGAAKGTNIIGAYSLEDLANKLEKPRKVMLMVRAGEVVDHFIDALLPHLEAGDIIIDGGNSNYPDTNRRVAALREKGIRFIGTGVSGGEEGARHGPSIMPGGNEEAWQFVKPVLQAISAKTEQGEPCCDWVGKDGAGHFVKMVHNGIEYGDMQLICEAYQFLKEGVGLSDDELQATFNEWRNTELDSYLIDITADILGYKDADGSRLVDKVLDTAGQKGTGKWTGINALDFGIPLTLITESVFARCVSAFKDQRVAASKLFHKTIGKVEGDKKVWIEAVRKALLASKIISYAQGFMLIREASEHFNWNINYGNTALLWREGCIIRSRFLGNIRDAYEANPDLIFLGSDSYFKGILENAMSDWRKVVAKSIEVGIPMPCMASAITFLDGYTSARLPANLLQAQRDYFGAHTYERTDKPRGEFFHTNWTGRGGNTASTTYDV

SEQ ID NO: 17281 - protein, 414 aa, Issatchenkia orientalis
MPWVGSAVVYGMQPYEFFENCRKQHGDVFSFLLLGKVMTVYLGPKGHEFVLNAKLSDVSAEDAYTHLTTPVFGKGVIYDCPNWKLMEQKKFAKVALTKESFIRYVPLIKDEMLKYFNANFRGDSGKTDVLKSQSEMTLFTASRSLFGDALRNRLDASYAEMYSDLDKGFTPLNFVFSYLPLPNYWKRDAAHKNISNTYLDLINTKRAGGEIKNEDLVDALLKNSVYKDGTRMTDEELAHLMIGVLMGGQHTSSATSAWFLLHLGEKPQLQEEIYREIQSVLGENFERELTYDDLQKLDLVNATIKETLRLHMPLHSIFRKVTRDLPVPNTSYIVPKGHYVLISPGYTMLSERYFPNASEFQPHRWDEIKSIDGGISFGAEGENAKETVDYGFGKISKGVASPYLPFGGGRHRCT

SEQ ID NO: 17282 - protein, 505 aa, Emericella nidulans
MPSFSLLTGHFGALKQTIDGMPPNATLHSIMLKLSQKFRSGMFYINMWPFSGTWLVVATPSGAAQIQSLNLSKPNILRRPLETITGGPSLMSMHGETWKRWRALFNPGFNPNYLIGLAPLIADEVVVFCEQLRQKARTGTVFQLEPLTLRLTVDTICSVTLYVVTPVGRWPFLTPDLEIHSSTTKLRTTPLPQRCNGRSNGPRLELPSTPLRRYLTVRPLVMWYNNRLMNRFIDQEVDRAYREQSGRQSKSVISLALRDYMKEKDGSLEDFKRRVAPQLRVFLFAGRDTTSSTLLYAFYLLSRHPEALAKVRLEHDQVFGPYHQQVHEKIHQDAKLLNQLPYTTAVLKETLRLFPPSASMREGGPGVEITDDNGQVYPTAGCNVWTLTVALHHNSAHWAEAESFIPERWLVGSDHPLYPAKGAWRAFEFGPRSCIGQTLAMLELRVALAMTLREFDIAPAYDKWDHIYPNDAVKEFNGHRAYQAEKGGGGAHPADGMPCLVTFRV

SEQ ID NO: 17283 - protein, 181 aa, Coffea arabica
MASSMISSAAVATTTRASPAQASMVAPFNGLKAASSFPISKKSVDITSLATNGGRVQCMQVWPPRGLKKYETLSYLPDLTDEQLLKEIDYLIRSGWVPCLEFELEKGFVYREYHRSPGYYDGRYWTMWKLPMYGCTDATQVLNEVGECLKEYPNCWVRIIGFDNVRQVQCISFIAAKPKGF

SEQ ID NO: 17284 - protein, 376 aa, Streptomyces roseochromogenes subsp. oscitans
MDFDLSPQQQQRVDHIRAGAGKLPSAKPDGVAGKDSWLAAAELGMTGLCLPTEHGGGGLGALDTALCLEAFCAGGADTGLAFGIAAHLLACGTVLTDHAGDPVRAELLRGLTSGTVIAANAMTEDDAGSDLSRLATTAVADSDSYVLNGKKSFVSNAPLADVFITYAATTPSAGYLGMSAFAVPRTLPGLRINSPLAKMGLNGCAAAQVEFTDCKVPGRYLLGPENQGNSIFQRSMIWERACLPAIYLGAMEVQLAQCVDHAQSRRQFGRSIGTFQAISHRLATMKLRLETSRLLLYRACWYLDQGRSAVEAVALAKTAVAEAAVANALDAVQVFGARGYLAADGIGQQLQNAIPLNIFSGTTEIQREVVARSMGL

SEQ ID NO: 17285 - protein, 449 aa, Streptococcus equi subsp. zooepidemicus
MSHITFDYSKVLEQFAGQHEIDFLQGQVTEADQALRQGTGPGSDFLGWLELPENYDKEEFARILKAAEKIKADSDVLVVIGIGGSYLGAKAAIDFLNSHFANLQTAKERKAPQILYAGNSISSSYLADLVDYVQDKDFSVNVISKSGTTTEPAIAFRVFKELLVKKYGQEEANKRIYATTDKVKGAVKVEADANHWETFVVPDNVGGRFSVLTAVGLLPIAASGADITALMEGANAARKDLSSDKISENIAYQYAVVRNILYRKGYVTEILANYEPSLQYFSEWWKQLAGESEGKDQKGIYPTSANFSTDLHSLGQFIQEGYRNLFETVIRVDKPRQNVIIPEMAEDLDGLGYLQGKDVDFVNKKATDGVLLAHTDGGVPNMFITLPEQDEFTLGYTIYFFELAIALSGYLNGVNPFDQPGVEAYKKNMFALLGKPGFEELGAALNARL

SEQ ID NO: 17286 - protein, 156 aa, Phaseolus vulgaris
MDDGGGSKLSGIRQIVRLKEMFQKWQTVTLGSKESNHDSDVARPGGIPPMINKRLTNVLYCDSDEDSCYSPQPPHDVPKGYLAVYVGPELRRFIIPTSYLSHSLFKVLLEKAAEEFGFDQSGGLTIPCEIETFKYLLNCMENHDDSSAGNTGTVEE

SEQ ID NO: 17287 - protein, 469 aa, Streptomyces filamentosus
MFQNADEVQKYVADNDVKFIDVRFCDLPGVMQHFTIPAATFDPAEELAFDGSSIRGFQAIHESDMALRADLSTARVDPFRRDKTININFFIHDPITGEQYSRDPRNIAKKAEAYLASTGIADTAYFGPEAEFYVFDNVRFQTSANESFYHIDSEAGAWNTGAVENNRGYKVRYKGGYFPAPPVDHFADLRAEISLELDKNGLQVERQHHEVGTAGQAEINYKFNTLLAAADDLMLFKYIVKNVAWRNGKTATFMPKPIFGDNGSGMHVHQSLWQGGSPLFYDEQGYAGLSDTARYYIGGILKHAPSLLAFTNPTVNSYHRLVPGFEAPVNMVYSQRNRSAAMRIPITGSNPKAKRVEFRAPDPSSNPYLAFSALLMAGLDGVKNKIEPAEPIDKDLYELAPEEHANVQQVPTSLPAVLDALEADNEYLQAGGVFTSDLIETWIDYKRTNEIAPIQLRPHPHEFELYFDI

SEQ ID NO: 17288 - protein, 215 aa, Lycopersicon esculentum
HEAARKLRENQSTTSVQTEDLVEDPAQESADYHRNLGLQMVSGLSNELENVRKASLIDGENLSAAVMKLNHSLMKTKEFLDTDMRSLEDESKFRDTLTNFIQHAEQDITCILEEEKKIMSLVKSTGDYFHGNSGKDEGLRLFSVVSDFLIMLDKACTVVRNSTKLPVKIPKKGTLTSPSQESCPESLQDIRKQLFPAIQERQMHYSSSDDESSSP

SEQ ID NO: 17289 - protein, 418 aa, Ricinus communis
NAQSHDNVVSIMLDTKGPEVRSGDVPQPMLKEGQEFNPTIRRGVSTQDTVSVNYDDFVNDVVVGDILLVDGGMMSLAVKSKTSDLVKCVVVDGGELKSRRHLNVRGKSARLPSITDKDWGDIKFGVDNQVDFYAVSFVKDAKVVHELKEYLKRCNADIHVIVKIESADSIPNLHSIISASDGAMVARGDLGAELPIEEVPLLQEDIIRRCHSMQKPVIVATNMLESMINHPTPTRAEVSDIAIAVREGADAVMLSGETAHGKYPLKAVRVMHTVALRTESSSPVNTTPPAQGAYKGHMGEMFAFHATIMANTLNTPIIVFTRTGSMAVLLSHYQPASTIFAFTNEERIKQRLSLYRGVMPIYMEFSSDAEETFSRALQLLLNKGLLVEGEHVTLVQSGAQPIWRQESTHHIQVRKVQN

SEQ ID NO: 17290 - protein, 269 aa, Pseudomonas putida KT2440
MSRLEQRFAELKAEGRSALVTFVTAGDPGYDASLQILKGLPAAGADVIELGMPFTDPMADGVAIQLATLRALEAGQTLVKTLQMVREFRVDNQTTPIVLMGYYNPIHRFGVDTFVTQAKEAGVDGLIIVDLPPEHDAELATPAQAAGIDFIRLTTPTTDDARLPRVLERSSGFVYYVSVAGVTGAGSATTEHVTEAIARLRRHTDLPISVGFGIRTPEQAANIARLADGVVVGSALVDKIAQAKSADQAVTDVLSLCSALAEGVRGARR

SEQ ID NO: 17291 - protein, 263 aa, Pseudomonas putida KT2440
MSGQNCVIEARGICNRFGRQVVHENLDLDLYRGEILAVVGGSGSGKSVLLRSIIGLRRPNEGQIKVLGQDLTGLREEQRSLVERRFGVLFQKGALFSSLTVTENVALPLIEHAGLSRSDAEHLAGVKLALAGLPISAADKYPASLSGGMIKRAALARALALDPDILFLDEPTAGLDPIGAAAFDQLILTLRDALGLSVFLITHDLDTLYTITDRIAVLSQKKVLVAGPLAEVEKTNDTWIQEYFHGPRGRAAEQAATRAGQER

SEQ ID NO: 17292 - protein, 393 aa, Pseudomonas putida KT2440
MVGKASFNWIDPLLLDQQLTEEERMVRDSAYQFAQDKLAPRVLEAFRHEQTDPAIFREMGEVGLLGATIPEQYGGSGLNYVCYGLIAREVERIDSGYRSMMSVQSSLVMVPINEFGTEAQKQKYLPKLASGEWIGCFGLTEPNHGSDPGSMITRARKVDGGYRLTGSKMWITNSPIADVFVVWAKDDAGDIRGFVLEKGWQGLSAPAIHGKVGLRASITGEIVMDNVFVPEENIFPDVRGLKGPFTCLNSARYGISWGALGAAEACWHTARQYTLDRQQFGRPLAANQLIQKKLADMQTEITLALQGCLRLGRMKDEGTAAVEITSIMKRNSCGKALDIARMARDMLGGNGISDEFGVARHLVNLEVVNTYEGTHDVHALILGRAQTGIQAFY

SEQ ID NO: 17293 - protein, 480 aa, Pseudomonas putida KT2440
MQLKDAQLFRQQAYINGEWLDADNGQTIKVTNPATGEVIGTVPKMGTAETRRAIEAADKALPAWRALTAKERSAKLRRWFELMIENQDDLARLMTTEQGKPLAEAKGEIAYAASFIEWFAEEAKRIYGDTIPGHQPDKRLIVIKQPIGVTAAITPWNFPAAMITRKAGPALAAGCTMVLKPASQTPYSALALVELAHRAGIPAGVLSVVTGSAGEVGGELTGNSLVRKLSFTGSTEIGRQLMEECAKDIKKVSLELGGNAPFIVFDDADLDKAVEGAIISKYRNNGQTCVCANRIYVQDGVYDAFAEKLAAAVAKLKIGNGLEEGTTTGPLIDGKAVAKVQEHIEDAVSKGAKVLSGGKLIEGNFFEPTILVDVPKTAAVAKEETFGPLAPLFRFKDEAEVIAMSNDTEFGLASYFYARDMSRVFRVAEALEYGMVGINTGLISNEVAPFGGIKASGLGREGSKYGIEDYLEIKYLCISV

SEQ ID NO: 17294 - protein, 425 aa, Pseudomonas putida KT2440; identical to SEQ ID NO: 460

SEQ ID NO: 17295 - protein, 252 aa, Pseudomonas putida KT2440
MIEVKGLTKRFKGQTVLNGIDLTVQPGEVVAIIGPSGSGKTTFLRCLNLLETPDAGQIQIGAISIDANRPLGGQQSAIRRLRQQAGFVFQNFNLFPHRTALENVIEGPVIVKKTPREQAIELGRRLLAKVGLAGKEDAYPRRLSGGQQQRVAIARALAMEPEVILFDEPTSALDPELVGEVLATIRGLAEEKRTMIIVTHEMSFARDVANRVIFFDKGVIVEQGEAKALFAAPKEERTRQFLRKFLGTAASE

SEQ ID NO: 17296 - protein, 257 aa, Pseudomonas putida KT2440
MAQATPALEIRNLHKRYGEQEILKGISLTARDGDVISILGSSGSGKSTLLRCINLLENPHQGEILVAGEALKLKAAKNGDLIAADNRQINRVRSEIGFVFQNFNLWPHMSILDNIIEAPRRVLGQSKAEAIEAAEALLNKVGIYDKRHSYPAQLSGGQQQRAAIARTLAMKPKVILFDEPTSALDPEMVQEVLNVIRALAEEGRTMLLVTHEMSFARHVSSEVVFLHQGLVEEQGSPQQVFENPTSARCKQFMSSHR

SEQ ID NO: 17297 - protein, 461 aa, Pseudomonas putida KT2440
MSGNNSNDLAQGLKQRHVTMLSIAGVIGAGLFVGSGHAIAAAGPAVLLAYAAAGTLVVLVMRMLGEMAVASPDTGSFSTYADRAIGRWAGFTIGWLYWWFWVLVIPLEANAAAAILHAWFPAVDLWAFSLIITLALTLTNLCSVKNYGEFEFWFALLKVLAIIGFIAVGCAALFGFVPSSQVSGTSHLFDTQGFMPNGLGAVLAAMLTTMFSFMGTEIVTIAAAESKDPGKQISRATNSVIWRICLFYLVSIFLVVALVPWNDPALAETGSYQTVLSRIGVPNAKLIVDIVVLIAVTSCLNSALYTSSRMLFSLSKRGDAPAIAQRTTKAATPHVAVLLSTAAAFLCVFANFVAPAQVFEFLLASSGAIALLVYLVIAVSQLRMRAQREARGEKITFKMWLFPGLTWATIAFIVAILVVMALREDHRAEIIATALLSIGVVAAGLLVHRKREAAGRAALDS

SEQ ID NO: 17298 - protein, 426 aa, Pseudomonas putida KT2440
MNLFNLRRSAPAAAAEPKRAPVIVPHASEQSPERLMPGTERAAQVFVRGQGSWLWDNEGHAYLDFTQGGAVNSLGHSPSVLVKALGNQAQALINPGSGFHNRGLLGLVNRLCQSTGSDQAYLLNSGAEACEGAIKLARKWGQLHRNGAYHIITASQACHGRSLGALSASDPLPCNRCEPGLPGFSKVPFNDLAALHAEVDSRTVAIMLEPIQGEAGVIPATQEYLKGVETLCRELGILLILDEVQTGIGRCGALLAEELYGVRADIITLGKGLGGGVPLAALLARGKACCAEPGELEGSHHGNALMCAAGLAVLDSVLEPGFLAQVQDNGRHLREGLSRLTGRYGQGEVRGHGLLWALQLKENLARELVAAALHEGLLLNAPQVDVVRFSPALTVSKGNIDEMLLRLARAFARLHAQQQARREMPA

SEQ ID NO: 17299 - protein, 374 aa, Pseudomonas putida KT2440
MSEAKSNAATGETLVSFRGVQKSYDGESLIVKDLNLDIRKGEFLTLLGPSGSGKTTSLMMLAGFETPTAGEIQLGGRSINNVPPHKRDIGMVFQNYALFPHMTVAENLAFPLTVRNLSKTDISERVKRVLNMVQLDAFAKRYPGQLSGGQQQRVALARALVFEPQLVLMDEPLGALDKQLREHMQMEIKHIHQRLGVTVVYVTHDQGEALTMSDRVAVFHQGEIQQIADPRTLYEEPCNTFVANFIGENNRISGTLLASDGKRCQVQLPRGERVEALAVNVGQAGEPVTLSIRPERVRLNGHSESCVNRFSGRVAEFIYLGDHVRVRLEVCGKGDFFVKQPIAELDPALAVGDVVPLGWEVEHARALDPIAEAH

SEQ ID NO: 17300 - protein, 255 aa, Pseudomonas putida KT2440
MRWSTPIDTNQPSSLSLSYNARHREFANRCAMQPYAIAPSILSADFARLGEDVDKVLAAGADIVHFDVMDNHYVPNLTIGPMVCTALRKYGVTAPIDVHLMVSPVDRIIGDFIEAGATYITFHPEATQHIDRSLQLIKDGGCKAGLVFNPATSLDALKYVMDKIDMVLLMSVNPGFGGQKFIPGTLDKLREARALIDASGRDIRLEIDGGVNVNNIREIAAAGADTFVAGSAIFNAPDYQEVIAKMRAELALARP

SEQ ID NO: 17301 - protein, 482 aa, Pseudomonas putida KT2440
MPSEHSAGSPAGSSVDFEKVGSDYFQQRELKKGAAGWVLLVGLGVAYVISGDYAGWNFGLAQGGWGGMFLATLLMATMYLCMCFSLAELSSMIPTAGGGYGFARSAFGPWGGFLTGTAILIEYAIAPAAIAVFIGAYCQSLFGIGGWMIYLAFYIVFISIHIFGVGEALKLMFIITAIAAIALAVFLIGMVPHFDAANLFDIAKTDAVGASSFLPFGYVGVWAAIPYAIWFFLAVEGVPLAAEETKNPKRDLPRGLIGAMLVLLAFALLILVVGPGGAGSEALKASGNPLVEALSKAYGGSTWMGGFVNLVGLAGLIASFFSIIYAYSRQIFALSRAGYLPRKLSETNKSKAPVLALVIPGIIGFALSLTGQGDLLILVAVFGATLSYVLMMAAHITLRIRRPKMERPYRTPGGIFTSGLALVLACIAVVAGFLVDPRVVIGAAVIYAVLIAYFAFYSRHHLVAGTPEEEFAAIQKAEEALH

SEQ ID NO: 17302 - protein, 506 aa, Pseudomonas putida KT2440
MRYAHPGTEGAKVSFKSRYGNYIGGEFVTPVKGQYFENTSPVNGKLIAEFPRSTAEDIDKALDAAHAAADAWGRTSVQDRSNVLLKIADRIEQNLELLAITETWDNGKPIRETLNADIPLAVDHFRYFAGCIRAQEGGAAEINEGTVAYHIHEPLGVVGQIIPWNFPILMAAWKLAPALAAGNCVVLKPAEQTPLGITVLLEVIGDLLPPGVLNVVQGYGREAGEALATSKRIAKIAFTGSTPVGSHIMKCAAENIIPSTVELGGKSPNVYFEDIMQAEPSFIEKAAEGMVLAFFNQGEVCTCPSRALVQESIYPQFMEVVMKKVLQIKRGDPLDTDTMVGAQASQQQFEKILSYLQIAQEEGAELLTGGKVEKLEGSLATGYYIQPTLLKGNNKMRVFQEEIFGPVVSVTTFKDEAEALAIANDTEFGLGAGVWTRDINRAYRMGRGIKAGRVWTNCYHLYPAHAAFGGYKKSGVGRETHKMMLDHYQQTKNLLVSYDINPLGFF

SEQ ID NO: 17303 - protein, 423 aa, Pseudomonas putida KT2440
MNNNEKFEGNAAAGVGTRVVWSGEQVQHPYNATQTPIVVSAAYGYNDIDAWYDVAQGKQPGFIYSRMSNPTVATLEAKLAELEQAESAVAFSSGMAAISAVLHTFLSNGKRVVSTRDSYGGTNKIFEEFLPRMGVQVCLCDTLDTEALEREIAAGCDLLYLETPTNPTLKVLDIRRLSAAAHKVGALVVADNTFATPLNQNPLALGVDVVVHSATKFLSGHGDVLGGVVCGAEALMAQVRHYREINGAALDPFSAYLIIRGIKTLAVRLRQQQASAMALAHYLSTEPLVEAVNYPGLPAHAGHAIAKAQMRGFGAIVSFVLKGGMPTVARLLPRLKYAHRAGNLGAVETIYGPARTTSHVENTLEERLALGISEGLVRISVGIEETDDLLADLAQACASVREELAVAKELHADADACQSPVQA

SEQ ID NO: 17304 - protein, 479 aa, Pseudomonas putida KT2440
MSVQTTTTRNASAHTFKQDMQTRHIVMLALGGVIGTGLFLTSGYTVNQAGPLGAVIAYILGAIMVYLVMMCLGELAVHMPEVGSFSSYATRYLGPGTGYMVAWMYWLTWTVAIGSEFTAAGILMVRWFPDTPVWMWSALFGAAVFISNIISVRSFAETEFWLSLVKVLAVIAFLVVGGGAILGGFEIQQAHSAGLGNFTREGLFPTGFWSIAMTLLAVAFAFSGTELIGIAAGETKDPEKNVPKAIRTTVLRLALFFIGTIFVLATLLPREQAGVIESPFVMVFAMIGIPYAADIMNFVIITALLSAANSGLYAASRMLWTLSDQGNMPRRYATLSRRGTPFNAIVLSMAGGMASLLSSVFAPDTIYLALVSISGLAVVVVWISIAASQIAFRRHYIASGGKLEDLKFRVRGYPFVPLGAIFCCVLACVGIAFDPAQRVALYFGLPFIAWCYLAYWLTCKYRSRRTAPLEIVAPGSEAA

SEQ ID NO: 17305 - protein, 476 aa, Pseudomonas putida KT2440
MTTSHYIAGHWVEGQGSDCISVNDPALGQPFAELMAASVSQVDQAVAAARSALPAWKSTCASERAAFLRGFAEQLGQRREALVTVQMRNNGKPRHEAEIDLDDAIATFGYYAELAEQLPSKNRTVPLAAPGFTARTRLEPVGVVGLIVPWNFPLVTSAWKLAPALAAGCTVVLKPSEVTPLIEQAYGQIADALGLPAGVLNIVNGKAETGAALSNHNGLDKLSFTGSNSVGSQVMRSASAQCRPVTLELGGKSAIVVFDDCDVDQAVEWIVAGISWNAGQMCSATSRLLVQDGIADALLPRLQAALENLRVGNPLTEEVDMGPLTSQAQWLKVASYFATAREEGLQCLAGGHALDREGWFVSPTLYTDVPKDSRLWTEEIFGPVLCARRFATEEQAIAEANDSRFGLVATVCSADLERAERVADALEVGHVWINSVQAVFVETSWGGTKGSGIGRELGPWGLSAYQSIKHVTRCLG

SEQ ID NO: 17306 - protein, 185 aa, Pseudomonas putida KT2440
MSADLEHIRQVMHEADCLYTEAEVEAAIAKVGEQICKDLHDKNPVVFCVMNGGLIFSGKLLTHLQFPLEASYLHATRYRNQTSGGELFWKAKPEVSFIDRDVLIVDDILDEGHTLSAIIEFCKHAGARSVYTAVLIDKDHDRKASPDLKANYVGLPCVDRYIFGYGMDYKGYWRNANGIFAVKGL

SEQ ID NO: 17307 - protein, 160 aa, Pseudomonas putida KT2440
MSAFHDLKLEALNGGELPLAPFKGQVVLVVNVASKCGLTPQYKALENLYQIYKDKGFNVLGLPCNQFAGQEPGSEKEIQDFCSLNYGVSFPLGSKLEVNGPQRHSLYRLLAGEGAEFPGDITWNFEKFLVGKDGRVLARFSPRTAPDDPAVVQAIEKALA

SEQ ID NO: 17308 - protein, 402 aa, Pseudomonas putida KT2440
MANPGSPRRFARIDRLPPYVFNITAELKMAARRRGEDIIDLSMGNPDGATPPHIVEKLVQVAQREDTHGYSTSRGIPRLRRAISNWYKDRYEVDIDPESEAIVTIGSKEGLAHLMLATLDQGDTVLVPNPSYPIHIYGAVIAGAQVRSVPLVPGVDFFNELERAIRESIPKPKMMILGFPSNPTAQCVELDFFERVVALAKQYNVLVVHDLAYADIVYDGWKAPSIMQVPGAKDIAVEFFTLSKSYNMAGWRIGFMVGNPELVSALARIKSYHDYGTFTPLQVAAIAALEGDQQCVRDIAEQYRQRRNLLVKGLHELGWMVENPKASMYVWAKIPPEYAHLGSLEFSKKLLAETKVCVSPGIGFGDYGDDHVRFALIENQDRIRQAIRGIRQMFRADGLARK

SEQ ID NO: 17309 - protein, 173 aa, Pseudomonas putida KT2440
MGTPCHYALFDLQPSFRLDLDKLATRYRELAREVHPDRFADASEREQRIALEKSAALNDAYQTLRSAPRRARYLLAISGHEVPQEVTVHDPDFLLQQMQWREELEELQDEADLDGVGVFKKRLKAAQDTLNEDFAGCWDAPGERDKAERLMRRMQFLDKLAQEVRQLEERLDD

SEQ ID NO: 17310 - protein, 349 aa, Pseudomonas putida KT2440
MTTLFDPIKLGDLQLPNRIIMAPLTRCRADEGRVPNALMAEYYVQRASAGLILSEATSVSPMGVGYPDTPGIWNDEQVRGWNNVTKAVHAAGGRIFLQLWHVGRISHPSYLNGELPVAPSAIQPKGHVSLVRPLSDYPTPRALETEEINDIVEAYRSGAENAKAAGFDGVEIHGANGYLLDQFLQSSTNQRTDRYGGSLENRARLLLEVTDAAIEVWGAQRVGVHLAPRADAHDMGDADRAETFTYVARELGKRGIAFICSREREADDSIGPLIKEAFGGPYIVNERFDKASANAALASGKADAVAFGVPFIANPDLPARLAADAPLNEAHPETFYGKGPVGYIDYPRL

SEQ ID NO: 17311 - protein, 453 aa, Pseudomonas putida KT2440
MQDQSTPERLQRGLKNRHIQLIALGGAIGTGLFLGIAQTIQLAGPSVLLGYAIAGLMAFLIMRQLGEMVVEEPVAGSFSHFAHQYWSEFAGFVSGWNYWVVYVLVGMAELTAVGIYVQYWWPDFPTWATAAIFFVVINLINLTQVKVYGEMEFWFALVKVVAIVSMIGFGAWLLGSGHGGPDASVANLWQYGGFFPNGVTGLVMALAVIMFSFGGLELVGITAAEADNPRESIPKATNQVVYRILIFYIGALAVLLSLYPWQKVVQGGSPFVMIFHELDSDLVATILNIVVLTAALSVYNSCVYANSRMLFGLASQGDAPRQLLKVSRSGVPLTALAVSAFATGLCVLINYLMPGGAFGLLMALAVSALVINWASISITHLKFRKAKLAAGITPFYKSLGHPLTNYLCLAFIVLILVVMYLTPPIRISVMLIPAWIAVLWVAFKLKKARQAKG

SEQ ID NO: 17312 - protein, 269 aa, Pseudomonas putida KT2440
MSVDSAYAVELKGVTFKRGSRSIFSNVDISIPRGKVTGIMGPSGCGKTTLLRLMGAQLRPSSGEVWVAGQNLPTLSRSDLFDARKQMGVLFQSGALFTDLDVFENVAFPLRVHTQLSDEMIRDIVLMKLQAVGLRGAIDLMPDELSGGMKRRVALARAIALDPQILMYDEPFVGQDPIAMGVLVRLIRLLNDALGITSIVVSHDLAETASIADYIYVVGDGQVLGQGTPDELMGSDNPRIRQFMKGDPDGPVPFHFPAPDYRADLLGAR

SEQ ID NO: 17313 - protein, 489 aa, Pseudomonas putida KT2440
MLRISQEALTFDDILLVPGYSEVLPNEVSLKTRLTRGIELNIPLVSAAMDTVTEARLAIAMAQEGGIGIIHKNMTIEQQAGEVRKVKKFEAGVVKDPITIDADATVRDLFELTRLNNISGVPVLANGDLVGIVTSRDVRFENRLDAKVRDVMTPKERLVTVREGADKNEVRELLHKHRLEKVLIVDDKFNLKGMMTVKDIEKAKAYPLASKDDQGRLRVGAAVGTGKDTGERVAALVAAGVDVVVVDTAHGHSKGVIDRVRWVKETYPQVQVIGGNIATGAAAKALAEAGADAVKVGIGPGSICTTRIVAGVGVPQISAIANVAAALEGTGVPLIADGGIRFSGDLSKAIVAGASCVMMGSMFAGTEEAPGEVELFQGRSYKAYRGMGSLGAMAQAQGSSDRYFQDSSAGAEKLVPEGIEGRVPYKGALAAIIHQLMGGLRSSMGYTGSATIEEMRTKPEFVRITGAGMAESHVHDVQITKEAPNYRVG

SEQ ID NO: 17314 - protein, 472 aa, Pseudomonas putida KT2440
MPVGNHSAHGQATEGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAIYMGIWFPDVPRWIWALAALGSMGAVNLVAVKAFGEFEFWFALIKIVTIIAMVLGGIGIIAFGFGNDGVAVGISNLWSNGGFMPNGVTGVLMSLQMVMFAYLGVEMIGLTAGEARNPQKTIPQAIGSVFWRILLFYVGALFVILSIYPWNEIGSQGSPFVMTFERLGIKTAAGIINFVVITAALSSCNGGIFSTGRMLYSLAQNGQAPAAFARTSKNGVPRNALLLSIGALLLGVLANYLVPEKVFVWVTSIATFGAIWTWVMILLAQLKFRAGLTTAERKALKYRMWLWPLSSYLALAFLVLVVGLMAYFEDTRVALYIGPAFLVLLTVLYYTFRLAPKDAQGVTSTAS

SEQ ID NO: 17315 - protein, 283 aa, Pseudomonas putida KT2440
MTTALRQPTLSSQCLAEFLGTALLIFFGTGCVAALKVAGASFGLWEISIIWGVGVSMAIYLTAGISGAHLNPAVSIALTLFAGFDKRKLPFYMLAQVCGAFCGAALVYTLYSNLFFDFEQAHAMLRGSEGSLELASVFSTYPHPSLSTSQAFLVEVVITAILMAVIMALTDDNNGLPRGAMAPLLIGLLIAVIGSAMGPLTGFAMNPARDFGPKLMTFLAGWGEIAFTGGRDIPYFLVPVFAPILGACLGAASYRGLIARNLPMAPAATPETNDIRQGDTQAN

SEQ ID NO: 17316 - protein, 300 aa, Pseudomonas putida KT2440
MSELISVSDRIYTKLEMNNPGGSHKYRAARRIVEHAVRKGEIIPGVTTVIEKTGGSFGFGLLAACHKYQVAVELAVGLSFSQTKRDLLECFGARLIGKEMLMAGATPKDVVMHHLDNQAALGKSYFYTDQFNNPVGIEAHRYQTASELAVQLTNAGAGRQILFVGCAGTGASFTGITLGLKDHGFDVSTVLVDPNGCDSRAGVFADHRFEGMAVGVCPPFMDWSLVDERAQVQHAEMLAAQRWFYMQSGIFVGNTAAACLAVAQRMAQHPRYVETTLVTIAYDAGLWYQDLLGANRRKAA

SEQ ID NO: 17317 - protein, 295 aa, Pseudomonas putida KT2440
MSTALPSLGFAGIGLMGLPMCRRLLAAGYPLTVWNRSPDKCAALVAAGARLASSPAELCRDSDMVLLCLADTAVVREVVFGEQGIAQGGRSGQLLIDFSSLEPTATREMAAELAALCGMAWLDAPVSGGTPGAEAGTLAIMVGGEAADLQRARPVLQVLGQRVTHMGAVGAGQVTKACNQMIVACNALVIAEVVALAEQSGVDATLIAEALAGGFADSKPLQILAPQMAESRFEPIKWHVRTLLKDLDGAVKFSREQGSATPLSGLAAQLMRLHGSQGYLQKDPATLVELYRNKV

SEQ ID NO: 17318 - protein, 450 aa, Pseudomonas putida KT2440
MQPDHSASGNGQLRKTLRLWHVIIIGLAYLTPMTVFDTFGIVSGITAGHVPSAYILALAGILFTAVSYGTLVKRFPQSGSAYTYTQRAINPHVGFLVGWSSLLDYLLLPMVNALLAKLYLSAMFPEVPEWMWVAGFVTLISLINMRSVNLVAHFNLLFVGVQVAIIAVFIYLCVRGLDQGEGLGTTWSLIPFADSQTQFSALAAGATILCFSFLGFDAVTCLSEETRDPAKTIPRAIFLTALIGGVVFITVSYFIQAYFPTMARFHDQEAALPEIALYVGGKLFQSIFIACTVINTIASGLASQTSVSRLLYVMGRDNVIPASVFARLHSRYKTPVLNIAVVGLISLSAIFFDLVTATSIINFGALVAFSFVNLSVINHCYLREGNRKGLANQLKYLVLPTIGFCIIVSLWLDLNAHSLMFGGIWAALGLVYLGWLTKAFRAAPPNYVAE

SEQ ID NO: 17319 - protein, 363 aa, Pseudomonas putida KT2440
MSALFEPYTLKDVTLRNRIAIPPMCQYMAEDGMINDWHHVHLAGLARGGAGLLVVEATAVAPEGRITPGCAGIWSDAHAQAFVPVVQAIKAAGSVPGIQIAHAGRKASANRPWEGDDHIAADDARGWETIAPSAIAFGAHLPKVPREMTLDDIARVKQDFVDAARRARDAGFEWIELHFAHGYLGQSFFSEHSNKRTDAYGGSFDNRSRFLLETLAAVREVWPENLPLTARFGVLEYDGRDEQTLEESIELARRFKAGGLDLLSVSVGFTIPDTNIPWGPAFMGPIAERVRREAKLPVTSAWGFGTPQLAEAALQANQLDLVSVGRAHLADPHWAYFAAKELGVEKASWTLPAPYAHWLERYR

SEQ ID NO: 17320 - protein, 324 aa, Pseudomonas putida KT2440
MKKTVLAFSRITPAMAERLQQDFNVILPNPKLGDISAQFNEALPEAHGLIGVGRKLGRAQLEGAARLEVVSSVSVGYDNYDLDYFNERGIALTNTPDVLTESTADLGFSLIMGCARRTAELDAWTKAGNWQATVGPAHFGSDVHGKTLGIVGMGNIGAAVARRGRFGFNMPILYSGNSRKTALEKELGAQFRSLDQLLAEADFVVIVVPLSDATRKLISSRELKLMKPSAFLINIARGPVVDEAALIEALQAGTIRGTGLDVYEKEPLSDSPLFKLPNALTLPHIGSATAETREAMANRAIDNLRAALLGERPRDLVNPQVWKG

SEQ ID NO: 17321 - protein, 485 aa, Pseudomonas putida KT2440
MMIPVILSGGSGSRLWPLSRKQFPKQFLALTGEHTLFQQTIERLVFEGMDTPIVVCNKDHKFIVQEQLAALKLETQGILMEPFGRNTAPAVAMAAMKLVNEGRDELMLVLPADHVIDDQKALQRALALATVAAERGEMVLFGVPATKPETGYGYIRSSQDALLPEGVARVAQFVEKPDEKRAAEFVQAGGYFWNSGMFLFRASRFLEELKKHDGDIYDTCVLALERSQEDGDVLSIDEATFACCPDNSIDYAVMEKTQRACVVPMSAGWSDVGCWSSLWEVHEKDDNGNVTKGDVVVQDSRNCMIHGNGKLVSVIGLENIVVVETKDAMMIAHKDKVQGVKQMVKTLDEQGRTETQNHLEVYRPWGSYDSVDMGGRFQVKHITVKPGASLSLQMHHHRAEHWIVVSGTAEVTCDENVFLLTENQSTYIPIASVHRLRNPGKIPLEIIEVQSGSYLGEDDIERFEDVYGRTSTPIERGVSVKTIAQ

SEQ ID NO: 17322 - protein, 254 aa, Pseudomonas putida KT2440
MSEAIKQPAGPEGIIQMQGVNKWYGQFHVLKDINLNVRQGERIVLCGPSGSGKSTTIRCLNRLEEHQQGRIVVDGVELTNDLKQIEAIRREVGMVFQHFNLFPHLSILENCTLAPMWVRKMPRRKAEEIAMHYLERVRIPEQAHKYPGQLSGGQQQRVAIARALCMKPKIMLFDEPTSALDPEMVKEVLDTMVGLAEDGMTMLCVTHEMGFARTVANRVIFMDKGEIVEQAAPDDFFDRPRSDRTKLFLSQILH

SEQ ID NO: 17323 - protein, 484 aa, Pseudomonas putida KT2440
MSIRRTKIVATLGPASNSPEVIEQLILAGLDVARLNFSHGTPDEHKARARLIRDIAAKNGRHVALLGDLQGPKIRIAKFANKRIELKIGDKFTFSTAHPLTEGNQDIVGIDYPDLVKDCGVGDELLLDDGRVVMRVETATADALHCVVIIGGPLSDHKGINRKGGGLTAPALTEKDKADIKLAAEMDLDYLAVSFPRDASDMEYARKLRDEAGGSAWLVAKIERAEAVADDETLDKLIAASDAVMVARGDLGVEIGDAELIAIQKKIIQHARRNNKAVIVATQMMESMIQNPMPTRAEVSDVANAVLDNTDAVMLSAESAAGSYPIEAVQAMARICLGAEKHPTSQKSSHRLHTTFQRCDESIALAAMYTANHFPGVKAIIALTESGYTPLIMSRLRSHVPIFALSPHRATQARASMFRGVYPIAFDPAALPADKVSQAAVDELLKRGLVEQGDWVILTKGDSYHTIGGTNGMKILHVGDPLVG

SEQ ID NO: 17324 - protein, 448 aa, Pseudomonas putida KT2440
MNQAQTNVGKSLDVQSFINQQPLSRYQWRVVLLCFLIVFLDGLDTAAMGFIAPALSQEWGIDRASLGPVMSAALIGMVFGALGSGPLADRFGRKGVLVGAVLVFGGFSLASAYATNVDQLLVLRFLTGLGLGAGMPNATTLLSEYTPERLKSLLVTSMFCGFNLGMAGGGFISAKMIPAYGWHSLLVIGGVLPLLLALVLMIWLPESARFLVVRNRGTDKVRKTLSPIAPQVVAEAGSFSVPEQKAVAARNVFAVIFSGTYGLGTVLLWLTYFMGLVIVYLLTSWLPTLMRDSGASMEQAAFIGALFQFGGVLSAVGVGWAMDRFNPHKVIGIFYLLAGVFAYAVGQSLGNITLLATLVLVAGMCVNGAQSAMPSLAARFYPTQGRATGVSWMLGIGRFGAILGAWSGATLLGLGWSFEQVLTALLVPAALATVGVVVKGLVSHADAT

SEQ ID NO: 17325 - protein, 368 aa, Pseudomonas putida KT2440
MSLLLEPYTLRQLTLPNRIAVSPMCQYSAIDGLANDWHLVHLGCRAVGGAGLVISEAVAVTADGRITAEDLGLWNDDQIVPLQRITRFITAQGAVPGIQLAHAGRKASTYRPWLGKQGSVKLEDGGWQPVGPSKIAFDPQHTPPRELSKDEIQDVIDAFVASTERALKAGFKVVEIHAAHGYLLHQFLSPLSNQRRDEYGSCFENRIRLTLQVVEAVRKVWPAELPLFVRVSATDWVEDGWNPDETVELARRLRVLGVDLIDVSSGGTSVNAEIPTGPGYQTRFAERVRKEAEIATGTVGMITEPAQAEHILRTGQADVIFLARELLRDPYWPLHADDDLGGNKATWPAQYQRATSRANPIHESDLRD

SEQ ID NO: 17326 - protein, 474 aa, Pseudomonas putida KT2440
MQTQMLINGQLVAGQGPAWTVLNPALGTALAQINEATEAQVDSAVRAADQAFDSWSQTSPKERSQALLALADAIEAHGDELARLESQNCGKPLSAALNDEIPAIADVFRFFAGAARCLGGSAAGEYLPGHTSMIRRDPLGVVASIAPWNYPLMMLAWKIAPALAAGNTVVIKPSELTPLTALRLGELAQDLLPPGVLNILFGRGQTVGNPLITHPKVRMVSLTGSIPTGAHIISATADSVKRMHMELGGKAPVLVFDDADIDAAIDGIRTFGFYNAGQDCTAACRLYVQDGIYERFVERLGKAVASLKPGLQESEETELGPLISAQHRDKVAGLVQRAIAQPHIRLVTGGKPIAGDGFFFEPTVLADALQDDEIVRNEVFGPVVSVTRFTDEAQALEWANDSNYGLASSVWTRDTGRAHRLAARLQYGCTWVNTHFMLVSEMPHGGQKHSGYGKDMSMYGLEDYTCVRHVMIKH

SEQ ID NO: 17327 - protein, 216 aa, Pseudomonas putida KT2440
MRVILLGAPGAGKGTQAKFITEKFGIPQISTGDMLRAAVKAGTPLGLELKKVMDAGQLVSDELIISLVKERIAQPDCANGCLFDGFPRTIPQAEAMVAAGVDIDAVVEIAVDDEEIVGRMAGRRVHLASGRTYHIQYNPPKVEGKDDETGEDLIQRDDDKEETVRHRLSVYHSQTKPLVDFYQKLSAANGGKPKYSHIEGVGSVEAITAKVLAALS

SEQ ID NO: 17328 - protein, 398 aa, Pseudomonas putida KT2440
MNHALTQLQPYPFEKLRALLGSVKPAADKRAIALSIGEPKHESPAFVAQAMADNLDKLAVYPSTLGLPALRQAIGQWCERRFGVPAGWLDADRHILPVNGTREALFAFTQAVVNRADDGLVISPNPFYQIYEGAALLAGATPHYLPCLENNGFNPDFDAVPAEVWKRCQILFLCSPGNPTGALVPMNTLKKLIALADEHDFVIAADECYSELYFDEDAPPPGLLSACAELGRSDFARCVVFHSLSKRSNLPGLRSGFVAGDAQIIKPFLLYRTYHGCAMPVQTQLASIAAWQDEAHVRENRDQYRAKYDAVLDILQPVLDVQRPDGSFYLWAKVPGDDAEFTRDLFEAQHVTVVPGSYLSREVDGVNPGAGRVRMALVAPLAECIEAAERIRAFLQNR

SEQ ID NO: 17329 - protein, 429 aa, Pseudomonas putida KT2440
MAKIVDIKGREVLDSRGNPTVEADVLLDNGIIGSACAPSGASTGSREALELRDGDKSRYLGKGVLKAVANINGPIRDLLLGKDPSDQKALDRAMIELDGTENKAKLGANAILAVSLAAAKAAAQDQDLPLYAHIANLNGTPGQYSMPVPMMNIINGGEHADNNVDIQEFMVQPVGAKTFSDGLRMGTEIFHHLKAVLKARGLNTAVGDEGGFAPNLASNEDALGAIAEAVEKAGYKLGTDVTLALDCAASEFYEDGKYNLSGEGKSFDAEGFADYLKGLTERFPIISIEDGLDESDWAGWKILTDKIGEKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAVYRGRAEFRG

SEQ ID NO: 17330 - protein, 371 aa, Pseudomonas putida KT2440
MMIKSRAAVAFEAKKPLEIVEVDVAMPKAGEVLLRVVASGVCHTDAYTLSGADPEGIFPSILGHEGGAIVEAVGEGVTSLAVGDHVIPLYTPECGKCKFCLSGKTNLCQAIRATQGKGLMPDGTTRFSYKGQQLFHYMGTSTFSEYTVLPEISVAKIQKEAPLEKVCLLGCGVTTGIGAVLNTAKVKPGDTVAIFGLGGIGLSAVIGAVKAKASRIIAIDINPAKFEIARQLGATDCVNPKDYDRPIQEVIVDLTDGGVDFSFECIGNVQLMRAALECCHKGWGESVIIGVAGAGQEISTRPFQLVTGRVWRGSAFGGVRGRSELPSYVEMSEKGEIPLDTFITHTMGLEDINKAFDLMHEGKSIRSVIHF

SEQ ID NO: 17331 - protein, 299 aa, Pseudomonas putida KT2440
MTLQYPTIADCVGNTPLVRLQRIAGETSNTLLLKLEGNNPAGSVKDRPALSMIARAELRGQIKPGDTLIEATSGNTGIALAMAAAIKGYKMILIMPDNSTAERKAAMTAYGAELILVTKEEGMEGARDLAEKLQAEGRGLVLDQFANGDNPIAHYNSTGPEIWQQTQGTITHFVSSMGTTGTIMGCSQYLKEQNPAVQIIGLQPMEGSAIPGIRRWPEEYLPKIFDATRVDRVVDMSQQEAEDTTRRLAREEGIFCGVSSGGAVAAMLRLSREVENAVMVAIICDRGDRYLSTGLFDPR

SEQ ID NO: 17332 - protein, 202 aa, Pseudomonas putida KT2440
MCVRRYPASSRIVMREKRVMRAHWLTVPVLALLASTSSWAADCPALLQGSLPELRGKGQVDLCERFAGKPLVVVNTASYCGFAPQFEGLEATYKEYHEQGLEMLGVPSNDFKQEDADSEKTAKVCYANYGVTFTMTKTQAVRGKDAIPLFAELASQSSAPKWNFYKYVVDRKGKVIGNFSSLTKPDDPAFRAAIEKAIASQP

SEQ ID NO: 17333 - protein, 424 aa, Pseudomonas putida KT2440
MFSWYREITSRERKTFWACFGGWSLDALEVQMFGLAIPALIAAFSLTKGDAGLISGLTLVTSAIGGWLGGTLSDRYGRVRTLQWMILWFSFFTFLSAFVTGFYPLLFVKAMQGFGIGGEWAAGAVLMAETINPKYRGKVMGTVQSAWAVGWGLAVALFMLIYSLVPQEFAWRVMFFVGLLPSLLIIWVRRNVPEPDSFQRLQKEKAIPSSFLQSMAGIFRPELLRVTLLGGLLGLGAHGGYHAVMTWLPTFLKTERNLSVLNSGGYLAVIILAFWCGCVVSGLLIDRIGRRKNILLFALCCVLTVQAYVFFPLTNTQMLFLGFPLGFFAAGIPASLGAFFNELYPADVRGAGVGFCYNFGRVLSAVFPFLVGHMSESMSLGSAIGIDAGIAYGVAVIAALCLPETRGRNLESAPAPETAGAVAK

SEQ ID NO: 17334 - protein, 1357 aa, Pseudomonas putida KT2440
MPGQPAPFCVFHRSPPMANSEVRSVCPYCGVGCGIVMSVADGKVGKISGDKLHPSNFGRLCTKGLTAHQPLSASGRMADAYLRQQRSQPPVRTSMDQAIAATAERLRGIIDQHGPDAVALYVSGQMSLEAQYLANKLAKGFIRTRHIESNSRLCMASASSGYKLSLGADGPPGSYQDFEHADVFLVIGANMADCHPILFLRLLDRVKAGAKLIVVDPRRSATADKADLFLQVRPGSDMALLNGLLHLLHRNGHTNPDFIARHTEGWDEMPAFLDDYTPERVAAITGLAEADIIKAAEWIGSANNWMSCWTMGLNQSIHGTWHSNAICNLHLATGAICRPGSGPFSLTGQPNAMGGRDMGYMGPGLPGQRSALVEDDRAFVERQWQLPPGSLRSEGGEGTVALFGQMKAGEVKACWVICSNPVASVANRQQVIDGLRKAELVITQDAFLDTETNRYADILLPAALWAEGEGVMINSERNLTLMPRAVEPPGQSLPDWQIIARVACAMGYADAFDYPNAEAVYEEIRRFHNPSTGYDLRGIGYAELRTQPRQWPCAPGSEQHRSPLRYLNDGSSQALLLDARGRRPALAFPTASGKAHFFARPWLPAAEVPDDDYPMVLNTGRVQHQWHTLTKTGKVPALNKLEPGPYLEIHPEDAARLGVAEKDQVAVRSRRGQAVLPARISDRVMPGNCFAPFHWNDLIGEQLAINAATCDAVDPLSLQPAFKHCAVALERVAGERIDALDLNTATVEPVRMPTATLSRLLGLHTLPVPVLAEEERHYLQGFLLGLDQARAEGVPRLPASAPLAASRRLFVDGLLAGLFAQPATAPIAAQAAPWHQVLWASQTGNGEQLAERCAARLRGAGLNVQLSCLEAVSPSQLQGAASVVLIASTFGDGDAPDSGAAFWQALQGEEGAHCAGLPYAVLALGDSSYDQFCGFGRKLDQRLAELGGHRLLARVDCEPDFDEAFAGWLEALLPALGTAAAPSPASEPAPVSAFSKQQPWMATVLENRLLNGPGASKETRQLVFDLGGSGFSYAAGDALGVWPRNCPALVEELLTLMQLDGQAMVELKGHSTMPLAEALRAHLEIAKVTAQQLQAFASNAPDLQRLLQPECKAELQDWLWGRQLVDVLRAFPQQLPLASWLELLKPLQPRLYSISSSPLAHPGQVHLTVSTVRYGERKGVCSSFLADRAQVQKVAIFPQVSKHFRLPEDDSVPVIMVGPGTGIAPFRAFLEEREARGAKGDNWLFFGEQYAATDFYYQEQLQAWQAAGHLRLDTAFSRDQVEKIYVQQRMLEQGALLWQWLEAGAYFYVCGDAQRMARDVDAALRVIVAEHGRMDAAAAAAYVEGLSKARRYRRDVY

SEQ ID NO: 17335 - protein, 320 aa, Pseudomonas putida KT2440
MKALQGVDGHVEWVEAERPTCDAGQVRIRVAAAGLNRADLLQMKGLYPPPPGASPYMGLECSGVVEEVGAGAAWRVGDRVCALLASGAMAEEVVVDARHVLPVPEGLGLHEAAALPEVYATAWLNIFQLGAVKAGEKVLVHAGASGVGSAAIQLCKAFGSPVWVSVGSQDRLAYCQALGAAGGVVRNENLDALEGFGPFDVILDPVGASYGELNLKLLARDGRWVIIGLMGGRKFELDLAQVLGKRLEITGSTLRNRDDGFKAELLRELQQQVWPLFAEGRLSPQLVDTYPVEFAQAAYAELETNQVSGKLVMVIDPSLV

SEQ ID NO: 17336 - protein, 367 aa, Pseudomonas putida KT2440
MADMSEQELKALRVRIDSLDEKILELISDRARCAEEVARVKTASLKEGEKPVFYRPEREAAVLKRVMERNKGPLGNEEMARLFREIMSSCLALEEPLKIAYLGPEGTFTQAAAMKHFGHAVISRPMAAIDEVFREVAAGAVNFGVVPVENSTEGAVSHTLDSFLEHDMVICGEVELRIHHHLLVGENTKTDSITRIYSHAQSLAQCRKWLDAHYPNVERVAVSSNAEAAKRVKGEWNSAAIAGDMAANLYGLTRLAEKIEDRPDNSTRFLMIGNQEVPPTGDDKTSIIVSMSNKPGALHELLVPFYQNGIDLTRIETRPSRSGKWTYVFFIDFVGHHRDPLIKAVLEQISQEAVALKVLGSYPKAVL

SEQ ID NO: 17337 - protein, 480 aa, Pseudomonas putida KT2440
MELIPVILSGGVGSRLWPVSREAHPKPFMTLPDGQNLIQKTFLRAADLNGVVEILTVTNRELLFKTEDEYRTINKQNLSQGYILEPFGRNTAAAVAAAALQLLESHGPQVHMLVLAADHLIQNEAAFSEAVSKAVQLAGEGWLVTFGIKPQYPETGFGYIEAAAGGVLEGGLRVERFVEKPDAKTAEAYVAAGNYFWNAGMFCFQVGTVIEQFRAYAPDVLEAVERTLEASRRSTSKGYSCLALDAECFASVPDISIDYALMERSSKVATIPCDIGWSDIGSWNAVSELTLPDEHGNRFDGEVMAYGASNNYVSTEDRLAALVGVQDLLVVDTPDALLIAHKDHAQDVKHIVKRLKNDGHTAHLLHQTVHRPWGTYTTLEDGERFKIKRIVVKPKASLSLQMHHHRSEHWIVVSGMAVVVNDDQELMLNTNESTFIRAGHKHRLQNPGVIDLVLIEVQSGDYLGEDDIVRFEDNYGRCDA

SEQ ID NO: 17338 - protein, 162 aa, Pseudomonas putida KT2440
MAATMLNIPCVTLGGEHKTLGDFPGKVLLVVNTASQCGFTPQYKGLEQLWQAYRDRGLVVLGFPCNQFGKQEPGDAREIAQFCERNFGVSFPLFRKVEVNGPGAHPLFVELKQRAPGILGSQKIKWNFTKFLVDPASGQVKRYAPTTKPQALEADIERLLSR

SEQ ID NO: 17339 - protein, 492 aa, Pseudomonas putida KT2440
MAVFASDSFGQLKVEKIMTAQWNHYINGEYVSPESEEYIHEFIPTTALPGDSIARGSAADVDKAVRAAAAAQPAWNARKPIERGRILLAIARLVRANAAAFCAKEAEETGKPLKMAAFEIEACAQYFEYYGGLATAIQGETINLGPSYHAYTTREPFGVVGVILPWNSPLNQAGRAIAPALVSGNTVVVKPSEFTSVTMLQFAELVVKEAGLPPGVLNVVTGTGKETGEPLVKHPLIRKVAFTGSVRAGREIGKLAADRIIPLSLELGGKSPNIVFEDADLDRAVAGSVFAFTVNTGQVCLAGTRCLVHESIFEKFSKKLAGAVEALQFSDGESFGLGPLTTKAQFEQVHRYNELAIQEGAHCLVGGEAPSDKTGWYVRPTVYTNVNNSMRIAREEIFGPVLVLIPFKDENEAVAIANDSDYGLAAGVWTTDLARAHRVSAQIEAGQVYVNEYPSGGVETPFGGFKQSGHGREKGIEALHHYTQTKTTIIRI

SEQ ID NO: 17340 - protein, 163 aa, Pseudomonas putida KT2440
MQHYVTPDLCDAYPDLVQVLEPMFSNFGGRDSFGGQIVTIKCFEDNSLVKEQVELDGKGKVLVVDGGGSLRRALLGDMLAEKAAKNGWEGLVIYGCVRDVDVLIQTDVGVQALASHPMKTDKRGIGDLNVVVTFAGVTFRPGEYVYADNNGVLVSPKPLKMPE

SEQ ID NO: 17341 - protein, 411 aa, Pseudomonas putida KT2440
MYYRVRCSMSASFWKSGHVPTLFAAFLYFDLSFMVWYLLGPLAVQIAADLQLSAQQRGLMVATPILAGAILRFAMGVLVDRLSPKTAGLIGQVVVIVALAAAWHLGVHSYEQALLLGVFLGFAGASFAVSLPLASQWYPPQHQGKAMGIAGAGNSGTVFAALLAPALAAGFGWNNVFGFALIPLSLALVVFALLARNAPQRPKPKAMADYLKALGDRDSWWFMFFYSVTFGGFIGLASALPGYFSDQYGLSPVTAGYYTAACVFAGSLMRPLGGALADRFGGIRTLLGMYGVAAICIAAVGFNLPSAAAALALFVSAMLGLGAGNGAVFQLVPQRFRQEIGVMTGLIGMAGGIGGFLLAAGLGTIKQHTGDYQLGLWLFASLGLLAWFGLHGVKQRWRTTWGSAAVTAARV

SEQ ID NO: 17342 - protein, 464 aa, Pseudomonas putida KT2440
MAVYNYDVVVLGSGPAGEGAAMNAAKAGRKVAMVDDRRQVGGNCTHLGTIPSKALRHSVRQIMQFNTNPMFRAIGEPRWFSFPDVLKSAEKVIAKQVASRTGYYARNRVDVFVGTGSFADEQTVEVVCPNGVVEKLNAKHIIIATGSRPYRPADIDFHHPRVYDSDTILSLSHTPRKLIVYGAGVIGCEYASIFSGLGVLVELVDNRGQLLSFLDSEISQALSYHFSNNNITVRHNEEYERVEGLDNGVILHLKSGKKIKADALLWCNGRTGNTDKLGLENIGIKVNSRGQIEVDEAYRTTVPNIYGAGDVIGWPSLASAAHDQGRSAAGSIVDNGSWRFVNDVPTGIYTIPEISSIGKNEQELTQAKVPYEVGKAFFKSMARAQIAGEPQGMLKILFHRETLEILGVHCFGYQASEIVHIGQAIMNQPGEQNNLKYFVNTTFNYPTMAEAYRVAAYDGLNRLF

SEQ ID NO: 17343 - protein, 448 aa, Pseudomonas putida KT2440
MSVIFPDLLAEVRSFRAEHPAIRYVDLIALDIPGHFYGKRYPMDMLEKVAAGAPLKLPQNCVLLGTQGGLYPIGDYCFADGDPDAARRLVPGTLKPVRWEKEVIAQMLITSDGTAKPIEFEPREVLARVLQRLAKRGIRPVVAFELEFYLFDRKLDNGLPQYPRDTATEDEDDQPNMHIERLSRFSSVLHEMVDGANEQGVPANVITAELGPGQFEINFSHSDDALSAADWSALFCRSTRGIAMKHGYRASFMSKPYLDAPGSGMHVHVSLYDAAGNNILAGSEQRKLRHAVAGCLELLPHCMPIFAPNHNAYRRYGAMVNAASKASWGFEDRDACIRIPESDPRNLRIEHRLAGADANPYLVLAAILTGMEHGLDRGVEPIAPLNENRQSGIDFPKDALSALAAMRHHPVVNQGLGSEFVMVYCENKYQEQLDFMHHIDAREYRWFL

SEQ ID NO: 17344 - protein, 311 aa, Pseudomonas putida KT2440
MTRDSLYGTAAESTYAGVVSFSRRRYSRDLRGVDVVVSGVPFDTATSNRPGARFGPRAIRAASVQQAWARHWPWAFDPFDHLAVIDYGDCPFDSGTPQSVPDSIEAHAEHILQAGCAMLTLGGDHFISYPLLKAHARRHGPLALIHFDAHSDTWPDEAGKRIDHGTMFWHAAREGLVDPAHSVQIGLRTTNDDSQGFAILDARQVHRQGTEAVIAAIRQRVGERPVYLTFDIDCLDPAYAPGTGTPVCGGLSTVQALEILGGLRGINLVGMDLVEVAPAYDHADITALAGATLAMEMLCLYAARHKVDNGQ

SEQ ID NO: 17345 - protein, 350 aa, Pseudomonas putida KT2440
MYTAIGYAAQTPTSPLAPMTFQRRSPRPDDVAIDILYCGVCHSDIHQARNEWGIAVYPLMPGHEIIGRVTAVGDKVTAHKVGDLVGVGCMVDSCRTCEACAKDLEQYCLEGPTMTYATPDRVDGSNTMGGYSSSIVVSEHFVVRIPAGMDLPSAAPILCAGITTYSPLKHHGVGPGHKIGILGMGGLGHMGIKLAKALGAEVTLFTRSQAKAEEARRQGADHVIVSTDAEQMRAAAGRFDFLLDTIPVQHDLNPYLETLKFDGVHILVGLIEPIDPALHAANLVMKRRVLAGSLIGGIAETQEVLDFCAEHDIRCDIEMLDIRNINQAYERMIAGDVKYRFVIDMATLQG

SEQ ID NO: 17346 - protein, 374 aa, Pseudomonas putida KT2440
MTQSELFKTTQLGPYTLKNRIVLPPLTRSRSSQPGNIANDLMATYYRQRSGAGFMVTEGTQIEPRGQGYAWTPGIHSPEQIQGWRKVTDAVHAEGGVIFAQLWHVGRVSHTSLQPGGEAPVAPSAIRADNVKVFIETGPGTGALADPSTPRALSTKEVKELVKLYAQAARNALDAGFDGVELHCANGYLVNQFISAHTNQRDDEYGGSLQNRLRFLREITLAVAGVVGKERMGVRFAPLFATTDEDRVYLGLVEEDPHQTYIEAVKILEEVGIAYLSLAEADWENAPELPETFREDVRKSFSGKILYAGKYTAERGNRVIKAGWGDLIAFGRPFIANPDLPARIANNWPLNPVDPSSMYGGTDKGYTDYPTYKS

SEQ ID NO: 17347 - protein, 503 aa, Pseudomonas putida KT2440
MRYPMKDSSDTHPNHLPDSCYGLFIDNQWVTAEYGETLDIINPANGKILTNIPNATAADVDRAVQAAQRAFVTWRTTSPAERANALLKIADLLEADADRFAVLETLDVGKPIRESRSVDIPLAIDHFRYFAGVIRSQSDEAVMLDEQTLSIALSEPLGVVGQVIPWNFPLLMAAWKIAPAIAAGNTVVIKPSELTPVTILELAKIFAKVLPAGVVNIVTGLGTTVGQALLDHPDLRKLAFTGSTRVGELVANAAAKKIIPATLELGGKSANIVFPDANWDKAVEGAVLAILWNQGQVCESGARLFVHESIYERFLAELKHKFEAVRVGDPLNPDTMMGAQVSKTQMERILGYVDIAKEEGAEVLIGGGRLTGADYDAGFFIQPTILVGVRNDMRVAYEEIFGPVLCVIPFKDEAEVIAMANDSEYGLAGAVWTQDINRALRVARAVETGRMWVNTYHEIPAHAPFGGYKKSGLGRETHKSMLEAYSQKKNIYVSLNEAPLGLF

SEQ ID NO: 17348 - protein, 366 aa, Pseudomonas putida KT2440
MSALFEPFELKSHCLRNRIAVPPMCQYMANEGLVNEWHHIHYASIARGGAGLVIVEATAVSPEGRITPSCAGLWSDKQGEAFIPIAQAIKAAGSVAGIQLAHAGRKASANRPWEGNGHIAEDDHRGWQTIAPSAIAFGAHLSKVPRAMSLSDIAQVREEFVMAARRALSAGFEWLELHFAHGYLGQSFLSAHSNRRSDGYGGNVENRRRFLIETMSAVREVWPEHLPLTVRLGVIEYDNQDEQTLLEAIALIRQLKNAGADLVNVSTGFNIPNTDTPWAPAFLAPIAERIRHEAGIPVAAAWGIESPALADRLVRDGQADLVMVGRAHLADPHWPYAAARTLGVERPAWVLPPPYAHWLERYTPVE

SEQ ID NO: 17349 - protein, 470 aa, Pseudomonas putida KT2440
MDATSTTTTAKSGHESKLSASLKSRHLTMMSIAGVIGGALFVGSGSVIHSAGPAAVLAYLAGGILVVLIMRMLGEMATSSPDTGSFSTYADRAIGRWAGFTIGWLYWWYWVILMAWEAYVAGKILHGFFPDVSVNVFVLATTLLLITVNFFNVKHYGEFEFWFALIKVIAIVCFLIVCTAAVMNIWQFGEVRGISHLTAEGFMPNGITTVIGALLGVMFAFLGAEIVTIAASEAKDPAAQIVKATNSVVWRVCLFYVGSIFLIVCLVPWNDPHLGVSGYGAYRRTLELLGVPYAELLMNFVVLTSVSSCLISGHYTASRMLFSLAQRGDAPSFFKITRAGTGVPVYAIMGSCAVAVVCALINFSETLRPKDVLDTLMNTTGMIALLVYLVIAFSQLRMRRKLIAEGKEVRLKMWLFPWLTYLVIAFIVAALVTMAFMPDYQILVISTGIAAAVVVAMGVVHQIRSGSKQH

SEQ ID NO: 17350 - protein, 438 aa, Pseudomonas putida KT2440
MNQSLAAFKRWRIQIFAITWLAYAAFYFTRKAFSVAKLGIAEDPGFMLDKAAMANLDAIYLAAYAVGQFTWGMLADRFGPRVVVLGGLLISAAAAVVMGSYATFPIFATCMLVQGLAQSTGWAGLCKNIGSFFPASQRGRVLGLWSSCYAFGGLVASPFAGWWAYTLVGTWHAAFFSSAVVVALVAVLFFFLQRNKPEDVGLPAVEPEPQSMAPADNLCSVWAPLREILRNRTVLTLGLAYFLLKPARYAILLWGPVIVFEQMPSVGKVGAAIIPTAFELAGLLGPIMIGLASDKLFGARRMPACVISLVLLTVTLAAFMAAMNTGSVLLVVALLFVMGLTLYGPDSMISGAAAIDFGTAKAGATAAGFVNGCGSVGAVLGGLLPGYFDGVTVFIVFAGCALFSALVLLPHWNSRPASSAQGTDVAPNTSMAIKPLRT

SEQ ID NO: 17351 - protein, 497 aa, Pseudomonas putida KT2440
MYTLEFWQQRASDLYLPAHALIDGKPVNAQDGATFAAINPATNNVLAQVAACGHAEVDLAVASARRAFEQGPWPRMAPGERKKVLLRLAELIMAHREELALLDSLNMGKPVMDAYNIDVPGSAHVFAWYGEALDKLYDQVAPTAANALATITREALGVVAAVVPWNFPLDMAAWKLAPALAAGNSVVLKPAEQSPFSALRLAQLALEAGVPEGVLNVVPGLGEQAGQALGLHPDVDCLVFTGSTQVGKYFMQYSAQSNLKQVWLECGGKSPNLVFDNCQDLDLAAEKAAFGIFFNQGEVCSANSRLYVQRAIHDEFIERLQAKARQWLPGNPLDPASRAGAIVDAGQTGRIEAAIVRAGQEGARLVCGGRRLTIEGSDNYIEPTIFAGVEGRMSLAREEVFGPVLAVSAFDTEEEAVRLANDSIYGLVASVWSDDFNQVHRVARALKAGTVSVNTVDALDVTVPFGGGKQSGFGRDLSLHSFDKYSQLKTTWYQLRG

SEQ ID NO: 17352 - protein, 506 aa, Pseudomonas putida KT2440
MIYAQPGTPGAVVSFKPRYGNFIGGEFVQPLAGQYFINSSPVNGQPIAEFPRSTAQDVERALDAAHAAAEAWGKTSVQDRARVLLKIADRIEQNLEVLAVTESWDNGKAIRETLNADVPLAADHFRYFAGCIRAQEGGVGEINEGTVAYHIHEPLGVVGQIIPWNFPLLMAAWKLAPALAAGNCVVLKPAEQTPLSITVFAELIADLLPAGVLNIVQGFGREAGEALATSKRIAKIAFTGSTPVGSHIMKCAAENIIPSTVELGGKSPNIFFEDIMQAEPAFIEKAAEGLVLAFFNQGEVCTCPSRALIQESIYEPFMAEVMKKIAKITRGNPLDTETMVGAQASEQQYDKILSYLEIAREEGAQLLTGGGAERLQGDLASGYYIQPTLLKGNNKMRVFQEEIFGPVVGVTTFKDEAEALAIANDSEFGLGAGLWTRDINRAYRMGRGIKAGRVWTNCYHLYPAHAAFGGYKKSGVGRETHKMMLDHYQQTKNLLVSYDINPLGFF

SEQ ID NO: 17353 - protein, 480 aa, Pseudomonas putida KT2440
MSHKTYNNYIDGQWCEGHATLGNYSPSDTGDLIGQYHQASAEQARQAIQAARAAQPLWAASGLESRQQVLMAIGDELIARKEELGELLSREEGKPLAEGIGEVNRSGQFFHYYAAEVLRQMGETAASVRPGVDIEVHREPVGVVGIITPWNFPMATAAWKIAPALAFGNAVVFKPANLVPASAWALTEIISRQGLPSGTFNLVMGSGADVGEALIQSAEIDALTFTGSLQTGRRVAVATAGNLVRCQLEMGSKNALVVMDDADLELAVECALNGAFFGTGQKCTASSRLIVCDGIHDRFVEALRLRMRQLKVGHALEAGVQIGPVADARQLEQNLAYLQLAQAEGATLIEGGERLQLACDGYYMRPALFINSRNDMRINREEVFGPIACVIRVRDFEEALATLNDTEYGLTAGIITQSLRHASHFKRRAQTGCVMVNLPTAGTDYHVPFGGRKASSFGPREQGQYARDFYTVVKTTYLRP

SEQ ID NO: 17354 - protein, 459 aa, Pseudomonas putida KT2440
MSTHSSTVQNDLAALIHPNTNLAQHREVGPLVIARGDGVRVFDEQGNAYIEAMSGLWSAALGFSEQRLVDAAVEQFKQLPYYHSFSHKTNAPAAALAAKLAALAPGDLNHVFFTNSGSEANDSVVKMVWYVNNALGRPAKKKFISRQQAYHGATVAAASLTGIPSMHRDFDLPAIPVHHLTCPNFYRFARPGESQEAFTVRLANELERYILAEGPETIAAFIGEPVIAAGGVIPPPTGYWAAIQAVCKRYDILVVIDEIITGFGRLGTMFGSQLYGIQPDIMVLSKQLTSSYQPLAAVVVSDAMNDVLVSQSQRLGAFAHGLTCTGHPVATAVALENIRIIEERDLVGHVQHLAPVFQRHLRAFEDHPLVGNVRGVGLMGGIELVADKATRQPFAQPGTLGGYVFKQAHKHGLIIRAIYDTIAFCPPLITTQDDIEAIFSAFERTLADATDWARSQHLL

SEQ ID NO: 17355 - protein, 417 aa, Pseudomonas putida KT2440
MNKIETFERLESNVRMYCRDLPLVFDTAQGSKIRGEDGREYLDFFAGAGALNYGHNDPRMRDALIAYLSANGVTHALDLHTTTKRQFLESIERDLLKPRGWDYKVQFTGPTGADAVEAALKLARKATGRTKVVSFYGAYHGMTAGALAVTGNRTRRGPGLSNDVVFVPYEDSPYGEFDSMGFLERLANDQGSGSELPAAVIVESVQIQAGVYPASNLWLQRLRQWTRDHGVVLICDEIQAGCGRTGDFFGFERSGIVPDLITCAKSIGGFGLPMAIVLIRAGLDVWQPGDHIGTFRGNQLAFLTAQIALGYWRDEQFLKLLTDNSAAMTRAVAGFAEIPGVASARSRGMIAGIDFGRGNVALAKDAQQRVLQAGVLVDRCGPNGEIIKLMPPVNTPTDQLEQGLNAFGEAVAAALRQ

SEQ ID NO: 17356 - protein, 474 aa, Pseudomonas putida KT2440
MQTKLLINGALVAGEGDHVDVYNPSLGRVLVQTHEASHAQVHAAVQSADAAFEAWSQTPPKDRAALLLTLADRIDAQAAVFARLEADNCGKPFTAVLQDELPAVSDVFRFFAGAVRCLQGSAAGEYIPGHTSMIRRDAVGVVASIAPWNYPLLMAAWKLGPALAGGNTVVLKPSEHTPMSTLKLGELLADIFPAGVVNIVHGRGATVGEPLTSHALVRMVSLTGSVRTGSRIIEGTADSVKRMHMELGGKAPVLIFDDADIDAAVEGIRAFGFYNAGQDCTAACRLYVQKAVYPEFVRKLGEAVSSIKCGLQDDPATEMGPLITQEHLQRVEGFVNRAREQPHIEVVTGGKRAAGAGFFFEPTVLAGTRQEDEVVCREIFGPVVTVSPFEDEAQVLAWANESDYGLASSVWTADVGRAHRLAARLQYGCTWVNTHFMLVSEMPHGGVKLSGYGKDLSMYGLEDYTLVRHVMFKH

SEQ ID NO: 17357 - protein, 463 aa, Pseudomonas putida KT2440
MQTHKNNLSHGLKSRHVTMLSIAGVIGAGLFVGSGRAIAEAGPATILAYILAGGLVVLVMRMLAEMAVASPDTGSFSTYADLAIGKWAGYTIGWLYWWFWVLIIPIEANIAATIINSWVPQLEIWVLSLVITLLLTATNLFSVKNYGEFEFWLALVKVVAIVSFIALGVCAIFGLLPGAGVSGVSRLWDTGGFMPNGFGAVLSAMLITMFSFLGAEVVTIAAAESDEAGKHISKATNSVIWRITLFYILSIFIVIALVPWTDPRLATEGSYVTVLDTLGVPNAKAIIDFVVLTSVTSCLNSSLYTASRMVYSLSRRGDAPACAQITSRSGTPVVAVLLSTGAAFLAVIANYLVPAKVFGFLMASSGAIALLVYLVIAISQLRLRQRLTAQGKTLGYRMWLFPWLTWGVILFISGVLVLMLFRPDHRLEVVSTMVLAVLVVCSGVLVTRRRARGGAVAGVGQGA

SEQ ID NO: 17358 - protein, 418 aa, Pseudomonas putida KT2440
MNVFDTLMLPNGSTVKNRIAKAAMEENMADAHQAPSEALMRLYQAWADGGAGLIITGNVMVDGRAMTGPGGVVLQDDQQLDKFKRWARIGRSGGAQFWLQINHPGRQMQSNLGQKTWAPSAVPLELGKMSKRFDTPHAMTPGVIEEVIQRFANTARLGEQAGFTGVEIHAAHGYLLSQFLSPLTNHRKDEWGGSLENRARLLLEIVKAVRAVVSVDFAVAVKLNSADFQRGGFTTEDAKKVVEWLNDLGVDMVELSGGSYEVPAMQGDARDGRTLAREAYFVEFARDLQTVAKMPMMVTGGIRRRPVAESVVQSGVDMVGIGTALAIDPHLPRDWLQGKDNAPQLPPITWKNKAIASLANMAVVKFQLRKLSRAKKPDPSVSPLRALIQQQLFMACRARQYRRWVETSAHYNGLEDAR

SEQ ID NO: 17359 - protein, 232 aa, Pseudomonas putida KT2440
MAGLDKRVATYEQALEGLTDNMTVLAGGFGLCGIPENLISEIKRRGVKGLTVVSNNCGVDGFGLGVLLEDRQIRKMIASYVGENAEFERQLLSGELEVELTPQGTLAEKMRAGGAGIPAFYTATGYGTPVADGKEVREFKGRKYILEESITGDFAIVKGWKADHYGNVVYRNTAQNFNPLAATAGKITVVEVEEIVEPGVLLPSEIHTPGIYVDRVIVGTFEKRIEKRTVKA

SEQ ID NO: 17360 - protein, 461 aa, Pseudomonas putida KT2440
MSAISSLTHAISLDPYSGEQIGTYPFDTDAALEAALQRAKVGYRQWRQVSLGQRSEYLLALADTLEAKAEAFAHMISREIGKPIAQARGEVSKCVGLCRWYAEHGPAMLAAEPTQVEKARIEYRPLGPILAVMPWNFPVWQVLRGAVPAILAGNTYVLKHAPNVMGSAYLMAELFKDAGLPEGVFEVLNVTPDGVTRAINDPRIAAVTLTGSVRAGMAIGAQAGAALKKCVLELGGSDPFIVLADADLDAAVQAAVIGRYQNTGQVCAAAKRLIVEASIVDAFTHKFVEATRQLKVGNPLEDDTYIGPMARYDLRDELDGQVQATLAEGATLLLGGNKVEGVANFYAPTVFANVTPDMTAFKQELFGPVAAIITARDADHAVELANDSEFGLASTIYTADYALAERMTAALDTGGVFINGYCASDPRVAFGGVKKSGFGRELSHFGVREFTNAQTVWLDRN

SEQ ID NO: 17361 - protein, 442 aa, Pseudomonas putida KT2440
MRTLDVHPIIDNARFTPFHWMVMAWCGLLLIFDGYDLFIYGVVLPVIMKEWGLTPLQAGALGSYALFGMMFGALAFGSLADRIGRKKGIAICFALFSGATILNGFASNPSEFGIYRFIAGLGCGGLMPNAVALMNEYAPKRLRSTLVAIMFSGYSLGGMLSAGVGIFMLPRFGWESMFFAAAVPLLLLPVILYYLPESIGFLVRQGRIEEARTLLKRLDPDCDVQADDVLQAADRKGSGASVLELFRNGLAIRTLALWVAFFCCLLMVYALSSWLPKLMANAGYSLGSSLSFLLALNFGGMAGAILGGWLGDRYNLVKVKVAFFIAAALSISLLGVNSPMPVLYLLIFIAGATTIGTQILLYAGAAQMYGLSVRSTGLGWASGIGRNGAIVGPLLGGALMGINLPLQLNFIAFAIPGAIAALAMAVHLASGRRHAQTLAAQA

SEQ ID NO: 17362 - protein, 365 aa, Pseudomonas putida KT2440
MKLLQPLQIGPLTLPNRVFMAPLTRLRSLEPGDVPTALMAEYYRQRASAGLIITEATQISFQAKGYSGSPGIHSAEQIAAWKHINEGIHAEGGHSAVQVWHTGRVSHTSLQPGGKAPVAPSALPADARTTLRDAQGNLTRVETSAPRALSEAEIAGIVADFGQAAINACEAGFDFIELHAAHGYLLHQFLTPSANQREDRYGGSVENRARIVLEAVDAAIANWSADRVGIRVFPLGGFNGVDNGEDQEAAGLYLIRELAKRNLAYLHLSEPDWAGGKPLRDEFRQAIRAAYPGVIIAAGAYTAEKGEDLIGRGLIDAVAFGRAYIANPDLVERLRLQAPLNEHRAKFDYANGPEGYTDYPFLKQA

SEQ ID NO: 17363 - protein, 506 aa, Pseudomonas putida KT2440
MTQYAVARLAQLDEHRPLRVQAGSEELILVRQGEQVHAYQGNCPHAGAPLDEGVVCGGLLVCPWHKATFAVDDGVVCEPPALADLRRYKAWIKGDEVWVDDQPLPATEPPRHSDARCFVVVGAGAAGSAAVATLLAHGFAGRLVWIDQERQPAYDRTALSKFVIAGQMPPDEVPALLEADALRKGQLERKYGKVRTLNSQKRQVTLADGQQIDYDACLLATGGKALRPDIPGADLPGVFTLRSLEDAARLLDAAEPGQPVVIVGDGFIGLEAASALRKYGVQVHVVSRHEVPLARQLGERIGRCIRALHERKGITFHGPTEVERIEGLDKVEAVQLTNGERLQTPLVLLGTGVRPATAFLQGVPLGEDKSVRVDAEMRAADGLWAAGDIATFPLTGRPVRIEHWRLAQQHGVIAAANMLGEQRRYADVPFFWTYQHGRTYEVLGHARDWNRIEFVGEPEKGDFVALQCVDERVEAVIAKGYSDAMATLSQRLKRPLSLQEAWALIG

SEQ ID NO: 17364 - protein, 297 aa, Pseudomonas putida KT2440
MTASPLLTAFLPLALGIIMLGLGLSLTLADFARVVKYPKPVVVGLVCQILLLPLVCFLIANGFGLESALAVGLMLLAASPGGTTANLFSHLAHGDVALNITLTAVNSLIAILTMPLLVNLSLSWFMASDQAIPLQFAKVMQVFAIVLLPVALGMLIRHFAPAFAARMEKPMKLVAALFLAFTIVLALAKDWQTVVEYAPVVGLAALLFNLLSLTVGYWVPRLLNISKRQAIAIGMEIGIHNGTLAIALALSPSLLNNATMAVPAALYSLIMFFTAAGFGWWVSRGHVAAEPKGETVN

SEQ ID NO: 17365 - protein, 482 aa, Pseudomonas putida KT2440
MLQVPLLIGGQSRPASDGRTFERCNPVTGEVVSQAAAATLADADAAVAAASAAFPAWAALAPGERRSRLLAGADLLQARAAEFIAAAGETGAMANWYGFNVKLAANMLREAAAMTTQITGEVIPSDVPGSFAMALRAPCGVVLGIAPWNAPVILATRAIAMPLACGNTVVLKASELSPAVHRLIGQVLHDAGIGDGVVNVISNAPQDAPAIVERLIANPAVRRVNFTGSTHVGRIVGELAARHLKPALLELGGKAPLLVLDDADLDATVEAAAFGAYFNQGQICMSTERLVVDSCIADAFVDKLAVKIAGLRAGDPQASTSVLGSLVSAAAGERIKALIDDAVAKGARLVSGGQLEGSILQPTLLDNVDASMRLYREESFGPVAVVLRAEGDEALLQLANDSEFGLSSAIFSRDTSRALALAQRVESGICHINGPTVHDEAQMPFGGVKSSGYGSFGSRTAIDQFTQLRWVTLQHGPRHYPI

SEQ ID NO: 17366 - protein, 331 aa, Pseudomonas putida KT2440
MQYVKLGSTGLDISRLCLGCMTFGEPDAGTHPWTLGEDASRPIIRHAVEQGINFFDTANSYSAGTSEIILGKLLREFTRREETVIATKVFFPANMWEGASRPNEQGLSRKAIMANIDASLSRLGTDYVDLYQIHRWDYHTPIEETMEALHDVVKAGKARYIGASSMYAWQFAKAQQVAANHGWSRFVSMQNYLNLIYREEEREMIPLCLDQGVGLMPWSPMARGRLTRPHGQQTQRTRTDVSGQSFYEKTEVEDGRVIDVVEQIASERGVPMAQVALAWVLGRAGVSAPIVGASKPAHLDDALGALSLQLSEDEVARLQAPYVPHAVTGFK

SEQ ID NO: 17367 - protein, 316 aa, Pseudomonas putida KT2440
MHEHDVLCFGETMAMFVAEQAGDLAGVGQFGKRIAGADSNVAIGLARLGFKVRWLSRVGDDSLGRFVLDSLRCEGLDCSGVEVDANYPTGFQLKARSEDGSDPAVEYFRRGSAASRLSAAMVSPVWLQARHVHATGIPLALSDSCRALSHALLDGMRAAGRSISFDPNLRPSLWPDQSSMVREINALAAKADWVLPGLEEGRLLTGQHTPADIAAFYLDQGVELVVIKLGDAGAYFRSAKGEGQVAPVPVSRVVDTVGAGDAFAVGVLSALLEGRPVAEAVARGNWCGSRAVQSRGDMEGLPLRHELEAYDLRRSA

SEQ ID NO: 17368 - protein, 497 aa, Pseudomonas putida KT2440
MLSELPILPATRAFLERKLKMRIGADWQDAASGRTLSFRNPATGEVLGEVPAAEAEDVDRAVRAARQAFDDSPWSRMRPRERQNLLWRLADLMERDARQLAELECLNNGKSAAVAQMMDVQLAIDFLRYMAGWATKIEGSTVEASMPLMPNDQFHGFVRREAVGVVGAIVAWNFPLLLACWKLGPALATGCTVVLKPADETPLSVLKLAELVDEAGYPAGVFNVVTGTGLNAGAALSRHPGVDKLTFTGSTEVGKLIGKAAMDNMTRVTLELGGKSPTIVMPDANLQEAAAGAATAIFFNQGQVCCAGSRLYVHRKHFDNVVADIAGIANAMKLGNGLDPAVQMGPLISAKQQDRVTGYIELGRELGATIACGGEGFGPGYFVKPTVIVDVDQRHRLVQEEIFGPVLVAMPFDDIDEVIGMANDNPYGLGASIWSNDLAAVHRMIPRIKSGSVWVNCHSALDPALPFGGYKMSGVGREMGSAAIEHYTELKSVLIKL

SEQ ID NO: 17369 - protein, 260 aa, Pseudomonas putida KT2440
MTAPLSLATLAPEPDPRPVLIRIEGLNKHYGAFHVLRDIDLQVREGERIVLCGPSGSGKSTLIRCINRLEVAQQGSIQVDGIDLAATTREAAQVRSDIGMVFQHFNLFPHMSVLDNCLLAPTSVRGLSRKDAEERARMYLSKVGIESQAHKYPSQLSGGQQQRVAIARALCMKPRIMLFDEPTSALDPEMVAEVLDVLVQLAGTGMTMLCVTHEMGFARQVAERVLFLEGGQIIEDSPPQVFFNQPRTERAKAFLAQILH

SEQ ID NO: 17370 - protein, 493 aa, Pseudomonas putida KT2440
MTLVRFQMCIDGQWRDAQSGKTFDSLNPATAQAWAQLPDADEADVELAVQAAQRAFDSKAWRSITATARGKLLRRLGDLIAENKEHLAQLESRDNGKLIRETRGQVGYLPEFFHYTAGLADKLEGGTLPLDKPDLFAYTVHEPIGVVAGIIPWNSPLYLTAIKLAPALAAGNTIVLKPSEHASATILELARLALEAGFPAGVVNVVTGYGPSTGAALTRHPLVRKIAFTGGAATARHVVRSSAENFAKLSLELGGKSPNIIFADADLDSAINGAVAGIYAASGQSCVAGSRLLVQDEIFDEFVERLIARAKRIRIGNPQDDASEMGPMATAQQLAVVEGLVAAAKAEGAKLHMGGKRADVEGDGWFYEPTLFECDSNAMTIMQEEVFGPVAAVIRFKTEEEALAMANDSQFGLAAGIWTRDLGRAHRLARDVRSGIIWVNTYRAVSAMAPIGGFKNSGYGRESGIDSVLAYTELKTVWINLSTAPMPDPFVMR

SEQ ID NO: 17371 - protein, 450 aa, Pseudomonas putida KT2440
MSSLNMYTLTEESKFNRFHGLILFWCVLILIIDGYDLAVVGAALPAIMADMQIDATSAGVMAGSALFGTMLGAIFLGTLADRIGRPKMIAICVALFSVFTAAAGFTDSPLTFSIMRFIAGLGIGGVLPICTAQMGEFSPLKVRTRLVTIVFAGYSVGGILVALTGKQLIESYGWQYVFYVAVLPVVLIPFILKSMPDSIGFMLKQGRQDELKVIARRLRPDLVIKDDTQFVGNPQIISAQDKPVRSLFLEGRGYSTVMIWMAFMTGLFMVYALNSWLTKLMAMAGFSLGSALNFVIVFNLGSIFGAILGGWLSDKFSIKHVLVVFYVVGAVALTLLGYTRSTELLFVVVFIVGASTLGTQLLAYAYAGDFYPSTIRSTGVGFASGVGRVGAIVAPVLIGALVSMALPLEQNFMAIALAGLVGAVAVTMINQSRSDSAVVRKKATVAHELT

SEQ ID NO: 17372 - protein, 468 aa, Pseudomonas putida KT2440
MTDSVEKIQLTRALKSRHIFMLSLGGVIGTGLFMGSGVTINQGGPVGAILAYLVAGLLMYLVMVCLGELSVQMPVSGSFQAHATKYIGPATGFMIGWVYWMSWATTVGLEFTAAGMLMTRWFPEVPIWYWSALFVVVLFGLNALATRAFGEAEYWFSGIKVATILGFIVIGLLVIFGAIPLSSGAPAPMLNNLVGESLFPHGLSAVFAVMMTVVYAFQGCEIMGVAAGETEHPEKSIPRAVRNVVFRVLIFYVLAIAVLSAIVPHEQAGLMESPFVQVFDMVGIPYAADLMNFVILTAILSVGNSGLYASTRILWAMSKTGMAPKSLSPLSKRGVPLRALSITLCFALISLMTSFVAADTLFMVLMAVSGMSGTVTWIVIALAQYRFRKAWLRDGGQLQDLKYKAPLYPLVPLLCITLCSSLFVFLALDETQRPSLYWGFGFIALCYAAYFFVNRRRQGAFAPSTPGV

SEQ ID NO: 17373 - protein, 446 aa, Pseudomonas putida KT2440
MNTDLKQRLDNDPMGRFQCLAIGICIILNMIDGFDVLVMAFTAASVSAEWGLNGAQVGLLLSAGLFGMAAGSLFIAPWADRFGRRPLILLCLALSGIGMLLSALSQSPLQLALLRGLTGLGIGGILASSNVIASEYASERWRGLAVSLQSTGYALGATLGGLLAVWLLGHWGWRSVFLFGGVVTVLVIPLVLLWLPESLDFLLARRPANALARVNRLAVRLGQPALAQLPAVAARAEGAKTGFRQLLAPAMRRTTLVIWLLFFLVMFGFYFVMSWTPKLLVAAGLSAQQGITGGVLLSVGGIVGAALIGGLASRWPLTRVLALFMLITAALLVLFVANGASVTAALALGLLIGLFSNGCVAGLYALSPVVYDASVRATGVGWGIGIGRMGAILSPTVAGVLLDGGWQPLHLYGVFASVFVLAAGCLLLLRPTAKPASALPADALSH

SEQ ID NO: 17374 - protein, 451 aa, Pseudomonas putida KT2440
MAFDFDLFVIGAGSGGVRAARFAAGFGAKVAVAESRYLGGTCVNVGCVPKKLLVYGAHVADELEQAAGFGWTLEEGHFDWGTLIANKNREIERLNGIYRNLLVNSGVTLLQGHARLTGANEVEVDGQRYTAEHILIATGGWPQVPDIPGKELAITSNEAFYLKDLPRRVLVVGGGYIAVEFAGIFQGLGADTTLLYRGDLFLRGFDGSVRTHLKQELEKRGLDLQFNADIQRIDKLEDGRLKATLKDGRELVADCVFYATGRRPMLDNLGLENTGVELDERGYIRVDEQYQTTAPSILAIGDVIGRVQLTPVALAEGMAVARRLFKPEQYRPVDYQNIPTAVFSQPPIGTVGLTEEQALEAGHKVQVFESRFRAMKLTLTDIQEKTLMKLVVDAETDKVLGCHMVGPDAGEIIQGLGIALKAGATKQQFDETIGVHPTAAEEFVTMRTVTR

SEQ ID NO: 17375 - protein, 336 aa, Pseudomonas putida KT2440
MKAAVVAPGRRVDVIEKSLRPLEHGEALLKMQCCGVCHTDLHVKNGDFGDKTGVVLGHEGIGVVQEVGPGVTSLKPGDRASVAWFYQGCGHCEYCNSGNETLCRDVKNSGYTVDGGMAEACIVKADYSVKVPDGLDSAAASSITCAGVTTYKAVKISNVRPGQWIAIYGLGGLGNLALQYAKNVFNAKVIAIDVNEEQLRFASEMGADLVVNPLNEDAAKVIQAKTGGAHAAVVTAVAKGAFNSAVDALRAGGRLVAVGLPSESMDLNIPRLVLDGIEVVGSLVGTRQDLQEAFQFAAEGKVVPKVTLRPIEDINQIFDEMLEGKIKGRMVIQFEG

SEQ ID NO: 17376 - protein, 231 aa, Pseudomonas putida KT2440
MINKTYESIASAVEGITDGSTIMVGGFGTAGMPSELIDGLIATGARDLTIISNNAGNGEIGLAALLMAGSVRKVVCSFPRQSDSYVFDELYRAGKIELEVVPQGNLAERIRAAGSGIGAFFSPTGYGTLLAEGKETREIDGRMYVLEMPLHADFALIKAHKGDRWGNLTYRKAARNFGPIMAMAAKTAIAQVDQVVELGELDPEHIITPGIFVQRVVAVTGAAASSIAKAV

SEQ ID NO: 17377 - protein, 455 aa, Pseudomonas putida KT2440
MTNALNHLPRPRAGADQLAERFSDLAPPLTARQAALESARCLYCYDAPCVNACPSEIDIPSFIHRISDENLQGAAERILSANILGGSCARVCPTEILCQQACVRNNAQECAPVLIGQLQRYALDNAQFSAHPFKRSAATGKRIAVVGAGPAGLSCAHRLAMHGHDVVVFEACDKAGGLNEYGIARYKLVDDYAQREVDFLLGIGGIEVRHGQRLGGNLSLGELRDQYDAVFLGLGLNAVRQLGLPDEEAPGVVAATEYIRELRQADDLSQLPLADRCLVIGAGNTAIDMAVQMSRLGARDVNLVYRRGHADMGATGHEQDIAKANQVRLHTWARPDAVLLDDAGKVRGMRFARTELAEGRLRDTGETFELAADAIFKAIGQRFDDASLGDPVAAQLAREGERIRVDENLQTSLPGVYAGGDCTALGQDLTVQAVQHGKLAAEAIHAQLMLNVEAA

SEQ ID NO: 17378 - protein, 327 aa, Pseudomonas putida KT2440
MQLGIIGLGRMGGNIARRLMRAGHRTVVHDRNRDAITGLEGEGAQGAHDLGALVQKLKAPRAVWVMLPAGDATEQTIAQLAEMLEPGDAIIDGGNTFYKDDMRRAAELAKRGLHYLDVGTSGGVWGLDRGYCMMIGGEKDVFERLEPLFKALAPGVGDIPRTHGRSGEHQRAEHGYIHAGPPGAGHYVKMVHNGIEYGLMQAYAEGFDLLRSKGGNELPEDQRFDLNVAEIAEVWRRGSVVTSWLLDLTADALVADPQLSQFSGSVSDSGEGRWTIDAAVEQAVPVPVLSSALFARFRSRQQQGTYGDKILSAMRLGFGGHVEKKGE

SEQ ID NO: 17379 - protein, 1106 aa, Pseudomonas putida KT2440
MAKRSRPAAFIDDPLWYKDAVIYQLHIKSFFDSNNDGIGDFAGLISKLDYIAELGVNTLWLLPFYPSPRRDDGYDIAEYKAVHPDYGSMADARRFIAEAHKRGLRVITELVINHTSDQHPWFQRARHAKRGSKAREFYVWSDDDQKYDGTRIIFLDTEKSNWTWDPVAGQYFWHRFYSHQPDLNFDNPQVLKAVIGVMRFWLDLGVDGLRLDAIPYLIERDGTNNENLAETHDVLKAIRAEIDANYPDRMLLAEANQWPEDTRPYFGEGDGDECHMAFHFPLMPRMYMALAMEDRFPITDILRQTPEIPANCQWAIFLRNHDELTLEMVTDRERDYLWNYYAEDRRARINLGIRRRLAPLLQRDRRRIELLTSLLLSMPGTPTLYYGDELGMGDNIYLGDRDGVRTPMQWSPDRNGGFSRADPQRLVLPPIMDPLYGYQTVNVEAQSHDPHSLLNWTRRMLAVRKQQKAFGRGSLRTLTPSNRRILAYIREYTDADGNTEVILCVANVSRAAQAAELELSQYADKVPVEMLGGSAFPPIGQLPFLLTLPPYAFYWFLLASRDRMPSWHIQPTEGLPELTTLVLRKRMEELLQAPASDTLQSTILPQYLPKRRWFAGKEGPIDAVRLCYGVRFGTATTPVLLSEIEVLSDGTATRYQLPFGLLREEQIHTALPQQLALSRVRRAHQVGLITDAFVLEPFIHAVMQACQDGLRLPCGDAEGELRFECTEQLAGLALDEESEVRYLSAEQSNSSVVIGDRVVLKLIRRVNPGIHPELEMSAYLTAAGFANISPLLAWVSRVDEQHAPHLLMIAQGYLSNQGDAWGWTQNTLERAIRDQMEPTRNDAEAHTDALAELSGFAALLGQRLGEMHLLLAAPTEDPAFQPRPSDAQDSERWCAQISTELTHALDLLAQHRDTLDSDSQSLVDDLQQQRDGLAQHIDTLSKQAQGGLLMRVHGDLHLGQVLVVQGDAYLIDFEGEPARPLEERRAKHSPYKDVSGVLRSFDYAAAMILRSASAVDLSEPARQARQRVARQYLHQSRHAFVEAYGLATAAMPHAWQHAEGERAALELFCLEKAAYEITYEAENRPSWLAVPLHGLHGLISTWGESE

SEQ ID NO: 17380 - protein, 460 aa, Pseudomonas putida KT2440
MASQDNKKQRSLQHGLTSRQVSMISIAGIIGAGLFIGSSNAIATAGPAILISYAMTGLLVLLVMRMLGEMAIANPNSGSFSTYASEAIGPWAGFTIGWLYWWFWVLIIPVEAIAGADILHAYFPGVPSWLFAFLIMLVLSGTNLVSVKNFGAFEYWFALVKVVAIIGFIGVCTLAVFGFWPLAEVSGVSRLWDSGGFMPNGFGTVLGGVLITIFSFFGAEIVTIAADETANPKDKIRRATNLVVYRIAIFYLASIFLVVSLVAWNDPGLKAVGSFQRVLEVLNVPGAKLLVDLVVLVAVTSCMNSGLYTASRMLYSLGARGQALSVTKRISGSGVPTVAVIFSTLAGFAGCFVNYVFPGKVFGFLLSTTGAIALLVYLVIAVSQLRMRARAEREGRPLELKMWLFPWLTWLVIGTIVMVLGYMLFSDAYRYETLMTAGVTAFILLVSLTQRRAKMVAQTA

SEQ ID NO: 17381 - protein, 416 aa, Pseudomonas putida KT2440
MNQESISQSIAIVHPITLSHGRNAEVWDTDGKRYIDFVGGIGVLNLGHCNPAVVEAIQAQATRLTHYAFNAAPHGPYLALMEQLSQFVPVSYPLAGMLTNSGAEAAENALKVARGATGKRAIIAFDGGFHGRTLATLNLNGKVAPYKQRVGELPGPVYHLPYPSADTGVTCEQALKAMDRLFSVELAVEDVAAFIFEPVQGEGGFLALDPAFAQALRRFCDERGILIIIDEIQSGFGRTGQRFAFPRLGIEPDLLLLAKSIAGGMPLGAVVGRKELMAALPKGGLGGTYSGNPISCAAALASLAQMTDENLATWGERQEQAIVSRYERWKASGLSPYIGRLTGVGAMRGIEFANADGSPAPAQLAKVMEAARARGLLLMPSGKARHIIRLLAPLTIEAEVLEEGLDILEQCLAELN

SEQ ID NO: 17382 - protein, 478 aa, Pseudomonas putida KT2440
MTQKFDVVVIGAGPGGYVAAIKAAQLGLKTACIEKYTDAEGKLALGGTCLNVGCIPSKALLDSSWKYKEAKESFNVHGISTGEVKMDVAAMVGRKAGIVKNLTGGVATLFKANGVTSIQGHGKLLAGKKVEVTKADGTTEVIEAENVILASGSRPIDIPPAPVDQNVIVDSTGALEFQAVPKRLGVIGAGVIGLELGSVWARLGAEVTVLEALDTFLMAADTAVSKEAQKTLTKQGLDIKLGARVTGSKVNGNEVEVTYTNAEGEQKITFDKLIVAVGRRPVTTDLLASDSGVTIDERGYIFVDDYCATSVPGVYAIGDVVRGMMLAHKASEEGIMVVERIKGHKAQMNYDLIPSVIYTHPEIAWVGKTEQALKAEGVEVNVGTFPFAASGRAMAANDTGGFVKVIADAKTDRVLGVHVIGPSAAELVQQGAIAMEFGTSAEDLGMMVFSHPTLSEALHEAALAVNGGAIHVANRKKR

SEQ ID NO: 17383 - protein, 318 aa, Pseudomonas putida KT2440
MSLNPDLAAYLQLVEAGRSAGKVLPMHALAADEARRQFEESSALIAGKADEPDCISDLSLTTRDGHTLPVRLYRPPQADPALAGAALLYLHGGGYVVGSLDSHDTLCWNLAQDAGVPVIAVGYRLAPQWRFPTASDDALDAWRWLVEQAEALGIDAQRLAVVGDSVGGSLATILANQLAAQRELPAPRLQVMIYPVTDASCRRPSVQRYGSGYLLEAQTLEWFYQQYATVPADRHDPRFSPLLGSVASNSAPALMLIAECDPLHDQGVAYARHLEQAGVAVQLAVIPGVTHDFMRMGSIIEEADEGLAMVVEALQQHL

SEQ ID NO: 17384 - protein, 452 aa, Pseudomonas putida KT2440
MPQPLYEFTDSPLLQRQQQQESNARSYPRRIPLALRRARGIHVEDVEGRQFIDCLAGAGTLALGHNHPVVVEAIQRVLADELPLHTLDLTTPVKDRFVQDLFGILPEALRREAKVQFCGPTGTDAVEAALKLVRTATGRSTVLAFQGAYHGMSQGALNLMGSHGPKQPLGALLGNGVQFMPYPYDYRCPFGLGGEAGVKANLHYLENLLLDPESGVPLPAAVILEVVQGEGGVVPADIEWLKGVRRITEQAGVALIVDEIQSGFARTGRMFAFEHAGIVPDVVTLSKAIGGSLPLAVVVYRDWLDTWKPGAHAGTFRGNQMAMAAGSAVINYLVEHRLAEHAEAMGQRLRGHLQRLQRDYPQLGDIRGRGLMLGVELVDPQGQPDALGHPPANRDLAPKVQRECLKRGLILELGGRHGAVVRFLPPLIISAEQIDEVAQRFSAAVAAAVGSV

SEQ ID NO: 17385 - protein, 230 aa, Pseudomonas putida KT2440
MSLGKRMGAELIGTFWLVLGGCGSAVLAASSPLGIGVLGVAFAFGLTVLTMAFAIGHISGCHLNPAVSFGLVVGGRFPAKELLPYVIAQVIGAILAAGVIYLIASGKAGFELSAGLASNGYADHSPGGYTLGAGFVSEVVMTAMFLVVIMGATDARAPAGFAPIAIGLALTLIHLISIPVTNTSVNPARSTGPALFVGGWALQQLWLFWVAPLIGAAIGGALYRGLAKEP

SEQ ID NO: 17386 - protein, 449 aa, Pseudomonas putida KT2440
MESRKSEAPTLDLAPPLETSWLERIFKLKQHGSTVRTEMIAGVTTFITMAYIIFVNPNIMADAGIDHGAAFVATCIAAALGCLLMGLYANWPVGLAPGMGLNAFFTYTVVGTMGYNWETALGAVFVSGVLFMFLTLSKVREWLLNSIPVSLRHAMGAGVGLFLGLIGLKTAGIIVDSPATLIKLGSLHEPGPLLAAVCFLLIAILSYKRVFGAILISIMGVTLAGWGLGLVKFGGVMSMPPSLAPTWMAMDVAGVFNVSMISVVLAFLFVHMFDTAGTLMGVAQRANLVAPDGRIENLSKALKADSASSVFGAVVGVPPVTSYVESAAGVAAGGRTGLTAVVVGLLFIAAMFFAPLAGMIPAYATAGALIYVAMLMMGSMAHIHWDEATDSIPAIVTVIMMPLTFSVADGIALGFISYVALKAGTGKYKEISASLWVLCAIFIAKFVFL

SEQ ID NO: 17387 - protein, 297 aa, Pseudomonas putida KT2440
MAKIGFIGTGIMGKPMAQNLQKAGHSLFISTHHDAAPADLIAAGAVALANPKEVAQEAEFIIVMVPDTPQVESVLFGENGVAEGVGPNKVVIDMSSISPTATKAFAEKIKATGAAYLDAPVSGGEVGAKAATLSIMVGGCPNAFERTLPLFEAMGKNITRVGGNGDGQTAKVANQIIVALNIQAVAEALLFAAKNGADPAKVREALMGGFASSKILEVHAERMIKGTFDPGFRINLHQKDLNLALQGAKELGINLPNTSNAQQVFNTCQALGGGNWDHSALIKGLEHMANFSIRDDK

SEQ ID NO: 17388 - protein, 471 aa, Pseudomonas putida KT2440
MTPDKKVKILATLGPAINGIDDIRQLVEAGVNIFRLNFSHGEHADHALRYQWIREVEQQLNYPLGILMDLQGPKLRVGRFAEGKVQLQRGQALRLDLDKTPGDSRRVNLPHPEIIAALEPGMDLLLDDGKLRLRVTAKHSDAIDTEVLNGGELSDRKGVNVPQAVLDLSPLTEKDRRDLAFGLELGVDWVALSFVQRPEDIVEARQLIGDRAYLMAKIEKPSAVEQLQAIAELADAIMVARGDLGVEVPAESVPQIQKRIIGTCRQLGKPVVVATQMLESMRFSPAPTRAEVTDVANAVAEGADAVMLSAETASGDYPLEAVQMMSKIIRQVENGPDYQAQLDVGRPKAEATVSDAISCAIRRISGILPVAVLVNYSESGASTLRAARERPRAPILNLTPNLNTARRLSVAWGVHSVVNDRLRQVDEVVSTALEIAQAQGMASRGDTLLITAGVPFGKPGTTNTLRIETLI

SEQ ID NO: 17389 - protein, 459 aa, Pseudomonas putida KT2440
MQQIIQTTLLIIGGGPGGYVAAIRAGQLGIPTVLVEGQALGGTCLNIGCIPSKALIHVAEQFHQASRFTEPSPLGISVASPRLDIGQSVTWKDGIVDRLTTGVAALLKKHGVKVVHGWAKVLDGKQVEVDGQRIQCEHLLLATGSSSVELPMLPLGGPVISSTEALAPKTLPQHLVVVGGGYIGLELGIAYRKLGAQVSVVEARERILPTYDSELTAPVAESLKKLGIALHLGHSVEGYENGCLLASDGKGGQLRLEADQVLVAVGRRPRTKGFNLECLDLKMNGAAIAIDERCHTSMHNVWAIGDVAGEPMLAHRAMAQGEMVAEIIAGKARRFEPTAIAAVCFTDPEVVVVGKTPEQASQQGLDCIVAQFPFAANGRAMSLESKSGFVRVVARRDNHLIVGWQAVGVAVSELSTAFAQSLEMGACLEDVAGTIHAHPTLGEAVQEAALRALGHALHI

SEQ ID NO: 17390 - protein, 460 aa, Pseudomonas putida KT2440
MQSHGLKQSLKQRHITMIALGGVIGAGLFMGSGSLIASAGPAAILSYFIGGLVVTLVMFMLGEMACRNPDAGSFSTYANTYLGDWAGFAVGWLYWFKSMMTITLEAVLLGAILHDFLPWLPIWAGAFLMLVTLMASNAYSVRSFAEVEYWLAAMKVATILIFMLLGVSILLGLHSDIPAPGLINLTAHDGFMPNGLSPVMAGVIVVIFSLGGSEIAAVAAGESENPRQNVIRAIKSVILRVMLFYVGSVSILILCLPWTDKANLASPYVSLFSLAGFGGAAVAMKLVLFVSFMSVMNSFMFSNSRMLFSLSQRGHAPKLFSRTSAKGVPINALLLSLSICTMILTVHFVSGGDLFMTLAKSTGSLVMVVWIFIIIAHVAMRIKTRHEAVAPNAFRAWLFPYTNIIALFALLAVIGTQAFDPASRFQFWFTVLTVLLVVAGYFLMRQRLASSAVLAHERDA

SEQ ID NO: 17391 - protein, 463 aa, Pseudomonas putida KT2440
MDKQKQDLISQQDRGAVLHPFTQLKDFASGKAGDPTIIETAKGITITDATGREYIDGFAGLYCMNVGYGRTEVAEAISKQAHKLAYYHTYAAHTTEELARLSDRLVKMAPGKMSKVFYGMSGSDANETQAKLVWYYNNLRGKPNKKKIIARERGYHGCSVVSGSMTGMSFYHDHMDLPIAGILRTGAPHYYWGAEPGETELEFSARRARELEELILREGPDTIGAFIAEPVLGTGGITPPPEGYWAAVQPVLKKYDILLIADEVITGFGRTGAMFGCDKYGIEPDLITVAKGLTSAYAPLSASIVGEKVYKVMEEGADRVGAFSHGYTYSGHPIGVAAANAVLDIVEGENIPAHVDKVGQYFQKSMQETFSSLPIVGEVRGVGMMAAIEFVADPATKKRFDPALKVGARISKAARDRNLIARAMPHGEILGFAPPLVTTEQEVDRIISIAHEAVLSVLDELKV

SEQ ID NO: 17392 - protein, 490 aa, Pseudomonas putida KT2440
MKDLAPSALNKLRRNDLLETRAYIDGRWVTGEGSLDVTDPANDQVIAQVAHCDESWVDLAVEAASRAFDGWRNTLPTQRGAVLRKWAALMRENQEDLAVIMTCEQGKPLSESRGEINYGANFVEWFAAEGERCYGETIPSHLPNSQLVTKLQPIGVTVAITPWNFPSAMITRKAAAALAAGCPMIVKPAPETPLSALALARLAEEAGIPGGVFQVLTGDAPKMSARLLAASAVRAFSFTGSTEVGRILLRQSADTVKKVSLELGGHAPFIVFDDASIAEAVEGCIGAKFATSGQDCLGANRIYVHRNIYGQFVEEFTKATEKLRVGHGLEEGVDIGPMTRVTVANKCREQISNALSLGAKLTCGGIDNHLGSSFVLPTVLADVTDKMDIAFEETFGPVAAILPFDSEDEVVTRANNTEFGLAAYVYTNDLRRACRVSDRLEYGMVALNTPKFTGAPIPFGGWKQSGLGREGSKHGLAEYMELKYVCIGGL

SEQ ID NO: 17393 - protein, 406 aa, Pseudomonas putida KT2440
MSVEQAPVQRADFDQVMVPNYSPAAFIPVRGEGSRVWDQSGRELIDFAGGIAVNALGHCHPALVKALTEQANTLWHVSNVFTNEPALRLAHKLVDATFADRAFFCNSGAESNEAAFKLARRVAHDRFGPQKHEIIATVNSFHGRTLFTVSVGGQPKYSDGFGPKITGISHVPYNDLEALKAQISDKTCAVVIEPIQGESGVVPADKAYLEGARKLCDEHNALLIFDEVQTGVGRTGSLYAYQHYGVIPDILTSAKSLGGGFPIGAMLTTTELAKHLAVGTHGTTYGGNPLGCAVACAVLDVVNTPETLAGIKAKHERFKTRLEQIGQQYNLFSQVRGVGLLLGCVLTEAWKGKAKDVLNAAEKEGVMVLQAGPDVVRFAPSLVVEDADIDEGLDRFERAVATLTKG

SEQ ID NO: 17394 - protein, 472 aa, Pseudomonas putida KT2440
MSGQNMHSGELKRGLKNRHIQLIALGGAIGTGLFLGSAGVMKSAGPSMILGYAICGFIAFMIMRQLGEMIVEEPVAGSFSHFAHTYWGGFAGFLSGWNCWVLYILVGMSELSAVGKYVHYWWPEIPTWVTAAAFFVLINAINLMNVKFFGEAEFWFAIIKVVAIVSMIGLGAYLLTSGSGGPEATVANLWTHGGFFPNGVSGLVMALAFIMFSFGGLEMLGFTAAEADKPKTVIPKAINQVIYRILIFYVGALVVLLSLTPWDNLVASIDASGGSYGSSPFVQVFSLLGSDVAANLLNFVVLTAALSVYNSGTYCNARMLLGMAEQGDAPASLAKVDKRGVPVRSILVSAAVTFVAVLLNYLMPQNALELLMSLVVATLVINWAMISYSHLKFRQHLDRTGQKPLFKALWYPYGNYVVLAFVVLILGIMLMIPGIQVSVYAIPVWLLAMLVVYMVKSRRQVNAGGAVETVAK

SEQ ID NO: 17395 - protein, 320 aa, Pseudomonas putida KT2440
MRPTVDKTLHQPLGGNEMPRFGGIATMLRLPHLQSAKGLDAAFIGVPLDIGTSLRSGTRFGPRQIRAESVMIRPYNMATGAAPFDSLSVADIGDVAINTFNLLDAVRIIEEAYDEIVEHNVIPMTLGGDHTITLPILRALHKKHGKIGLVHIDAHADVNDHMFGEKIAHGTTFRRAVEEGLLDCDRVVQIGLRAQGYTADDFNWSRRQGFRVVQAEECWHKSLEPLMAEVREKVGGGPVYLSFDIDGIDPAWAPGTGTPEIGGLTTIQAMEIIRGCHGLDLIGCDLVEVSPPYDTTGNTSLLGANLLFEMLCVLPGVVRR

SEQ ID NO: 17396 - protein, 454 aa, Pseudomonas putida KT2440
MHFAPVEQATRFLADNPDIELFELFILDANGVPRGKLLHREELLAVYQTGRPLPSTILGLTLNGDDVENSGLVWDVGDIDCRAYPLDGSLVRLPWRRVPTAAVQVSMHPSEGLPASIADPRHVLLRTIEALKADGYHPVMACELEFYLLDQQRDAQGRPQPALDNDGGRPRSTQVYGLRELEQIEPFLADLYAACKAQGIPARTAISEYAPGQVEITLEHGDALQAMDQAVRYKRLVKGVAHAHGMQACFMAKPFAQLAGTGMHMHLSLADSAGNNLFASEDKAGTPLLRQAVAGMLRHLRDSLLLFCPNANSFRRFQANSYAPLAPTWGVDNRTVSLRVPGGPANSRHVEHRICGADANPYLAAAAILAASHWGIREQLDPGAPVEGNGYAQATEHLPTDWLTALDALQHSDWAREALGEDFLGVYLKVKRAEYRQFMAEVSEQDWRWYLHQA

SEQ ID NO: 17397 - protein, 324 aa, Pseudomonas putida KT2440
MSRIFADNAHSIGNTPLVQINRIAPRGVTILAKIEGRNPGYSVKCRIGANMVWDAESSGKLKPGMTIVEPTSGNTGIGLAFVAAARGYKLMLTMPASMSLERRKVLKALGAELVLTDPAKGMKGAIEKANEIVASDPEQYFLPGQFENPANPAIHEKTTGPEIWNDTDGAIDVLVAGVGTGGTITGVSRYIKHTQGKAILSVAVEPVASPLISQTLAGEELKPSPHKIQGIGAGFVPKNLDLSIVDQVETVTDEESKAMAIRLMQEEGILCGISCGAAMAAAVRLAEKPEMQGKTIVVILPDSGERYLSSMLFSDMFSEQETQQ

SEQ ID NO: 17398 - protein, 428 aa, Pseudomonas putida KT2440
MNPTGVQQQVSTLPSSGPFAWYRDIDKQQRRTFWSCKIGYGLDGMDTQMLSFVIPTLIMLWGITTTEAGLIHTSTLIASAVGGWVAGILSDRIGRVRTLQLTVLWFAFFTFLCGFAQNYEQLLIARTLMGFGFGGEWTAGAVLIGEVIRAQDRGKAVGMVQSGWAIGWGLTAILYALLFSWLPAEQAWRALFLLGLVPAIFVIFVRRLVKDPEVYRKAKAVENAEAPSRFYEIFAPGMLWTTVRASLLTTGALGGYYAITSWLPTFLKNERGLSVLGTGGYLAMVIVGSYMGYVVSAYLSDLLGRKKNFILFAVGSFVIVLLYTQMPVSDGVMLWLGLPLGFFASGIFSGMGAFLTELFPTRIRGSGQGFCYNIGKVIAALFPLMIGMLGQNVPLGLGIGVFSAVSYGIVIVAALSLPETRGKQLQAR

SEQ ID NO: 17399 - protein, 456 aa, Pseudomonas putida KT2440
MAKAKRLYGCTECGATFPKWAGQCGECGAWNTLVETMIESGGAAAPSSGRAGWTGQQAQIKTLAEVSVEEIPRFTTSSTELDRVLGGGLVDGSVVLIGGDPGIGKSTILLQTLCNIAVGMPALYVTGEESQQQVAMRSRRLGLPQDQLKVMTETCIETIIATARVEKPRVMVIDSIQTIFTEQLQSAPGGVAQVRESTALLVRYAKQSGTAIFLVGHVTKEGSLAGPRVLEHMVDTVLYFEGESDGRLRLLRAVKNRFGAVNELGVFGMTDRGLKEVSNPSAIFLNRTQEEVPGSVVMATWEGTRPMLVEVQALVDDSHLANPRRVTLGLDQNRLAMLLAVLHRHGGIPTHDQDVFLNVVGGVKVLETASDLALLAAVMSSLRNRPLAHGLLVFGEIGLSGEVRPVPSGQERLKEAAKHGFKRAIVPKGNAPKEAPAGLQVIAVTRLEQALDALFE

SEQ ID NO: 17400 - protein, 431 aa, Pseudomonas putida KT2440
MLERLFQLRAHNTNVRTEILAGVTTFLAMAYILFVNPSILGETGMDKGAIFVATCLAAAIGSATMGLIANYPIALAPGMGLNAFFTYTVVLHMGHTWQVALGAVFLSAVMFFLLSIFRIREWIVNSIPLPLRSAIAAGIGLFLALIALHNAGIVVDNPATLVGMGDLKQPSVILATLGFFLIVGLESLKVRGAVLIGILAVTVASIAMGVTPFGGIVSMPPSLAPTFLQLDIAGALDVGLISVIFAFLFVDLFDNSGTLIAVAKRAGLMGKDGHMPKMGRALIADSTAAMAGSLLGTSTTTSYIESAAGVSAGGRTGLTAIVVAVLFLLALFFAPLAGSVPAFATAPALLFVAVLMASGLAEINWDDVTEAAPVVVTALAMPLTYSIANGIAFGFIAWTAVKLISGRHRELNSALVILSILFVIKLGWFNA

SEQ ID NO: 17401 - protein, 295 aa, Pseudomonas putida KT2440
MRIAFIGLGNMGAPMARNLIKAGHQLNLFDLNKAVLAELAELGGQISPSPKDAAANSELVITMLPAAAHVRSVYLNEDGVLAGIRPGTPTVDCSTIDPQTARDVSKAAAAKGVDMGDAPVSGGTGGAAAGTLTFMVGASTELFASLKPVLEQMGRNIVHCGEVGTGQIAKICNNLLLGISMIGVSEAMALGNALGIDTKVLAGIINSSTGRCWSSDTYNPWPGIIETAPASRGYTGGFGAELMLKDLGLATEAARQAHQPVILGAVAQQLYQAMSLRGEGGKDFSAIVEGYRKKD

SEQ ID NO: 17402 - protein, 251 aa, Pseudomonas putida KT2440
MRRPMVAGNWKMHGTRASVAELTKGLSNLALPSGVEVAVFPPALFINQVIDGLAGKEITVGAQNSAVQPEQGALTGEVAPEQLVEAGCKLVLIGHSERRQIIGETDEVLNRKFAAAQAKGLKPVLCIGETLEEREAGKTLEVVGRQLSSIIEAFGVKAFADAVIAYEPVWAIGTGLTATPQQAQDVHAAIRGQLAAEDAEVAAKVQLLYGGSVKAANAAELFGMPDIDGGLIGGASLNADEFGAICRAAGN

SEQ ID NO: 17403 - protein, 375 aa, Pseudomonas putida KT2440
MSKRDYYEVLGVERGATEADLKKAYRRLAMKYHPDRNPGDKESEDKFKEANEAYEVLSDASKRAAFDQYGHAGVDPSMGGGGAGFGGANFSDIFGDVFSDFFGGGGRGGGRGGAQRGSDLRYTLELNLEEAVRGTTVSIRVPTLVNCQPCDGSGAKKGSTPSTCPTCGGIGQVRMQQGFFSVQQTCPRCHGQGKIITDPCTSCHGEGRVEEYKTLSVKVPAGVDTGDRIRLSGEGEAGTHGGPTGDLYVVISVREHEIFQRDGKHLYCEVPISYTDAALGGELEVPTLDGRVKLKIPEGTQTGKQFRLRGKGVAPVRGGGAGDLLCRVAVETPVNLSRRQRELLEELRDSLEGDSSHSPKASGWFDGVKRFFGDL

SEQ ID NO: 17404 - protein, 269 aa, Pseudomonas putida KT2440
MSSMTVIETAPTLAPRPVASAEPFLRLEGIHKQFGPYPVLHDVCFEMNKGEVVAIIGPSGSGKSTLLRCINQLEPPTKGRVSMDGVHIEAGKALPRTELLKLRRRIGMVFQSFNLFPHLTVLRNVSLAQIRTLGRSAKEADARSLQLLERVGLADKAQHYPARCSGGQQQRIAIARALALDPELMLFDEPTSALDPELGLEVLAVMKELAGEGMSMIVVTHEMHFAETVSDRVVVMADGRIIEHGPSQRVMREPEHERVIQFLQAVRNR

SEQ ID NO: 17405 - protein, 463 aa, Pseudomonas putida KT2440
MNTVGSDGNLAQGFKPRHVTMLSIAGIIGAGLFVGSGHAIAAAGPATIISYFVAGTLVVLVMRMLGEMAVAHPDTGSFSTYADQAIGRWAGYTIGWLYWWFWVLVIPIEALAAGHVLNAWFPQVDSWIFALASVLLLAGTNLFSVAKYGEFEFWFAILKVTAILGFIGLGFAALMDWLPNREVSGLSGLMAEYGGFAPKGWSAVVGAFITVMFSFIGTEAVTIAASESSDPSRNIAKATRSVIWRISTFYILSIFVIISVVPWNDPQLAVVGSYQRALEIMNIPNAAFMVDLVVLVAVTSCMNSSIYIASRMMFSLAKRGDAPAFLNKTSKVGVPRAAVFGSTLIGAAIAVLNYFAPKGVFEFLLASSGAIALLVYMVIAISQLRMRRRLERENTELKFRMWLFPYLTWAVIIFIAGALAVMMYTPEHRAEVSSTLGLAIVISFLGIVTSRGHAQPVAARSMG

SEQ ID NO: 17406 - protein, 427 aa, Pseudomonas putida KT2440
MSRSEALFAQAQKHIPGGVNSPVRAFKSVGGTPLFFKHAEGAYVVDEDDKRYVDYVGSWGPMILGHGHPDVLDSVRRQLEHGLSYGAPTAMETEMADLVCSIVPSMEMVRMVSSGTEATMSAIRLARGYTGRDAIIKFEGCYHGHSDSLLVKAGSGLLTQGVPSSAGVPADFAKHTLTLPFNDIAAVEKTLAEVGQTVACIIVEPVAGNMNCVPPAPGFLEGLREQCDKHGVVLIFDEVMTGFRVSLGGAQGHYGIKPDLSTFGKIVGGGMPVGCFGGKREIMGCIAPLGPVYQAGTLSGNPLAMAAGLTTLKLISRPGFHAELTDYTSRMLDGLQQRADAAGVPFVTTQAGAMFGLYFSGADDIVTFEDVMASDAERFKRFFHLMLDGGVYLAPSAFEAGFTSIAHGDKELQITLDAAEKAFAALK

SEQ ID NO: 17407 - protein, 468 aa, Pseudomonas putida KT2440
MTQTSPIATDEPHLQRNLTNRHIQLIAIGGAIGTGLFMGSGKTISLAGPSIIFVYMIIGFMLFFVMRAMGELLLSNLNYKSFIDFSADLLGPWAGYFTGWTYWFCWVVTGIADVVAIAAYTQFWFPDLPQWIPALTCVGLLLSLNLVTVKMFGELEFWFALVKIVAILGLVATGLYMVITGFTSPSGRTAQLANLWNDGGMFPHGLMGFFAGFQIAVFAFVGIELVGTTAAEAKNPERTLPRAINSIPIRIIVFYVLALIAIMAVTPWRDVVPGKSPFVELFVLAGLPAAASIINFVVLTSAASSANSGVFSTSRMLYGLSQEGDAPKAFEKLSSRSVPANGLYFSCTCLLLGAVLIYLVPNVVEAFTLVTTVSAVLFMFVWTLILLSYLKYRKDRAALHQASNYKMPGGRFMCYVCLSFFAFILVLLSLEADTRSALVVTPIWFVVLAVTYQLVRSRRHPRTAVRNG

SEQ ID NO: 17408 - protein, 319 aa, Pseudomonas putida KT2440
MDFKDYYKILGVEPTADEKAIKAAYRKLARKYHPDVSKERDAEEKFKEANEAYEVLGDAQKRAEFDEIRKYGGQHGRPFQAPPGWESRGGGGGFEGGDFSDFFSSIFGGRSAGGNPFGGARQQQRSAGRRGQDVELELAVFLEETLSKESKQISFQVPQTNAMGQRTGFTTKTLNVRIPAGVTDGERIRLKGQGAPGSGGGANGDLFLTIRMAPHPLFDVEGHDLIITVPLAPWEAALGAKVAVPTLDGKINLTIRPDSQSGQRLRVPGKGLANKQGERGNLYAQLKVVMPPASDESARELWTKLSEKAAFNPRTQWSK

SEQ ID NO: 17409 - protein, 286 aa, Pseudomonas putida KT2440
MPQTKHPSNAPQLLSSVTVARLPARQAHAHKGDFGHVLVVGGDLGTGGAVLLSAEAALRCGAGLVSVATRPEHVSASLARLPEVMCLGVRSANQLMGVLERASVLVVGPGLGQAAWGCSLLSAVANAERPQVWDADALNLLARTPLALPSGSILTPHPGEAARLLGIATEAVQADRPGAARKLARRYNSVCVLKGAGTLVAAPSGQLALCERGHPAMAGAGLGDVLTGVLAALLAQGLDAWGAACLGVWLHACAGERLGKKGRGLAASDLAPVIRELLEEHSACLA

SEQ ID NO: 17410 - protein, 1317 aa, Pseudomonas putida KT2440
MATTTLGVKLDDPTRERLKAAAQSIDRTPHWLIKQAIFNYLEKLEGGATLTELNGHASNPADDAGEVQADHSHQCFLEFAESILPQSVLRSAITAAYRRPEQEVVPMLLEQARLSAPLADATNKLAASIAEKLRNQKSVGGRAGIVQGLLQEFSLSSQEGVALMCLAEALLRIPDKGTRDALIRDKISTGNWQPHLGNSPSLFVNAATWGLLLTGKLVSTHNETGLTSSLTRIIGKSGEPMIRKGVDMAMRLMGEQFVTGETIAEALANASRFEAKGFRYSYDMLGEAALTEHDAQKYLASYEQAIHSIGKASHGRGIYEGPGISIKLSALHPRYSRAQYERVMEELYPRLLSLTLLAKQYDIGLNIDAEEADRLELSLDLLERLCFEPSLAGWNGIGFVIQAYQKRCPYVIDYVIDLAKRSRHRLMIRLVKGAYWDSEIKRAQVEGLEGYPVYTRKVYTDVSYVACARKLLAVPEAIYPQFATHNAHTLSAIYHIAGQNYYPGQYEFQCLHGMGEPLYEQVVGKIADGKLNRPCRVYAPVGTHETLLAYLVRRLLENGANTSFVNRIADHSISIQELVADPVASIERMGTQEGSIGLPHPRIPLPRDLYGTERANSAGIDMANEHRLASLSCAMLATAHNDWKAAPLLACAASESAAAPVLNPADHRDVVGHVQEATVADVDNAIQCALNAAPIWQATPPAERAAILERTADLMEAEIQPLMGLLIREAGKTFANAIAEVREAVDFLRYYAVQARNDFSNDAHRPLGPVVCISPWNFPLAIFTGQVAAALAAGNPVLAKPAEQTPLIAAQAVRLLLEAGIPEGVLQLLPGRGETVGAGLVGDERVKGVMFTGSTEVARLLQRNVAGRLDNQGRPIPLIAETGGQNAMIVDSSALTEQVVIDVVSSAFDSAGQRCSALRVLCLQEDSADRVIEMLKGAMAESRLGCPDRLAVDIGPVIDAEAKAGIEKHIQGMREKGRPVYQVAIADAAEIKRGTFVMPTLIELDSFDELKREIFGPVLHVVRYNRRNLDQLIEQINNSGYGLTLGVHTRIDETIAKVVETANAGNMYVNRNIVGAVVGVQPFGGEGLSGTGPKAGGPLYLYRLLSTRPADAIGRHFQQQDGEGTPDRTLHEQLVKPLHGLKAWAENNQLADLAALCSQFASQSQSGIARLLPGPTGERNSYTILPREHVLCLADNETDLLAQFAAVLAVGSSAVWVDGEPGKALRARLPRELQAKVKLVADWNKDEVAFDAVIHHGDSDQLRGVCQQVAKRAGAIVGVHGLSSGDHQIALERLVIERAVSVNTAAAGGNASLMTIG

SEQ ID NO: 17411 - protein, 387 aa, Pseudomonas putida KT2440
MTVLKMTDLDLQGKRVLIREDLNVPVKDGVVASDARILAALPTIKLALEKGAAVMVCSHLGRPTEGEFSAENSLKPVADYLSKALGRDVPLVADYLDGVAVQAGELVLFENVRFNKGEKKNADELAQKYAALCDVFVMDAFGTAHRAEGSTHGVAKFAKVAAAGPLLAAELDALGKALKAPAKPMAAIVAGSKVSTKLDVLNSLSSVCDQLIVGGGIANTFLAAAGHPVGKSLYEPDLVDTAKAIAAKVSVPLPVDVVVAKEFAESAEATVKAIADVAADDMILDIGPQTAANFAELLKSSKTILWNGPVGVFEFDQFGNGTKVLAKAIADSAAFSIAGGGDTLAAIDKYGVSKEISYISTGGGAFLEFVEGKVLPAVAILEERAKA

SEQ ID NO: 17412 - protein, 130 aa, Pseudomonas putida KT2440
MKDWLDEIKWNSDGLVPAIAQDHKTGRVLMMAWMNRESLALTAAEQRAIYWSRSRGKLWRKGEESGHVQKLHELRLDCDADVIILMVEQLGHIACHTGRESCFYRVYEDGQWKIVDPVLKDPDAIYSAGH

SEQ ID NO: 17413 - protein, 467 aa, Pseudomonas putida KT2440
MQQAQGLKRGLSARHIRFMALGSAIGTGLFYGSASAIQMAGPAVLLAYLIGGAAVFMVMRALGEMAVHNPVAGSFGHYATTYLGPMAGFILGWTYAFEMVIVAIADVTAFGIYMGFWFPEVARWIWVLGIVFLIGGLNLCNVKVFGEMEFWLSLLKVGAIVAMILAGLGIMAFGFSQVGTGHAVGMSNLFDHGGFMPNGVGGLIASFAVVMFAFGGIEIIGVTAGEAKDPQRVIPKAINAVPLRILLFYVLTLFVLMCLYPWPQIGSQGSPFVQIFSNLGIGSAAAVLNVVVISAAISAINSDIFGAGRMMYGLAQQGHAPRGFSKLSKHGVPWMTVVVMGAALLIGVLLNYLIPENVFLLIASIATFATVWVWLMILLTQVAMRRSMSREQVAQLKFPVPFWPYGPAMAIAFMVFIFGVLGYFPDTQAALIVGVIWVVFLVASYLLWCKPRAGQGQPVAEPAELHR

SEQ ID NO: 17414 - protein, 511 aa, Pseudomonas putida KT2440
MTSTPKPLVLIILDGFGHSDIPEHNAIFAANKPVYDRLCATQPHGLISGSGMDVGLPDGQMGNSEVGHMNLGAGRVVYQDFTRVTKAIRDGEFFENPVLTGAVDKAVGAGKAVHILGLLSDGGVHSHQDHLVAMAELAAQRGAEKIYLHAFLDGRDTPPRSAQSSIELLDATFAKLGKGRIASLIGRYYAMDRDNRWDRVSAAYNLIVDSAAEYTADTALAGLEAAYARDESDEFVKATRIGEAVKVEDGDAVIFMNFRADRARELSRAFVEPDFTEFARARLPKMAAYIGLTQYSAKIPAPAAFAPSSLNNVLGEYLAKNGKTQLRIAETEKYAHVTFFFSGGREEPFEGEERILIPSPKVATYDLQPEMSAPEVTDRIVEAIEQQRFDVIVVNYANGDMVGHTGVFEAAVKAVEALDTCVGRIVDALDKVGGEALITADHGNVEQMEDECTGQAHTAHTTEPVPFIYVGKRNVKVREGGVLADVAPTMLKLLGLEKPVEMTGTSILVDA

SEQ ID NO: 17415 - protein, 490 aa, Pseudomonas putida KT2440
MARFGTQKLYIDGAYVDAGSDATFEAINPATGEVLAHVQRATEADVEKAVESAERGQKVWAAMTAMQRSRILRRAVDILRERNDELAMLETLDTGKSYSETRYVDIVTGADVLEYYAGLVPAIEGEQIPLRESSFVYTRREPLGVTVGIGAWNYPIQIALWKSAPALAAGNAMIFKPSEVTSLTTLKLAEIYTEAGLPNGVFNVLTGSGREVGTWLTEHPRIEKVSFTGGTTTGKKVMASASSSSLKEVTMELGGKSPLIICADADLDKAADIAMMANFYSSGQVCTNGTRVFIPAEMKAAFEAKIAERVARIRVGNPEDENTNFGPLVSFQHMESVLGYIAKGKEEGARVLCGGERLTAGDFAKGAFVAPTVFTDCTDDMTIVKEEIFGPVMSILTYETEEEVIRRANDTDYGLAAGVCTNDITRAHRIIHKLEAGICWINAWGESPAEMPVGGYKQSGVGRENGVSSLAQYTRIKSVQVELGGYNSVF

SEQ ID NO: 17416 - protein, 472 aa, Pseudomonas putida KT2440
MAERLNNDFQFIEVGRKDPKKKLLRQRKKEFVEIYEPFKPQQSVEQAHRCLGCGNPYCEWKCPVHNFIPNWLKLVSEGNILAAAELSHQTNTLPEVCGRVCPQDRLCEGACTLNDGFGAVTIGSVEKYITDTAFAMGWRPDMSKVKPTGKRVAIIGAGPAGLGCADVLVRAGVTPVVFDKNPEIGGLLTFGIPEFKLEKTVLSNRREVFTGMGIEFRLNTEVGKDVTMEQLLAEYDAVFMGMGTYTYMKGGFPGEDLPGVHDALDFLIANVNRNLGFEKSPEDFVDMQGKKVVVLGGGDTAMDCNRTSIRQGAKAVTCAYRRDEANMPGSRKEVKNAKEEGVKFLYNRQPIAIVGEDKVEGVKVVETRLGEPDARGRRSPEPIPGSEEILPADAVVIAFGFRPSPAPWFEQHGIQLDSQGRVVAPEKGKFKHQTSNPKVFAGGDMVRGSDLVVTAIFEGRTAAEGILDYLEV

SEQ ID NO: 17417 - protein, 476 aa, Pseudomonas putida KT2440
MNSPSALPPVQFDLDLATTFAAQRLAFAGNPLPPAAQRRQWLKSLREALLSSQAELIEAISQDFAGRSADETLLAELLPSVQGLRHAEKHLQRWMRSRRRRVGLAFQPASAQVRYQPLGVVGVIVPWNYPLFLAIGPLTCALAAGNRVMLKLSEATPATGLALQQLLERVFPTDLVSVVLGEVEVGQAFARLPFDHLLFTGATSVGRQVMQAAAHNLTPVTLELGGKSPAIVSDDVPLDSAAERIAFGKTLNAGQTCVAPDYVLVPRERLPAFSDAYQRAVHRLYPRIADNPDYTAIINPRQLQRLQHLLDDARAKGAQVLDLYPGEAPQGRRLPPHLLLDVNDSMQVMQDEIFGPLLPLVPYDGIDQALAYINQRPHPLALYFFGYDRRTQEHVLRHTHSGGVCLNDTLLHVAQDDLPFGGIGPSGMGHYHGHDGFLTFSKAKAVLAKQRFNAARLIYPPYGKALQRLVYKLFIR

SEQ ID NO: 17418 - protein, 159 aa, Pseudomonas putida KT2440
MIDPDGFRPNVGIILTNDAGQVLWARRINQDAWQFPQGGINPDETPEDALYRELNEEVGLERDDVEILACTRGWLRYRLPQRLVRTHSQPLCIGQKQKWFLLRLVSNEQRVRMDLTGKPEFDGWRWVSYWYPLGQVVTFKREVYRRALKELAPRLLTRD

SEQ ID NO: 17419 - protein, 329 aa, Pseudomonas putida KT2440
MSIEVRNVSKRFNSFQALNAINLDINSGELVALLGPSGCGKTTLLRIIAGLETPDQGNIVFHGEDVSGHDVRDRNVGFVFQHYALFRHMSVFDNVAFGLRMKPKGERPSESKIAEKVHELLNMVQLDWLSDRYPEQLSGGQRQRIALARALAVEPKVLLLDEPFGALDAKVRKELRRWLARLHEDINLTSVFVTHDQEEAMEVADRIVVMNKGVIEQIGSPGEVYDQPANDFVYHFLGDSNRLALSEGHHVLFRPHEVSLSRHETEGHHAAEVRDIRPLGATTRVTLKVEGQSELIEAEVVKDHDSLTGLARGETLFFRPKVWQKVADI

SEQ ID NO: 17420 - protein, 458 aa, Pseudomonas putida KT2440
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGEPFFADPREVLRQVVTKFDELGLTICAAFELEFYLIDQENVNGRPQPPRSPISGKRPQSTQVYLIDDLDEYADCLQDILEGAKEQGIPADAIVKESAPAQFEVNLHHVADPLKACDYAVLLKRLIKNIAYDHEMDTTFMAKPYPGQAGNGLHVHISVLDKDGNNIFTSEDPEQNAALRHAVGGVLETLPASMAFLCPNVNSYRRFGAQFYVPNAPSWGLDNRTVALRVPTGSADAVRIEHRVAGADANPYLMMAAVLAGVHHGLTNKIEPGAPIEGNSYEQLEQSLPNNLRDALRELDDSEILNKYIDPKYIDIFVACKESELEEFEHSISDLEYNWYLHTV

SEQ ID NO: 17421 - protein, 462 aa, Pseudomonas putida KT2440
MHVAPTTELKALLRLAGPLIASQLAHMLMVLTDTLMMARISPQALAGGGLGAASYSFVSIFCLGVIAAVGTLVAIRKGANDIEGATRLAQNGLWLAWALALFAALVLWNLEPVLLLFGQKPENVASAAEFLTLLPLALPGYLTFMALRGFTSALGRSTPVMVISLFGTVLNYLFNVALIEGMFGLPKLGLMGIGLVTAVVSMGMATALALYIRWHPAYTAYPLRKGLSRPSLAALRELWRLGLPIGGTYMVEVGLFAFAALCMGVLGSTELAAHQIALQIVSTAFMVPTGLSYAVTMRVGLYYGAGNLLAARSAGRVGIGFGAMIMFAFATLFLLLPEALVGLFIDRNDPAFAAIFQVAVQLLMVAAWFELFDGMQTIAMGSIRGLKDAKTTFLIGLVCYWLVGAPSAWLFTFTLGGGAVGIWWGLALGLACAAVALTFGFEWRMKRLLGKAGVRTEAAVSA

SEQ ID NO: 17422 - protein, 497 aa, Pseudomonas putida KT2440
MTTLTRADWEQRAQQLKIEGRAFINGEYTDAVSGETFECLSPVDGRFLAKVASCDLADANRAVENARATFNSGVWSQLAPAKRKAKLIRFADLLRKNVEELALLETLDMGKPIGDSSSIDIPGAAQAIHWTAEAIDKVYDEVAPTPHDQLGLVTREPVGVVGAIVPWNFPLLMACWKLGPALATGNSVVLKPSEKSPLTAIRIAQLAIEAGIPAGVLNVLPGYGHTVGKALALHMDVDTLVFTGSTKIAKQLMVYAGESNMKRIWLEAGGKSPNIVFADAPDLQAAAEAAASAIAFNQGEVCTAGSRLLVERSIKDKFLPMVVEALKGWKPGNPLDPQTTVGALVDTQQMNTVLSYIEAGHKDGAKLLAGGKRTLEETGGTYVEPTIFDGVTNAMRIAQEEIFGPVLSVIAFDTAEEAVAIANDTPYGLAAGIWTSDISKAHKTARAVRAGSVWVNQYDGGDMTAPFGGFKQSGNGRDKSLHALEKYTELKATWIKL

SEQ ID NO: 17423 - protein, 460 aa, Pseudomonas putida KT2440
MTSVTPCASSSSEMNDFLQAHPDTQYVDLLISDMNGVVRGKRIERASLHKVYEKGINLPASLFALDINGSTVESTGLGLDIGDADRICFPIPGTLSDEPWQKRPTAQLLMTMHELDGQPFFADPREVLRQVVSKFDDLGLTICAAFELEFYLIDQDNLNGRPQPPRSPISGKRPQSTQVYLIDDLDEYADCLQDMLEAAKEQGLPADAIVKESAPAQFEVNLHHVADPLKACDYAILLKRLIKNVAYDHEMDTTFMAKPYPGQAGNGLHVHISLLDKKTGKNIFASDDPLQSDTLRHAIGGVLETMPASMAFLCPNINSYRRFGAQFYVPNAPSWGLDNRTVAVRVPTDSSENVRLEHRVAGADANPYLMLAAILAGVHHGLTNKVEPEAPIEGNSYEQLEQSLPNNLRDALRALDDSEVLNQYISPDYIDIFVACKESELAEFEVSISDLEYNWYLHTV

SEQ ID NO: 17424 - protein, 382 aa, Pseudomonas putida KT2440
MTSPVVIIGTGLAGYNLAREFRKLDAQTPLLLITADDGRSYSKPMLSMGFAKQKDADGLCMAEAGAMAEQLNAEIRTHTRISGIDPGHKRLWIGEEAVEYRDLVLAWGAQTVQVPIEGDGGHLVFPINDLEDYARFRAAAAGKQRVLILGAGLIGCEFANDMSLGGFKVDVVAPCEQIMPTLLHPAAAAAVQGGLEGLGVRFHLGPVLTRLQQVTQGLEAHLSDGSVIACDLVVSAIGLRPRTDLAAAAGLQTNRGVSVDRELRTSHANIFALGDCAEVDGINLLYVMPLMSCARALAQTLAGKPTAVSYGPMPITVKTPACPVVVSPAPQGCEGIWQVEGQGSDLKVLCLDADGKLLGYALTGAAVMEKLALNRQLPPVMA

SEQ ID NO: 17425 - protein, 347 aa, Pseudomonas putida KT2440
MLTIYSDDHRLHHGRCELIDGKLMPCFEMPSRADHVLDQVKKRKLGDIQGPTDFGRAPLLRVHSADYLDFFEGAWARWAALGQEGDLLPFTWPARTLRQVKPTGLHGELGYYSFDAGAPITAGTWQAAYSAAQVALTAQAAIQQGAHAAFALCRPPGHHAAGEVMGGYCYLNNAAIAAQAFLDQGRRKVAILDVDYHHGNGTQDIFYSRDDVFFASIHGDPQDEFPFFLGYADETGEGAGQGYNINYPLPAGSDWAAWSAALEDACKRIASYDADVLVISLGVDTFKDDPISQFKLDSPDYLEMGKRIGQLGKPTLFVMEGGYAVEEIGINAVNVLEGFQRAQSGAR

SEQ ID NO: 17426 - protein, 466 aa, Pseudomonas putida KT2440
MKSYDVVIIGGGPGGYNAAIRAGQLGLSVACVEGRSTLGGTCLNVGCMPSKALLHASELYEAASGDEFAHLGIEVKPTLNLAQMMKQKDESVTGLTKGIEYLFRKNKVEWIKGWGRLDGIGKVVVKAEDGSETALQAKDIVIATGSEPTPLPGVTVDNQRIIDSTGALSLPQVPKHLVVIGAGVIGLELGSVWRRLGSQVTVIEYLDRICPGTDTETAKTLQKALAKQGMVFKLGSKVTQATAGADGVSLTLEPAAGGTAESLQADYVLVAIGRRPYTKGLNLESVGLEADKRGMLNNEHHRTSVPGVWVIGDVTSGPMLAHKAEDEAVACIERIAGKPHEVNYNLIPGVIYTRPEMATVGKTEEQLKAEGRAYKVGKFPFTANSRAKINHETEGFAKVIADAETDEVLGVHLVGPSVSEMIGEFCVAMEFSASAEDIALTCHPHPTRSEALRQAAMNVDGMAMQI

SEQ ID NO: 17427 - protein, 461 aa, Pseudomonas putida KT2440
MKTWLCIICGLIYDEAKGWPDDGIAPGTRWEDVPEDWLCPECKVGKADFEMIELSTPIAAVATAPVIQAQPLVAARPAQPVVIIGSGHAGYGLAQALRKAAPQLEIRVLTQESGHLYSKPALSIALAQGRTAAALATETPLAIEQRLGIRIYTGCKVERIDAQAQRLYTSLGEMDYGQLVLASGASPVRLPIEGRAEALLSVNNLQDYQAFRQRLDGVRRVAILGDGLIGCEFANDLASNGYQVRVIGLGAWPMERLLPEAAGQHLQQALSGLGVQWSLRTTLQCIEPDGEGYRLTLADGQVVGADLVLSAVGLRPNLELALEAGLDCGRGIKVDAQLQTSQPGIYALGDCVEINGQLLPYLAPINEGIRALAKTLLGQPTAAHYPLAPVTVKTPVVPLCLLTPPGGCEGQWRCDATSDGLSAAFHDHAGALRGFVLLGRQAQMQRNTWLQNCQDTQQNVA

SEQ ID NO: 17428 - protein, 481 aa, Pseudomonas putida KT2440
MHPIAPHWLNFIDGQWTDSEQHLSIHNPGTTDLVATIAQASVADAECALQAARRCADSNALNRVRPAQRVTWLLEVAAQIRAITDEGAWVLCQENGKSLRDARDEFIEAARYFEYYAGMADKIEGKSIPLGDGYIDFTVYDPLGVSLQIVPWNFPVSICARSLAPALAAGNAVVIKSPELSPLGLCVLMQAIERAGLPQGAVNLICGRGREVGAYLAGHRDVDQIVFTGSVGTGQSILRSAAEHAIPSVMELGGKSAALVFPDADREQLISSVKSGIFFNAGQVCSAMSRLLVHRSIYDEVVADVVAMAEGLTVGLGQDNPDHTPVISAAQLEGIEALCRRAQQQGAVVATGGEAISGLSGHYMAPTVLRDVTAQMEIAQTEVFGPVLAVIPFDSEEEALAIANGTVFGLVAGVFTQDLNRALRCARRLCTGQVFVNEWYAGGIETPFGGVGLSGFGREKGQEALYSYVRTKNLAVRIKGE

SEQ ID NO: 17429 - protein, 304 aa, Nostoc sp. PCC 7119
MTQAKAKHADVPVNLYRPNAPFIGKVISNEPLVKEGGIGIVQHIKFDLTGGNLKYIEGQSIGIIPPGVDKNGEPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 17430 - protein, 303 aa, Nostoc sp. PCC 7119
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKKMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 17431 - protein, 275 aa, Bacillus subtilis
SELWYTEKQTKNFGITMKVNKTLHTEQTEFQHLEMVETEEFGNMLFLDGMVMTSEKDEFVYHEMVAHVPLFTHPNPEHVLVVGGGDGGVIREILKHPSVKKATLVDIDGKVIEYSKKFLPSIAGKLDDPRVDVQVDDGFMHIAKSENQYDVIMVDSTEPVGPAVNLFTKGFYAGIAKALKEDGIFVAQTDNPWFTPELITNVQRDVKEIFPITKLYTANIPTYPSGLWTFTIGSKKYDPLAVEDSRFFDIETKYYTKDIHKAAFVLPKFVSDLIK

SEQ ID NO: 17432 - protein, 433 aa, Burkholderia cepacia
MSLNDDATFWRNARHHLVRYGGTFEPMIIERAKGSFVYDADGRAILDFTSGQMSAVLGHCHPEIVSVIGEYAGKLDHLFSEMLSRPVVDLATRLANITPPGLDRALLLSTGAESNEAAIRMAKLVTGKYEIVGFAQSWHGMTGAAASATYSAGRKGVGPAAVGSFAIPAPFTYRPRFERNGAYDYLAELDYAFDLIDRQSSGNLAAFIAEPILSSGGIIELPDGYMAALKRKCEARGMLLILDEAQTGVGRTGTMFACQRDGVTPDILTLSKTLGAGLPLAAIVTSAAIEERAHELGYLFYTTHVSDPLPAAVGLRVLDVVQRDGLVARANVMGDRLRRGLLDLMERFDCIGDVRGRGLLLGVEIVKDRRTKEPADGLGAKITRECMNLGLSMNIVQLPGMGGVFRIAPPLTVSEDEIDLGLSLLGQAIERAL

SEQ ID NO: 17433 - protein, 401 aa, Synechocystis sp. PCC 6803
MLSKQSIANLTEADLAGKRVFVRVDFNVPLDNGSITDDTRIRAALPTIKDLLSKGAKVILGSHFGRPKGKVVDSMRLTPVGDRLGELLGQPVVKCDDCIGAEVTAKIASLPNGGVALLENLRFHAGEEGNDAEFAKALAANADLYVNDAFGTAHRAHASTEGVTHFLSPNVAGYLIEKELQFLQGAIEAPKRPLVAIVGGSKVSSKIGVIETLLDKCDKLIIGGGMIFTFYKAQGLNTGKSLVEEDKLDLAKSLMAKAKEKGVEFLLPTDVVVADNFAPDANAQTVGVDAIPDGWMGLDIGPDSVKTFQDALAGCGTVIWNGPMGVFEFDKFAVGTEAIACSLAELTASGTVTIIGGGDSVAAVEKVGVAEKMSHISTGGGASLELLEGKVLPGIAALDDR

SEQ ID NO: 17434 - protein, 446 aa, Cochliobolus carbonum
MRVTDIISCALLQASIALSTPVEELGAKAVVAKRFPPVPFLPGKASSVPGSRNKTCMLKALGGGKDDSANILSAVKQCNNGGHVVFPKGQQFTIGTALDLTFLNGIDLDIQGTIQFTNDTDYWQANSFKQVFQNATTFFQLGGKDINVYGGGTLDGNGQAWYDLYAKDIYILRPILFGLIGAKNAKISDLKFRYSPQWYTLVANSSQVVFSNIDIFGDSKSKNPAKNTDGWDTYRSDNIIIQNSNINNGDDCVSFKPNSTNILVQNLVCNGSHGISVGSLGQYPGEVDIVENILVRNISMSNASDGARIKVWPGASSALSGDLQGGGGSGAVRNVTYDGMIVKNVDYAIEITQCYGQKNLTLCNQFPSNLTISDITIKNFKGTTSKKYDPRVGYVVCSSPKVCSDISIENIDVKSPSGTNLFTCANAEGIQSQVNCTVEGDKGGHS

SEQ ID NO: 17435 - protein, 201 aa, Phytophthora infestans
MNPEYDYLFKLLLIGDSGVGKSCLLLRFADDTYTESYISTIGVDFKIRTIELDGKTIKLQIWDTAGQERFRTITSSYYRGAHGIIVVYDVTDQESFNNVKQWLHEIDRYACENVNKLLVGNKSDLTAKRVVSTDAAKEFAESLGIEFLETSAKNAANVEKAFMMMAAQIKKRMANAPVAPKAGVKLTPGQQVPSNGGSKCC

SEQ ID NO: 17436 - protein, 322 aa, Cicer arietinum
FNSWTGADCCHKWYGVSCDKETRRVADINLRGESEDPIFERAHRTGYMTGYISPAICKLTRLSSITVADWKNISGEIPRCITSLPFLRIIDLIGNRISSTIPSDIGRLHRLTVLNVADNAISGNIPPSLTNLRSLMHLDIRNNQISGPIPKDFGRLPMLSRALLSGNKISGPIPDSISRIYRLADLDLSRNQVSGPIPESLGKMAVLSTLNLDMNKLSGPIPASLFNSGISDLNLSRNGLNGNLPDVFGARSYFTVLDLSYNSLKGPIPKSMGLASYIGHLDLSYNHLCGKIPVGSPFDHLEASSFVYNDCLCGKPLKVCAN

SEQ ID NO: 17437 - protein, 403 aa, Lactobacillus delbrueckii subsp. lactis
MAKLIVSDVDVKDKKVLVRVDFNVPIKDGVIGDDNRIVAALPTIKYIIENGGKAILLSHLGRIKSDEDKKSLSLAPVAKRLGELLEKPVTFVPSNEGKEVEDAINNMKDGDVVVLENTRFQDIDNDFGKRESKNDPKLGEYWASLGDVFVNDAFGTAHRSHASNVGIATAMKAAGKPVAAGFLLEKEIKFLGNAVANPVHPFVTILGGAKVSDKIGVITNLIPKADHIIIGGGMAYTFLKAQGHNIGKSLVEDDKVEFAKELLEKAGDKLVLPIDHVAATEFNNDAASEVVGQDIPDNEMGLDIGPKTIELFKKTLEGAKTVVWNGPMGVFEMPNFAKGTLEVGRALADLPDATTIVGGGDSTAAAKQLGIAPKLTHISTGGGASLEYLEGKELPGIACVSDK

SEQ ID NO: 17438 - protein, 347 aa, Escherichia coli O157:H7
MRIEEDLKLGFKDVLIRPKRSTLKSRSDVELERQFTFKHSGQSWSGVPIIAANMDTVGTFSMASALASFDILTAVHKHYSVEEWQAFINNSSADVLKHVMVSTGTSDADFEKTKQILDLNPALNFVCIDVANGYSEHFVQFVAKAREAWPTKTICAGNVVTGEMCEELILSGADIVKVGIGPGSVCTTRVKTGVGYPQLSAVIECADAAHGLGGMIISDGGCTTPGDVAKAFGGGADFVMLGGMLAGHEESGGRIVEENGEKFMLFYGMSSESAMKRHVGGVAEYRAAEGKTVKLPLRGPVENTARDILGGLRSACTYVGASRLKELTKRTTFIRVQEQENRIFNNL

SEQ ID NO: 17439 - protein, 445 aa, Escherichia coli
MNTSPVRMDDLPLNRFHCRIAALTFGAHLTDGYVLGVIGYAIIQLTPAMQLTPFMAGMIGGSALLGLFLGSLVLGWISDHIGRQKIFTFSFLLITLASFLQFFATTPEHLIGLRILIGIGLGGDYSVGHTLLAEFSPRRHRGILLGAFSVVWTVGYVLASIAGHHFISENPEAWRWLLASAALPALLITLLRWGTPESPRWLLRQGRFAEAHAIVHRYFGPHVLLGDEVVTATHKHIKTLFSSRYWRRTAFNSVFFVCLVIPWFVIYTWLPTIAQTIGLEDALTASLMLNALLIVGALLGLVLTHLLAHRKFLLGSFLLLAATLVVMACLPSGSSLTLLLFVLFSTTISAVSNLVGILPAESFPTDIRSLGVGFATAMSRLGAAVSTGLLPWVLAQWGMQVTLLLLATVLLVGFVVTWLWAPETKALPLVAAGNVGGANEHSVSV

SEQ ID NO: 17440 - protein, 180 aa, Streptococcus agalactiae NEM316
MLENDIKKVLYSEEDIILKTKELGAKLTADYAGKNPLLVGVLKGSVPFMAELLKHIDTHVEIDFMVVSSYHGGTTSSGEVKILKDVDTNIEGRDVIFIEDIIDTGRTLKYLRDMFKYRQANSVKVATLFDKPEGRLVDIDADYVCYDIPNEFIVGFGLDYAENYRNLPYVGVLKEEIYSK

SEQ ID NO: 17441 - protein, 338 aa, Streptococcus agalactiae NEM316
MKAVVVNQASTGVEVVEHDLPKVGHGEALVKVEYCGVCHTDLHVAHGDFGQVPGRILGHEGIGIVEEIGEGVTSLRVGDRVSIAWFFEGCGHCEYCTTGRETLCRSVKNAGYSVDGGMSEYAVVTADYAVKVPEGLDPAQASSITCAGVTTYKAIKEAGAAPGQWIAVYGAGGLGNLAVQYAKKVFNAHVVAVDINADKLQLAKEVGADLTVNGKEIKDVAAYIQEKTGGCHGVVVTAVSKVAFNQAIDSVRAGGTVVAVGLPSEYMELSIVKTVLDGIRVVGSLVGTRKDLEEAFAFGAEGLVVPVVEKVPVDTAPQVFDEMERGLIQGRKVLDFTK

SEQ ID NO: 17442 - protein, 426 aa, Streptococcus agalactiae NEM316
MRYSKEIIQLAIPAMIENILQMLMGVVDNYLVAQLGVVAVSGVSVANNIITVYQAIFIALGASIASLLAKSLAGSEKDDAISVCSQAIFLTLLIGAVLGIISIVFGQTFFKLLGTTKSVAQVGGLYLAIVGGGVVTLGMLTTLGSFLRVQGQPRLPMYVSIFVNFLNAVLSGFAIFEWRYGLVGVAVSTLIARLIGICILAKYLPIKKIIKRMTWKISAQIWNLALPSAGERLMMRAGDVVIVAIVVQLGTNVVAGNAIGETLTQFNYMPGLGIATATIILTAKYVGQKNRESIEETIQSSYYIGLVLMILISSFMLLAGKPLTQLFTNNPSAIKGSLIVILLSFVGVPATIGTLVYTAAWQGLGNAKLPFYTTTIGMWLIRVVLGYLLGIVFELGLLGVWMATIADNIFRWLFLKVHYHRYIQKM

SEQ ID NO: 17443 - protein, 212 aa, Streptococcus agalactiae NEM316
MNLLIMGLPGAGKGTQAAKIVEEFGVAHISTGDMFRAAMANQTEMGRLAKSYIDKGELVPDEVTNGIVKERLAEDDIAEKGFLLDGYPRTIEQAHALDATLEELGLRLDGVINIKVDPSCLIERLSGRIINRKTGETFHKVFNPPVDYKEEDYYQREDDKPETVKRRLDVNIAQGEPILEHYRKLGLVTDIEGNQEITEVFADVEKALLELK

SEQ ID NO: 17444 - protein, 379 aa, Streptococcus agalactiae NEM316
MNNTEFYDRLGVSKDASQDEIKKAYRRMSKKYHPDINKETGAEEKYKEVQEAYETLSDTQKRAAYDQYGAAGANGGFGGFDGGGFGGFDGGGFGGFEDIFSSFFGGGGMRNPNAPRQGDDLQYRVNLSFEEAIFGAEKEVSYNRESSCHTCSGSGAKPGTSPVTCQKCHGSGVINVDTQTPLGTMRRQVTCDVCQGSGQEIKEKCPTCHGTGHEKKTHKVSVKIPAGVETGQQIRLTGQGEAGFNGGPYGDLFVIINVLPSQQFERNGSTIYYTLKISFVQAALGDTIDIPTVHGAVEMSIPAGTQTGKTFRLRGKGAPKLRGGGQGDQHVTVNIVTPTKLNDAQKEALHAFAEASGDKMVHPKKKGFFDKVKDALDVD

SEQ ID NO: 17445 - protein, 454 aa, Streptococcus agalactiae NEM316
MAKKKSVFTCQECGYQSPKYLGRCPNCSAWSSFVEEVEVQEVKNARVSLNGEKSRPTKLKDVSSINYSRTKTDMDEFNRVLGGGVVPGSLVLIGGDPGIGKSTLLLQVSTQLANKGTVLYVSGEESAEQIKLRSERLGDIDNEFYLYAETNMQSIRSEIEKIKPDFLIIDSIQTIMSPEVSSVQGSVSQVREVTAELMQLAKTNNIATFIVGHVTKEGTLAGPRMLEHMVDTVLYFEGERHHTFRILRAVKNRFGSTNEIGIFEMQSGGLVEVLNPSQVFLEERLDGATGSAIVVTMEGTRPILAEVQALVTPTVFGNAKRTTTGLDFNRVSLIMAVLEKRCGLLLQNQDAYLKSAGGVKLDEPAIDLAVAVAIASSYKEKPTNPQESFIGEIGLTGEIRRVTRIEQRINEASKLGFTKIYAPKNSLAGIEIPKGIDVIGVTTVSQVLKAVFST

SEQ ID NO: 17446 - protein, 439 aa, Streptococcus agalactiae NEM316
MKKYDVIVLGFGKAGKTLAAKLATQGKSVAMVEEDDKMYGGTCINIGCIPTKTLLVSASKNHDFQEAMTTRNEVTSRLRAKNFAMLDNKDTVDVYNAKARFISNKVVELTGGADKQELTADVIIINTGAKSVQLPIPGLADSQHVYDSTAIQELAHLPKRLGIIGGGNIGLEFATLYSELGSKVTVIDSQSRIFAREEEELSEMAQDYLEEMGISFKLSADIKSVQNEDEDVVISFEDEKLSFDAVLYATGRKPNTEGLALENTDIKLTERGAIAVDEYCQTSVENIFAVGDVNGGPQFTYISLDDSRIVLNYLNGDKDYSLKNRGAVPTSTFTNPPLATVGLDEKTAKEKGYQVKSNSLLVSAMPRAHVNNDLRGIFKVVVDTETNLILGARLFGAESHELINIITMAMDNKIPYTYFQKQIFTHPTMVENFNDLFNF

SEQ ID NO: 17447 - protein, 223 aa, Streptococcus agalactiae NEM316
MIKILVVEDNIVQQKIITTKLTQEGYQFITASNGQEALNCLDTEEVQLIITDIMMPMMDGYQLIQELRSAAYNVPIIVMTAKSQMEDMTKGFGLGADDYMVKPVQLQELALRIKALLRRANIVAQHQLIIGNTCLNEDELSLKYFEQEIVFPQKEFRVLFHLLSYPNRIFTRLELLDSIWGMDTDLDERVVDACINKIRRKVEHLPDFKIETVRGVGYRAKND

SEQ ID NO: 17448 - protein, 246 aa, Streptococcus agalactiae NEM316
MTQAILEIKHLKKSYGSNEVLKDISLSVNKGEVISIIGSSGSGKSTFLRSINLLEEPSGGEILYHGHNVLEKGYDLNNYREKLGMVFQSFNLFENLNILENAIVAQTTVLKRERQEAEKIAKENLNAVGMTEQYWKAKPKQLSGGQKQRVAIARALSVNPEAILFDEPTSALDPEMVGEVLKTMQDLAKSGLTMIIVTHEMEFAKEVSDRVIFMDKGIIAEQGTPKQLFENPTQERTKEFLQRFLK

SEQ ID NO: 17449 - protein, 128 aa, Streptococcus agalactiae NEM316
MIDVRLINGIALAFEGDAVYSLYIRRHLIMQGFTKPNQLHRKATQYVSANAQALLINAMLEENILTDEEQLIYKRGRNANSHTKAKNADIITYRMSTGFEALMGYLDMTGQIKRLETLIQWCIETIEK

SEQ ID NO: 17450 - protein, 445 aa, Streptococcus agalactiae NEM316
MTEKYVNKVIVILGASFAGMTCAQKLRQLNPNWDIVLIDKEIHPDYVPNGLNWYYRHEISGLNQAMWQTEEEQRLQNIRCLFGLKVEKINKEDRELMLSDGSSVYYDQLICAMGSQAESTYIDGADAQGVLTTKTYATSQNAKQVLDKSHKVAVVGAGIIGLDIAYSLHESGKAVTLLEAQERPDFRHTDPDMSLPLLDAMAESKLHFFQNQKVEKITVTREEKLCLRTLTGDTFTVDAVILAVNFRPDSRLLTGLVDLSVDNSVVVNDYFQTSDPNIYAIGDLIWSYFKGLNSAYYMPLINQAIRSAQMLAYHLSGHAVPKLKITRATGSKHFGYYRANIGLTELEAGLYEDTVSVTYFPKEQYDLRIKLIANQKTGHLLGAQLISKENCLATANQLVQAISCDMTDFDLAFQDFIYTARESEMAYMLHQAAINLYEKRIGLCE

SEQ ID NO: 17451 - protein, 247 aa, Streptococcus agalactiae NEM316
MIKLRQLTKSFSGQKVLDKLDLDIEKGQVVALVGASGAGKSTFLRSMNYLEEPDYGTIEIDDFKVDFKSISKDDILTLRRKLAMVFQQFNLFERRTALDNVKEGLKIVKKMSDQEATRIARDELAKVGLADREKYYPRHLSGGQKQRVALARALAMKPDVLLLDEPTSALDPELVGEVEKSIADAAKQGQTMVLVSHDMNFVYQVADKVLFLEKGRILESGTPEQLFNHPLEERTKEFFASYNKSYL

SEQ ID NO: 17452 - protein, 486 aa, Streptococcus agalactiae NEM316
MYKDDSLTLHTDLYQINMMQVYFNKGIHNKRAVFEAYFRKVPFENGYAVFAGLERIVRYLENLSFSDSDLSYLEELGYPEEFLDYLKNLKMELTVKSAKEGDLVFANEPLVQIEGPLAQCQLVETAILNIINYQTLVATKAARIRSVIEDEPLLEFGTRRAQEMDAAIWGTRAAIIGGANATSNVRAGKIFNIPVSGTHAHALVQTYGDDYQAFKAYAETHKDCVFLVDTYDTLRVGVPNAIRVAKEMGEKINFLGVRLDSGDLAYLSKKVRQQLDDAGFPNAKIYASNDLDENTILNLKMQKAKIDVWGVGTKLITAYDQPALGAVYKIVSIETDAGSMRDTIKLSNNAEKVSTPGKKQVWRITSRAKGKSEGDYITFADTDVTQLDEIEMFHPTYTYINKTVRDFDAVPLLVDIFDKGKLVYQLPSLQEIQEYGRKEFDQLWDEYKRVLNPQDYPVDLARDVWQNKMDLIDRIRKEALAKGEVR

SEQ ID NO: 17453 - protein, 308 aa, Streptococcus agalactiae NEM316
MSKIYNSITDLIGNTPIIQLHHIVPEGAAEVYVKLESFNPGSSVKDRIALAMIEDAEQKGILKAGDTIVEPTSGNTGIGLAWVGKAKGYNVIIVMPETMSIERRKIIQAYGAQLVLTPGSEGMKGAIAKAKEISAEQNAWLPLQFNNQANPEIHEKTTGREIIETFGEKGLDAFIAGVGTGGTITGVSRALKKVNPDVAIYAVEADESAILSGEQPGPHKIQGISAGFIPETLATDSYDHIIRVTSDDAIETGRIIGGLEGFLAGISASAAIYAAIEVAKQLGKGKKVLALLPDNGERYLSTSLYDFE

SEQ ID NO: 17454 - protein, 291 aa, Streptococcus agalactiae NEM316
MALFSKKDKYIRISPNKALGSSDKRSLPEVPDELFAKCPSCKHMIYQKDLGLAKICPACSYNFRISAQERLLLTVDEDSFEELFTGIETKDPLNFPNYREKLAATRQKTNLDEAVVTGLAKIKGQTTALAIMDSHFIMASMGTVVGEKLTRLFELATEKKLPIVIFTASGGARMQEGIMSLMQMAKVSAAVKRHSNQGLFYLTILTDPTTGGVTASFAMEGDIILAEPQALVGFAGRRVIETTVREDLPEGFQKAEFLLEHGFVDAIINRTELRDCIAQLIAFHGNEVGHE

SEQ ID NO: 17455 - protein, 473 aa, Streptococcus agalactiae NEM316
MEKFFKLKEHGTTIRTEITAGLTTFFAMSYILFVNPAILSQTGMPAQGVFLATIIGAVVATSVMAFYANLPYAQAPGMGLNAFFTYTVVFALGYTWQEALAMVFICGLISLIITLTKVRKMIIESIPTTLKSAITAGIGTFLAYVGIKNAGFLKFSIDPGTYDVVGKGAAKGLATITANSSATPGLVSFDNPAILLSLIGLSITIFFIVKGIRGGIILSILTTTLLGILMGVVKLDAINWEATNLSASFRDLKQVFGVALGEKGLISLFSNPSRLPSVLMAILAFSLTDIFDTIGTLIGTGEKVGILATTGDNHESKSLDKALYSDLIGTTFGAICGTSNVTTYVESAAGIGAGGRTGLTALVVAGLFAISSFFSPLVSIVPSQATAPILVIVGIMMLSNLKDIKWDDMSEAIPAFFTSLFMGFTYSITYGIAAGFLTYTLAKVIKGQAKDIHVVLWILDILFILNFISLAIL

SEQ ID NO: 17456 - protein, 449 aa, Streptococcus agalactiae NEM316
MTHITFDYSKVLGQFVGEHELDYLQPQVSAADAFLRQGTGPGSDFLGWMDLPENYDKEEFSRIQKAAEKIKSDSEVLVVIGIGGSYLGAKAAIDFLNNHFANLQTAEERKAPQILYAGNSISSTYLADLVEYVQDKEFSVNVISKSGTTTEPAIAFRVFKELLVKKYGQEEANKRIYATTDKVKGAVKVEADANNWETFVVPDNVGGRFSVLTAVGLLPIAASGADITALMEGANAARKDLSSDKISENIAYQYAAVRNVLYRKGYITEILANYEPSLQYFGEWWKQLAGESEGKDQKGIYPTSANFSTDLHSLGQFIQEGYRNLFETVVRVEKPRKNVTIPELTEDLDGLGYLQGKDVDFVNKKATDGVLLAHTDGGVPNMFVTLPTQDAYTLGYTIYFFELAIGLSGYLNSVNPFDQPGVEAYKRNMFALLGKPGFEELSAELNARL

SEQ ID NO: 17457 - protein, 244 aa, Streptococcus agalactiae NEM316
MVEPIISIQGLHKSFGKNEVLKGIDLDIHQGEVVVIIGPSGSGKSTFLRTMNLLEVPTKGTVTFEGIDITDKKNDIFKMREKMGMVFQQFNLFPNMTVLENITLSPIKTKGLSKLDAQTKAYELLEKVGLKEKANAYPASLSGGQQQRIAIARGLAMNPDVLLFDEPTSALDPEMVGEVLTVMQDLAKSGMTMVIVTHEMGFAREVADRVIFMDAGIIVEQGTPKEVFEQTKEIRTRDFLSKVL

SEQ ID NO: 17458 - protein, 278 aa, Streptococcus agalactiae NEM316
MIVGEQEARALIKPRPKSSHKGDYGSVLLIGGFYPYGGAIIMAALACVKTGAGLVTVATQSCNIPSLHSQLPEVMAFDSDDYKWLEKSIVQSDVIVIGPGLGVSESSRKILNQTMEKIQSHQSVIIDGSALTLLSEGAFPQTKAKNLVLTPHQKEWERLSGIAVSQQTKENTQTALKSFPKGTILVAKSSHTRIFQDLDEKEIIVGGPYQATGGMGDTLCGMIAGMLAQFKEASPLDKVSVGVYLHSAIAQELSKEAYVVLPTTISDEIPKEMARLSK

SEQ ID NO: 17459 - protein, 435 aa, Streptococcus agalactiae NEM316
MSIITDVYAREVLDSRGNPTLEVEVYTESGAFGRGMVPSGASTGEHEAVELRDGDKSRYGGLGTQKAVDNVNNVIAEAIIGYDVRDQQAIDRAMIALDGTPNKGKLGANAILGVSIAVARAAADYLEVPLYSYLGGFNTKVLPTPMMNIINGGSHSDAPIAFQEFMIMPVGAPTFKEALRWGAEVFHALKKILKERGLETAVGDEGGFAPKFEGTEDGVETILKAIEAAGYEAGENGIMIGFDCASSEFYDAERKVYDYSKFEGEGGAVRTAAEQIDYLEELVNKYPIITIEDGMDENDWDGWKALTERLGGRVQLVGDDFFVTNTDYLARGIKEEAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 17460 - protein, 251 aa, Streptococcus agalactiae NEM316
MSLISYKNVNKYYGDYHALRQINLEIEPGQVVVLLGPSGSGKSTLIRTMNALESIDDGSLVVNGHELANSSSKELVNLRKEVGMVFQHFNLYPHKTVLENITLAPIKVLKQSKKEAMEIAEKYLKFVNMWERKDSYPSMLSGGQKQRIAIARGLAMHPKLLLFDEPTSALDPETIGDVLSVMQKLANDGMNMVVVTHEMGFAREVADRIIFMADGEILVDTTDVQDFFDNPTEPRAKQFLSNIINHTSTDL

SEQ ID NO: 17461 - protein, 252 aa, Streptococcus agalactiae NEM316
MSRKPFIAGNWKMNKNPEEAKAFIEAVASKLPSSELVEAGIAAPALTLSTVLEAAKGSELKIAAQNSYFENSGAFTGENSPKVLAEMGTDYVVIGHSERRDYFHETDQDINKKAKAIFANGLTPIICCGESLETYEAGKAVEFVGAQVSAALAGLSEEQVSSLVIAYEPIWAIGTGKSATQDDAQNMCKAVRDVVAADFGQAVADKVRVQYGGSVKPENVAEYMACPDVDGALVGGASLEAESFLALLDFVK

SEQ ID NO: 17462 - protein, 230 aa, Streptococcus agalactiae NEM316
MVKLVFARHGESEWNKANLFTGWADVDLSEKGTQQAIDAGKLIQAAGIEFDLAFTSVLKRAIKTTNLALEAADQLWVPVEKSWRLNERHYGGLTGKNKAEAAEQFGDEQVHIWRRSYDVLPPDMAKDDEHSAHTDRRYASLDDSVIPDAENLKVTLERALPFWEDKIAPALKDGKNVFVGAHGNSIRALVKHIKQLSDDEIMDVEIPNFPPLVFEFDEKLNLVSEYYLGK

SEQ ID NO: 17463 - protein, 475 aa, Streptococcus agalactiae NEM316
MTVFPKHFLWGGAVAANQVEGAFRTDGKGLSVQDVLPNGGLGDFTAKPTPDNLKLEAIDFYHNYKNDIKLFAEMGFKVFRTSIAWSRIFPNGDDSAPNEAGLQFYDNLFDELLKYNIEPLVTLSHYETPLHLAKTYNGWADRRLIAFFEKFAQTVMERYKDKVKYWLTFNEVNSILHMPFTSGAIMTDKSQLSPQELYQAIHHELVASARVTKLGRSINPNFKIGCMILAMPAYPMTSDPRDVLAARQFEQHNLLFSDIHVRGKYPTYIQSYFKNNGIKIKFEEGDEEVLAQNTVDFLSFSYYMSVTQAYDFENYQSGQGNILGGLTNPHLTTSEWGWQIDPIGLRLVLNQYYERYQIPLFIVENGLGAKDQLIETLDGDYTVEDDYRIDYMNQHLVQVAKAIEDGVEIMGYTSWGCIDCVSMSTAQLSKRYGLIYVDRNDDGTGSLQRYKKKSFGWYQKVIKTNGQSLFEHHNR

SEQ ID NO: 17464 - protein, 475 aa, Streptococcus agalactiae NEM316
MTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGQRIGKLAGMRPIMLELGGKDAGIVLADADLDNAAKQIVAGAYDYSGQRCTAIKRVLVVEEVANELAEKISENVAKLSVGDPFDNATVTPVIDDNSADFIESLVVDARQKGAKELNEFKRDGRLLTPGLFDHVTLDMKLAWEEPFGPILPIIRVKDADEAVAIANKSDFGLQSSVFTRDFQKAFDIANKLEVGTVHINNKTGRGPDNFPFLGLKGSGAGVQGIRYSIEAMTNVKSIVFDMK

SEQ ID NO: 17465 - protein, 500 aa, Streptococcus agalactiae NEM316
MNKRVKIVATLGPAVEFRGGKKFGESGYWGESLDVEASAEKIAQLIKEGANVFRFNFSHGDHAEQGARMATVRKAEEIAGQKVGFLLDTKGPEIRTELFEDGSDFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGNGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGLVESGDNIVIVAGVPVGTGGTNTMRVRTVK

SEQ ID NO: 17466 - protein, 456 aa, Streptococcus agalactiae NEM316
MSKIVVVGTNHAGTAAIKTMLSNYGEANEIVTFDQNSNISFLGCGMALWIGEQIDGPEGLFYSDKEQLESMGAKVYMNSPVLNIDYDKKEVTALVDGKEHVESYEKLILATGSQPIIPPIKGVEIQEGSREFKATLENLQFVKLYQNSEEVIEKLAKPGINRVAVVGAGYIGVELAEAFQRIGKEVTLVDVADTCMGGYYDRDFTDMMSKNLEDHGIRLAFGQAVQAVEGDGKVERLVTDKETFDVDMVILAVGFRPNTELGAGKLDTFRNGAWVVDKKQETSVKDVYAIGDCATIWDNSRDDINYIALASNAVRTGIVAAHNACGTELEGAGVQGSNGISIYGLNMVSTGLTLEKAKQAGYNAVETGFNDLQKPEFIKHNNHEVAIKIVYDKDSRVILGCQMVSHEDVSMGIHMFSLAIQEKVTIEKLALTDIFFLPHFNKPYNYITMAALGAKD

SEQ ID NO: 17467 - protein, 399 aa, Streptococcus agalactiae NEM316
MNNVQGNLFRPLILPNGLSLENRFVLSPMVTNSSTSEGFVTDDDIAYAVRRAKSAPLQITGAAYVTEYGQLFEYGFSVSKDEDIPGLTKLAKAMKSKGAKAVLQLTHAGRFSSHTLARHGYVYGPSPMQLQSPYPHQVKELTHKDILMIIDEYVQATRRAIQAGFDGVEISSAQRLLIQTFFSTFSNQRKDEYGPQTLTNRCRLGLEVFKAVQKVIREEAESDFILGFRATPEETRGSQIGYSIEEFMEFLEKILAIAQVDYLAIASWGHDVFRNTIRSEGVYKGQLVNQVIFEHFGDRVPIMATGGINSASKVFEALQHAHMVGASTPLVVDPEFLQKIKAKRSDQINLRIKVSDLEGLAIPKASFKDIVPLMDYGESLPKEAREVFRELRSNYREER

SEQ ID NO: 17468 - protein, 327 aa, Streptococcus agalactiae NEM316
MFNDIPVFDYEDIQLIPNKCIISSRSQADTSVKLGNYTFKLPVIPANMQTIIDEEVAETLACEGYFYIMHRFNEEERKPFIKRMHDKGLIASISVGVKDYEYDFVTSLKEDAPEFITIDIAHGHSNSVIEMIQHIKQELPETFVIAGNVGTPEAVRELENAGADATKVGIGPGKVCITKVKTGFGTGGWQLAALRWCSKAARKPIIADGGIRTHGDIAKSIRFGASMVMIGSLFAGHLESPGKLVEVDGQQFKEYYGSASEYQKGEHKNVEGKKILLPVKGRLEDTLTEMQQDLQSSISYAGGKELDSLRHVDYVIVKNSIWNGDSI

SEQ ID NO: 17469 - protein, 478 aa, Streptococcus agalactiae NEM316
MVKQVFPKGFLWGGATAANQCEGAYNVDGRGLANVDVVPTGEDRFAIISGQKKMFDFEEGYFYPAKESIDFYHHYKEDLALLAEMGFKTYRMSIAWTRIFPKGDELYPNEAGLRFYENIFKECRKYGIEPLVTITHFDCPIYLIKHYGGWRSRKMIGFYERLVRALFTRFKGLVKYWLTFNEINMILHAPFMGAGLYFEDGENQEQIKYQAAHHELVASAIAVKIAHEVDPNNQIGCMLAAGQYYPNTCHPQDYWASMQKNRENYFFIDVQTRGKYPNYAKKYFEHLGISIQMTAEDLALLRDYTVDFISFSYYSSRVASGNPTVSEQVQENIFASLKNPYLKSSEWGWQIDPLGLRITLNAIWDRYQKPMFIVENGLGAVDIPDENGYVEDDYRIDYLRQHIAAMRDAIYVDGVNLIGYTTWGCIDLVSAGTGEMEKRYGFIYVDRNNKGEGTLKRYKKKSFYWYKKVIASNGSQIE

SEQ ID NO: 17470 - protein, 384 aa, Streptococcus agalactiae NEM316
MTNPIIAFKNVSKVFEDSNTVVLKDINFELEEGKFYTLLGASGSGKSTILNIIAGLLEASTGDIYLDGKRINDVPTNKRDVHTVFQNYALFPHMTVFENVAFPLKLKKMDKKEIQKRVQETLKMVRLEGFEKRAIQKLSGGQRQRVAIARAIINQPKVVLLDEPLSALDLKLRTEMQYELRELQQRLGITFVFVTHDQEEALAMSDWIFVMNEGEIVQSGTPVDIYDEPINHFVATFIGESNILSGKMIEDYLVEFNGKRFEAVDGGMRPNESVQVVIRPEDLQITLPDEGKLQVKVDTQLFRGVHYEIIAYDDLGNEWMIHSTRKAIEGEVIGLDFTPEDIHIMRLNETEEEFDARIEEYVDTDDHEDGLINAIEEERNEENL

SEQ ID NO: 17471 - protein, 1252 aa, Streptococcus agalactiae NEM316
MKRKDLFGDKQTQYTIRKLSVGVASVATGVCIFLHSPQVFAEEVSVSPATTAIAKSNINQVDNRQSTNLKDDINSNSETVVTPSDMPDTKQLVSDETDTQKGVTEPDKATSLLEENKGPVSDKNTLDLKVAPSTLQNTPDKTSQAIGAPSPTLKVANQAPQIENGYFRLHLKELPQGHPVESTGLWIWGDVDQPSSNWPNGAIPMTNAKKDDYGYYVDFKLSEKQRKQISFLINNKAGTNLSGDHHIPLLRPEMNQVWIDEKYGIHTYQPLKEGYVRINYLSSSGNYDHLSAWLFKDVATPSTTWPDGSNFVNQGLYGRYIDVPLKTNAKEIGFLILDESKTGDAVKVQPNDYVFRDLANHNQIFVKDKDPKVYNNPYYIDQVQLKDAQQTDLTSIQASFTTLDGVDKTEILKELKVTDKNQNAIQISDITLDTSKSLLIIKGDFNPKQGHFNISYNGNNVTTRQSWEFKDQLYAYSGNLGAVLNQDGSKVEASLWSPSADSVTMIIYDKDNQNRVVATTPLVKNNKGVWQTILDTKLGIKNYTGYYYLYEIKRGKDKVKILDPYAKSLAEWDSNTVNDDIKTAKAAFVNPSQLGPQNLSFAKIANFKGRQDAVIYEAHVRDFTSDQSLDGKLKNQFVTFAAFSEKLDYLQKLGVTHIQLLPVLSYFYVNEMDKSRSTAYTSSDNNYNWGYDPQSYFALSGMYSEKPKDPSARIAELKQLIHDIHKRGMGVILDVVYNHTAKTYLFEDIEPNYYHFMNEDGSPRESFGGGRLGTTHAMSRRVLVDSIKYLTSEFKVDGFRFDMMGDHDAAAIELAYKEAKAINPNMIMIGEGWRTFQGDQGKPVKPADQDWMKSTDTVGVFSDDIRNSLKSGFPNEGTPAFITGGPQSLQGIFKNIKAQPGNFEADSPGDVVQYIAAHDNLTLHDVIAKSINKDPKVAEEEIHRRLRLGNVMILTSQGTAFIHSGQEYGRTKRLLNPDYMTKVSDDKLPNKATLIEAVKEYPYFIHDSYDSSDAINHFDWAAATDNNKHPISTKTQAYTAGLITLRRSTDAFRKLSKAEIDREVSLITEVGQGDIKEKDLVIAYQTIDSKGDIYAVFVNADSKARNVLLGEKYKHLLKGQVIVDADQAGIKPISTPRGVHFEKDSLLIDPLTAIVIKVGKVAPSPKEELQADYPKTQSFKGSKTVEKVNRIANKTSITPVVSNKTDSYLTNEANLPKTGDKSSKILSVVGISILASLLALLGLSLKRNRHLK

SEQ ID NO: 17472 - protein, 446 aa, Streptococcus agalactiae NEM316
MYQTQTNKEKFVLFLKLFIPVLIYQFANFSATFIDSVMTGQYSQLHLAGVSTASNLWTPFFALLVGMISALVPVVGQHLGRGNKEQIRTEFHQFLYLGLILSLILFLIMQFIAQPVLGSLGLEDEVLAVGRGYLNYMLIGIMPLVLFSICRSFFDALGLTRLSMYLMLLILPFNSFFNYMLIYGKFGMPRLGGAGAGLGTSLTYWAIFIVIIIVMSLHPQIKTYHIWTLERIKAPLIIEDIRLGLPIGLQIFAEVAIFAVVGLFMAKFSSIIIAAHQAAMNFSSLMYAFPLSISTALAITISFEVGAERIQDANTYSRIGRLTAVGITSGTLLFLFLFRENVAAMYNSDPHFVAITAQFLTYSLFFQFADAYAAPVQGILRGYKDTTKPFMIGAGSYWLCALPLAVILEKNSQLGPFAYWIGLITGIFVCGLFLNQRLQKIKKLYY

SEQ ID NO: 17473 - protein, 468 aa, Streptococcus agalactiae NEM316
MTKTLPKDFIFGGATAAYQAEGATHTDGKGPVAWDKYLEDNYWYTAEPASDFYHKYPVDLALAEEYGVNGIRISIAWSRIFPTGYGEVNLKGVEFYHKLFEECHKRHVEPFVTLHHFDTPEALHSNGDFLNRDNIEHFVNYAAFCFEEFPEVNYWTTFNEIGPIGDGQYLVGKFPPGIQYDLAKVFQSHHNMMVSHARAVKLYKDKGYKGEIGVVHALPTKYPLDPENSADVRAAELEDIIHNKFILDATYLGYYSEMTMAGVKHILKENGGELDLREEDFQALEAAKDLNDFLGINYYMSDWMQAFDGETEIIHNGKGEKGSSKYQIKGVGRRVAPDYVPKTDWDWIIYPQGLYDQIMRVKNDYPNYKKIYITENGLGYKDEFVDNTVYDDGRIDYVKQHLEVLSEAISDGANVKGYFIWSLMDVFSWSNGYEKRYGLFYVDFETQERYPKKSAHWYKQVAKTQIIE

SEQ ID NO: 17474 - protein, 458 aa, Streptococcus agalactiae NEM316
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPDVPAWAFASFFALVIFGLNALSVRFFAEAESFFSSIKVIAIIIFIILGLGAMFGLVSFEGQHKAILFTHLTANGDFPNGIVAVVSVMLAVNYAFSGTELIGIAAGETDNPKEAVPRAIKTTIGRLVVFFVLTIVVLASLLPMKEAGVSTAPFVDVFDKMGVPFAADIMNFVILTAILSAGNSGLYASSRMLWSLANEGMLSKSVVKINKYGVPMRALLLSMAGAVLSLFSSIYAADTVYLALVSIPGFAVVVVWLAIPVAQINFRKEFLKENRLEDLSYKTPFTPVLPYITIVLLLISIVGIAWDSSQRAGLYFGVPFIILCYIYHKLRYKTW

SEQ ID NO: 17475 - protein, 449 aa, Streptococcus agalactiae NEM316
MSKQYDYIVIGGGSAGSGTANRAAMYGAKVLLIEGGQVGGTCVNLGCVPKKIMWYGAQVSETLHKYSSGYGFEVNNLNFDFTTLKANRDAYVQRSRQSYAANFERNGVEKIDGFARFIDNHTIEVNGQQYKAPHITIATGGHPLYPDIIGSELGETSDDFFGWETLPDSILIVGAGYIAAELAGVVNELGVETHLAFRKDHILRGFDDMVTSEVMAEMEKSGISLHANHVPKSLKRDEGGKLIFEAENGKTLVVDRVIWAIGRGPNVDMGLENTDIVLNDKGYIKTDEFENTSVDGVYAIGDVNGKIALTPVAIAAGRRLSERLFNHKDNEKLDYHNVPSVIFTHPVIGTVGLSEAAAIEQFGEDNIKVYTSTFTSMYTAVTTNRQAVKMKLITLGKEEKVIGLHGVGYGIDEMIQGFSVAIKMGATKADFDDTVAIHPTGSEEFVTMR

SEQ ID NO: 17476 - protein, 347 aa, Streptococcus agalactiae NEM316
MFVKKGLFVFLLLCILSMWLMIFGVAFYYFGSLHQSLTSRIIYQFVLTVLLTTTAWFMGAYFLAFEGHFKTVFQFQEADGKQIVNCLFQLCFALYAVVMLIGSIIDRVQTKRLLLAVVSWLFLVYTPLAYLIWNSEGVFAKMGVLDFSGGMVVHLSAGLSSYILAHVIGKSEHQHNKVKNDSLFLGMILITFGWFGFNMGPVGEWNSQAIMILLNTIFAIIGGGLAWTLAAKWNGEEEKTGSLLNGIIVGLVTSTAGVGYLLTWQLLAVTFFASLFTYFVTDYVAKAFAIDDVVSSFGMNGIGGLLGSLGVGLFKLSHMPVQLLALATTILLSIIMTYIISKAIFRK

SEQ ID NO: 17477 - protein, 457 aa, Streptococcus agalactiae NEM316
MLKKLFAPPQKRERLSAEEIKHKYPRYRVQVLISIFVGYMGYYFVRNTTSILSGILNMSATEIGIITCASYIAYGLSKFISGLISDESNSKIFLPVGLFLTGLVNVLIGVIPSVITSIWLFTIMYLINGWLQGMGYPPGARTLVYWYDNKERIKYATIWNLSHNFGGAIAPILTGVGLALAGNDSLNQARAAYWFPGVVACLLAVLVYFLQEDTPESIGLPPIEEYHKEQYTNVVDSSDILEEPEVLGMGEIIKKYILPNTKLMWASLYSIFVYILRYGIVSWTPKFLATSVQDGGKGITATAGMGGFSLFEIGGIIGMLTAGYLSAKVFKNSKPLTNVAFLVVAILLLAAYWFIPAGPQYMALDFIILLGLGASIYGPVMMVGLYAMELVPKAAAGAASGLTGTFSYVGGATIATLAIGIIIDHFGWGVAFIIFGISGFAAIVCTLLSRDKSLEYW

SEQ ID NO: 17478 - protein, 246 aa, Streptococcus agalactiae NEM316
MAELKIDVQDLHKSYGQNEVLKGIDAKFYEGDVVCIIGPSGSGKSTFLRTLNLLESITSGKVVVDGFELSNPKTDIDKARENIGMVFQHFNLFPHMSVLENITFAPIELGKESKEAAEKHGMELLEKVGLADKANAKPDSLSGGQKQRVAIARSLAMNPDILLFDEPTSALDPEMVGDVLNVMKDLAEQGMTMLIVTHEMGFARQVANRVIFTDGGRFLEDGTPEQIFDTPQHPRLQDFLNKVLNV

SEQ ID NO: 17479 - protein, 462 aa, Streptococcus agalactiae NEM316
MSKNNNDHTQKSENGMVRGLENRHVQLIAIAGTIGTGLFLGAGRSISLTGPSIVLVYAITGAFMFFMMRAIGEMLYQDPNQHTFINFITKYLGPGWGFFSTLSYWISLIFIGMAEITAVGEYVQFWFPEWPSWIIQIVFLAILSSINLIAVKAFGETEFWFAMIKVIAILGLIATGIFMVLTNFDTGHGYHASISNITNHFEWFPKGKLNFFMAFQMVFFAYLAIEFVGVTTSETANPRKVLPKAIQEIPMRIILFYAGSLLAIMAIFPWQQLPVNESPFVTVFKLAGIKWAAALINFVVLTSAASALNSTLYSTGRHLFQLANESPNTLTKALKLDQLSRQSVPSRAIIASAVIVGASALISVLPGISDAFSLITASSSGVYISIYVLIMIAHWKYRKSPDFMEDGYKMPAYKILSPITLLFFLFVFVSLFLQDSTYIGAIGATIWIIGFGLYSHFKHKSH

SEQ ID NO: 17480 - protein, 237 aa, Streptococcus agalactiae NEM316
MTQFLGEFLGTFILVLLGDGVVAGNVLSKTKEEGTGWTAIVFGWGIACTVAVYVSGLFSPAHLNPAVTLAMASIGAISWGQVIPFIIAQMLGAMVAATILWLHYYPHWKETKDSGLILASFSTGPAIRHTPSNLLGEIIGTAILVITIMAIGPSKVAAGLGPIIVGIVIFAVGFSLGPTTGYAINPARDLGPRLMHAILPIENKGDSDWSYAWIPVVGPIIGGVLGAILYNIALTLI

SEQ ID NO: 17481 - protein, 304 aa, Streptococcus agalactiae NEM316
MLQNIGQTGIQATRIALGCMRMSDLEGKQAEEVVGTALDLGINFFDHADIYGGGLSELRFRDAIKHLNVNRDKMIIQSKCGIREGYFDFSKEYILSSVDGILERLGTEYLDFLILHRPDVLVEPEEVAEAFTKLRAEGKVKHFGVSNQNRFQMELLQSYLDEPLAVNQLQLSPAHTPMFDAGLNVNMLNKASIEHDDGIVDYCRLKRVTIQAWSPFQIDLSRGLFVNHPDYKELNETIAKLAKNYNVSSEAIVIAWILRHPAQIQAIVGSMNPSRLKAIDKANDIALTREEWYDIYRSAGNILP

SEQ ID NO: 17482 - protein, 448 aa, Streptococcus agalactiae NEM316
MTITAEDIRREVKEKNVTFLRLMFTDILGVMKNVEIPATDEQLDKVLSNKAMFDGSSIEGFVRINESDMYLYPDLDTWIVFPWGDENGAVAGLICDIYTAEGEPFAGDPRGNLKRNMKRMQEMGYKSFNLGPEPEFFLFKMDENGNPTLDVNDKGGYFDLAPTDLADNTRREIVNVLTQMGFEVEASHHEVAVGQHEIDFKYDDVLKACDNIQLFKLVVKTIARKHGLYATFMAKPKFGINGSGMHCNMSLFDNEGNNAFFDPEDPRGMQLSEDAYYFLGGLMEHAYNYTAIINPTVNSYKRLVPGYEAPVYIAWAGRNRSPLIRVPASRGMGTRLELRSVDPTANPYLALSVLLGSGLEGIENKIEAPEPIETNIYAMTVEERRQAGIVDLPSTLHNALKALEEDEVVKAALGTHIYTNFLDAKRIEWASYATYVSQWEIDNYLDLY

SEQ ID NO: 17483 - protein, 398 aa, Streptococcus agalactiae NEM316
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGAKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQLGVKSIIGGGDSAAAAINLGRADKFSWISTGGGASMELLEGKVLPGLAALTEK

SEQ ID NO: 17484 - protein, 220 aa, Streptococcus agalactiae NEM316
MSTNKIAPSILAADYANFANELKRIEETTAEYVHIDIMDGQFVPNISFGADVVSSMRKHSKLVFDCHLMVVDPERYIEDFAQAGADIMTIHVEATKHIHGALQKIKEAGMKAGVVINPGTPVESLIPILDLVDQILIMTVNPGFGGQAFIPEMMSKVKTVAAWRKEYGHHYDIEVDGGIDNTTIKAAAEAGANVFVAGSYLFKASDLPAQVETLRVALDD

SEQ ID NO: 17485 - protein, 415 aa, Streptococcus agalactiae NEM316
MSPLNINKNNWRALIAAIVASGTDDLNIMFLAFSMSTIITDLHLSAAQAGWIGTITNLGMLVGGLIFGLLADRYNKFKVFKWTILIFSIATGLVFFTTNLSYLYIMRFIAGIGVGGEYGIAIAIMAGIVPTNKMGRISSLNGIAGQVGSISSALLAGWLAPALGWRGLFLFGLLPIVLVLWMQFAVDDKDILDQYNTDADDEPLDISIKALFDTPVLATQSLALMVMTTVQIAGYFGMMNWLPTIIQTNLNVSVKNSSLWMIATILGMCLGMLVFGQLLDKFGPRLVYGCFLLSSAICVYLFQFATTMPSMIIGGAVVGFFVNGMFAGYGAMITRLYPHHIRSTANNLILNVGRAIGGFSSVIIGMILDVSNVSMVMLFLASLYIVSFLSMLSIKQLKRQKYHTNLTQLDVKPTD

SEQ ID NO: 17486 - protein, 493 aa, Streptococcus agalactiae NEM316
MSNWDTKFLKKGFTFDDVLLIPAESHVLPNEVDMKTKLADNLTLNIPIITAAMDTVTDSKMAIAIARAGGLGIIHKNMSIVDQAEEVRKVKRSENGVIIDPFFLTPDNTVSEAEELMQNYRISGVPIVETLENRKLVGIITNRDMRFISDYKQLISEHMTSQNLVTAPIGTDLETAERILHEHRIEKLPLVDDEGRLSGLITIKDIEKVIEFPKAAKDEFGRLLVAGAVGVTSDTFERAEALFEAGADAIVIDTAHGHSAGVLRKIAEIRAHFPNRTLIAGNIATAEGARALYDAGVDVVKVGIGPGSICTTRVVAGVGVPQITAIYDAAAVAREYGKTIIADGGIKYSGDIVKALAAGGNAVMLGSMFAGTDEAPGETEIFQGRKFKTYRGMGSIAAMKKGSSDRYFQGSVNEANKLVPEGIEGRVAYKGSVADIVFQMLGGIRSGMGYVGAANIKELHDNAQFVEMSGAGLKESHPHDVQITNEAPNYSVH

SEQ ID NO: 17487 - protein, 476 aa, Ochroma pyramidale
  misc_feature (1)..(9): Xaa can be any naturally occurring amino acid
XXXXXXXXXSVGFKAGVKEYKLTYYTPEYEVKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGAPIVMHDYLTGGFTANTSLAHYCRDNGLLLHIHRAMHAVIDRQKNHGMHFRVLAKALRLSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTLD

SEQ ID NO: 17488 - protein, 476 aa, Fremontodendron mexicanum
  misc_feature (1)..(9): Xaa can be any naturally occurring amino acid
XXXXXXXXXSVGFKAGVKEYKLTYYTPEYEVKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAVFARELGVPIVMHDYLTGGFTANTSLAHYCRDNGLLLHIHRAMHAVIDRQKNHGMHFRVLAKALRLSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTLD

SEQ ID NO: 17489 - protein, 476 aa, Theobroma cacao
  misc_feature (1)..(9): Xaa can be any naturally occurring amino acid
XXXXXXXXXSVGFKAGVKEYKLTYYTPEYEVKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAICARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSIPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTLD

SEQ ID NO: 17490 - protein, 476 aa, Tilia americana
  misc_feature (1)..(9): Xaa can be any naturally occurring amino acid
XXXXXXXXXSVGFKAGVKEYKLTYYTPEYEVKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAVFARELGVPIVMHDYLTGGFTANTTLAHYCRDNGLLLHIHRAMHAVIDRQKNHGIHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTLD

SEQ ID NO: 17491 - protein, 475 aa, Sloanea latifolia
  misc_feature (1)..(9): Xaa can be any naturally occurring amino acid
XXXXXXXXXSVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 17492 - protein, 476 aa, Daphne mezereum
  misc_feature (1)..(9): Xaa can be any naturally occurring amino acid
XXXXXXXXXSVGFKAGVKEYKLTYYTPEYETKDTDILAAFRVTPQPGVPPEEAGAAVAAESSTGTWTTVWTDGLTSLDRYKGRCYHIEPVPGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHVHAGTVVGKLEGERDITLGFVDLLRDDFIEKDRSRGIFFTQDWVSLPGVLPVASGGIHVWHMLPLTEIFGDDSVLQFGGGTLGHPWGNAPGAVANRVALEACVQARNEGRDLAREGNEIIREASKWSPELAAACEIWKEIKFEFQAMDTLD

SEQ ID NO: 17493 - protein, 475 aa, Asteranthos brasiliensis
  misc_feature (1)..(9): Xaa can be any naturally occurring amino acid
XXXXXXXXXSVGFKAGVKDYKLTYYTPDYKTLDTDILAAFRVTPQPGVPPEEAGAAVAAESSTGTWTTVWTDGLTSLDRYKGRCYHIEPVPGEDNQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTSEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDYIEKDRSRGIYFTQDWVSMPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 17494 - protein, 340 aa, Corynebacterium efficiens YS-314
MTTFRAALVESFDADIAVKDVERPTPGPNQALVKLIASGICHTDLHAAKGDWPVLPEPPFIPGHEGIGEIVELGPGEHDVAVGDIVGNAWLWSACANCEFCRTGRETFCPNAQYGGYTQNGSFGEYMLVDTRFAPRIPDGVDYLEAAPILCAGVTVYKALKVSNIRPGQFMVISGIGGLGHIAVQYAKAMGMRPIAVDIADSKLELAKSLGAEFTVNARDVDPAEAVREFTNGGAHGVLVTAVHEKAFGQALGMARTNGTIVFNGLPPGEFPVSVFDVVFRGLTITGSLVGTRQDMEEALDFYARGLIKPKVAECGLDDVADVFEKLESGGIDGRVAIRY

SEQ ID NO: 17495 - protein, 499 aa, Corynebacterium efficiens YS-314
MRLWGAGGLAEAMSTENFVSNQIFINGWVDGTSERSTTTLNPFNGEEVATIRNASQEDVDKAYATAAEVQKEWAAVPPVKKARILNKAAQVIEDNRDAIVELIRRESGSTALKANIEAGLAMASLREAATFPARITGQILPSNTPGKSNYVFREPLGVVGVISPWNFPFALSMRSVAPALACGNGVVLKPASDTPIVGGTLLAHIFEAAGLPTGLFNVVVGAGSEIGDYFVEHRIPRLISFTGSTPVGKQVGATATGGKYIKKVALELGGNAPMVVLSDADINKAVAAASMGSFLHQGQICMAVNRIIVEAPVYDQFLEGFAARVSKVAYGDQLDDATMVGPIVNDSQVESVSGKIDLAREQGARAVVSGPIEGRVIAPHVFADVTPDMELFREEIFGPVVGVVKADNEEHALELANDTEFGLSSAVFTEDLQRGINFARRVEAGMTHINDITVNDEAHVMFGGEKNSGLGRFNGEWAIDEFTTDHWVSVTTGTDAYPI

SEQ ID NO: 17496 - protein, 1294 aa, Corynebacterium efficiens YS-314
MGFLRCAGSPPPNPEILSAESSTDLWVNFRGFWEQELGVKAATVSGGASAPAPGTAGDRISTCQYVGGHNNRDNWCGSHDGRVSARSVVGSGPRWPTNTARDVTNPGEQGASTMTATTDHSMKLPIELATLTDRAVVKVRDWLEYAQQESVPNPTAERLAAILQDPNGLEFTVGFVDRVVRTEDIHAAARALNDLGSIAPSTMSFIDRAQIQAGSLVGRALPHVVVPAARARIRQMVGHMIVDARDKPFGRAVAELQGDGNRLNINLLGEAVLGEKEALKHLEDARRLLGRMDVDYVSIKVSSVASQISLWGFDETVEAVVKRLTPLYKEAAAATGTPGGTKFINLDMEEYGDLRLTIEVFKRLMSLPGVENLEAGIVLQAYLPDALASLQELAEFGAHRVDNGGAPIKIRLVKGANLPMEHVHAEIAGWPVATMPSKQATDANYKRVLWWALRRENMTGLRLGVAGHNLFDIAFAHLLSIERGVAEKVEFEMLQGMASDQARAASRDVGQLLLYVPAVRPQEFDAAISYLVRRLEENSASENFMSVIFDLEADNPAFRREESRFRASIEDLAGLIDAPVPGPNDTQDRGAQEAETLEAAGERARELEAARAPDQLPPFANEPDTNPALTANQQWARAAIKRSAGEGWLEQQTAPLSVEEEDIDALIEGTRAAAAEWAALPPMERARILYRTADILAARRGHLVSIAAAEVGKVVEQTDPEISEAIDFARYYAHRALELEQVDNADFTPDRVAVITPPWNFPIAIPAGSTFAALAAGAGVIHKPSKPSQHCSAAVVEALWEAGVPRRVLHCVYPANREAGRRLVSHPEVDRVILTGSSETAAMFASWRPDLQINAETSGKNAMVITPAADRDLAVADLVHSAFGHAGQKCSAASLGILVGTMYTSERFRSQLVDAASSLVVDWPTNMSATVGPLTEQPSDKLQHALTQLEPGERWLLEPKPLDDTGRLWRPGIKEGVQPGSFFHLTEVFGPVLGLMKADDLEQAIEYQNAVEFGLTGGIQSLDIDEVRTWVDAVEVGNVYVNRGITGAIVERQSFGGWKKSSVGLGSKAGGPNYVMLMGRWSDKPAKDAPVKSSPLINKWTHTLSPDDITWLEQANASDALAWTSEFGTPRDPSGLEAEANIFRYRPAKVVLRIADDAEPREVARAVLAARRAGAQLTAMVGPGVGGGVREVLADASTSVETIDDAVFITRLLRGDYDDGTGARVRVIGTVTPFQRERLAVRPEVAILDEPVTSSGRVELRYWLKEQAVSMTLHRFGNRSEAFHKLAADLKRPL

SEQ ID NO: 17497 - protein, 387 aa, Corynebacterium efficiens YS-314
MRSQSSCHPGDNTGPGVKLGHVLPSDVESEHLNMTTPHHPTPVRAWGVTAFAQPLESLTITRRELRADDVSIDIEYAGICHSDIHTATGDWGEREYPLVPGHEIVGRVSAVGDAVTKHRVGDRVGVGCFVNSCGHCEPCRAGEHSYCDTGAVLTYGSEDRYADGEYTQGGYSQAIVVKEDFVVRVPESLDPAAATPLLCAGITTYSPLKHHGAGPGKKVGIIGLGGIGHVAVKIAVAMGAEVVVFSHSTSKREDALKFGATEHVSTADPTFAETWGGQFDLILNTVSVNLDTATYLSLLCFDGALVALGLPNDPMEVPTRMLTSKRRTLTGSLVGGIPETQEMLDFCAEHNITAEIELIDATSINEAYERTINSDVRYRFVIDAATF

SEQ ID NO: 17498 - protein, 508 aa, Corynebacterium efficiens YS-314
MSDPHGFQKYTRAEPAHRPVPLRLMDFHEVYEAAPAGQIEEQAARCMDCGVPFCHQGCPLGNIIPEWNNLVREGRWKEAYDRLHATNNFPEFTGRLCPAPCEGACVLDINDDAVTIKNVELEIVERAFAEGWVEPVRASLDTGLTVAVVGSGPAGLAAAQQLTRAGHRVTVFERSDRLGGLMRYGVPDYKMENRWIDRRLDQMRAEGTVFRVGVSPKAAELALFDAVVLATGTPVARELGIPGAELAGVHPAMDYLTAQNRANEGDGPVPAEFDARGRRVVIIGGGDTGTDCFGTALRQGAASVTQFDIRPRGPVLRAEETPWPMYPNQFRTATAHEEGSYVLRGDESVAEIEALGLGTRAVGEPLGERRFAVNTVALHGDDRGRVTGLTGCQIKVVGGRREPVEGTEFPFDADLVLVALGFTGAEQGGLAHELGVGFDTRGRMIRDAGYRSPTNSRVYIAGDNGRGQSLIVWAIAEGRACAAAVDADLMGETALPVAVTPQDMPMAV

SEQ ID NO: 17499 - protein, 318 aa, Corynebacterium efficiens YS-314
MKAIVQTEEKNTASLELQDVPVPTLKPGEVLVEVKAAGVNRADLLQTQGNYPVPPGASEILGLECAGIIADPGDTGRSKGEEVACLLTGGGYAEFVAVPEGQLMPIPEGFSFVEAASIVEVACTVWSNIGMLAGLKEGQTFLVHGGAGGIGTFAVQMGKAMGATVAVTTGSPEKLQTCQQLGADILINYREEDFAEVLKNRADVILDIIGAKYLGQNVKALAKDGHMVTIGLQGGVKGELNLGLLLAKRGTISATALRGRDDADKARIVAATVEAIWPMLADGRITPHIDHTLPLADAAKALKALEDGTVTGKLVLEV

SEQ ID NO: 17500 - protein, 339 aa, Corynebacterium efficiens YS-314
MIITEGVDSFVFPHRSGPRVGLCRIFHVFGAVGFDFFDTVQGVAPRCVEHEGPRGIFPILAPMKTIVITGASDGIGAAAARIISTACPEDRLVLVGRNPGKTEGVAKQLDAEWHTADYADLDQVRRLAGELAALDRIDVLANNAGGIFAGPKKTVDGFELTWQINVVAPYLLTNLLMPVLLESRASVVATSSNGALFAKFDESDPNTFKGFTSDRAYGNAKLGNILFTKELHRRYHSAGMNAVAFHPGIISSNFGQEDAGLLGRMFQSPVSRFFSTPEFGGENLAYHIAGVPGIHWESGRYYDEKRRPGRQRAIAHDLDVARRVFDDMAASLEVEWPEG

SEQ ID NO: 17501 - protein, 432 aa, Corynebacterium efficiens YS-314
MARVGTPTPPQPRSLPSSTTIHTEMPMPTGQLSADVVEHADYLLLDADFTQGERVLRDQVRAFGKEHILPIINDYWERAEFPYEILEPLAGLGLAGTVIKGYGCPGLSRLENGIVSRELGRIDGSICTFFGVHSGLSMGSINILGSEEQRRRWLPDMAKFRKTGAFALTEPNHGSDSVSLETSARREGDSWVLNGHKRWIGNGHAGDIIVVYARDEADQQVKAFVVEKQRNGEYPPGYRAEVITGKTGKRAILQGDIVIDNLRIPEENRLTNCHSFKDVNRVLAATRGGVAWESTGHAMAGFELAAQYALQRHQFGSPIASYQLVQTKLAHMLADVVENQLLCVRMAELQERGEFSTPMASLTKMTTAKNALSICREARDMMGGNGLLLNNHIARHMTDMEVSYTYEGTDSIQALIVGRDITGISAFTHSRK

SEQ ID NO: 17502 - protein, 488 aa, Corynebacterium efficiens YS-314
MVNKIVESVDEAIAGIEDGMVLAVGGFGPAGVPFTLIDGVYHSGTHNLSVYSNNPGGTGDDGSISGLAKLIQGRRIRRFAGSHIGYNKNFEAQYLSGEIELELIPQGSLSERMRAGGAGIPAFYTPTGANSLVAQGGIPIKYDENGNVTVVSSPKETRTFTRNGDTRDYVLEEAITADFSLIHAYKADPEGNLVFRASGQNFNPDAAMCGTVTVVEAEYIVPTGSLKNDEIHLPGIYVDRVLPLTPEQRSFKPFGALPPASGEQVVQPTHPHNQMGWNRDEMAVRAAQELNDGEYVNLGIGLPTRVADFVPAGTRVTLQSENGIMKMGPAPNYYELDPDIINAGKDSVTILPGGSTFGSSASFAMIRGGHIDKAILGSLQVSENGDLANWAIPGKKIRGMGGAMDLVEGAKTVIVLMEHLDPEGAPRVLPECTYPLTGRGVVDRIITNLGVFDVDDEGLVLIETAPGVTLEMIEERTPVHFRMALQTV

SEQ ID NO: 17503 - protein, 380 aa, Corynebacterium efficiens YS-314
MVTASANYRGVTMSFTVPGIIARSKGAPVEKVNVVVPDPGANDVIVDIQACGVCHTDLAYRDGDISDEFPYLLGHEAAGVVSVVGENVTHVEVGDFVVLNWRAVCGECRACKKGEPKYCFNTHNASKKMTLEDGTELSPALGIGAFIEKTLVHEGQCTKVNPDEDPAAAGLLGCGIMAGLGAAVNTADIQLGESVAVFGLGGVGMAAVAGAKLAGASKIIAVDIDERKLEWAREFGATDVINSSGLSGEGEESEVVAKIRELTGGFGTDVTIDAVGIMPTWQQAFYSRDHAGRMVMVGVPNLTSHIDIPAIDFYGRGGSLRPAWYGDCLPERDFPAYVELHLQGRFPLDKFVSERIGLDDVEEAFNTMKAGDVLRSVVEL

SEQ ID NO: 17504 - protein, 362 aa, Corynebacterium efficiens YS-314
MCAWPTLRRATILARMTIPVKALQKTGPDAPFQITTIQRRSPRADDVVIDIKAAGICHSDIHTVRNEWGEANFPLTVGHEIAGVVSAVGSEVTDWKVGDRVGVGCLVDSCGTCEMCQQGFENHCLNGAVGTYNSVDVDGTITQGGYAEKIVVSERFVCRIPDALDFDVAAPLLCAGITTFSPIVQWNVKEGDKVAVMGLGGLGHMGVQIAAAKGAEVTVLSRSLKKAEVAKSLGAVRTLATSDESFFNDYRGEFDFILNTISANINLGAYLGLLKPRGVMAVVGLPPEKQPLSFGSLIGGSKVLTGSNIGGIPETQEMLDFCAEHGLGARIEKISVHEVDEAYDRVVAGDVQFRFVIDTSTF

SEQ ID NO: 17505 - protein, 479 aa, Corynebacterium efficiens YS-314
MLCRTRIVEIVTEHYDVVVLGAGPGGYVSAIRAAQLGKKVAVIEKQYWGGVCLNVGCIPSKALIKNAEIAHIFNHEKKTFGINGEVTFNYEDAHKRSRGVSDKIVGGVHYLMKKNKITEIDGFGTFKDAKTIEVTDGKDAGKTVTFDDCIIATGSVVNSLRGVEFSENVVSYEEQILNPVAPKKMVIVGGGAIGMEFAYVLGNYGVDVTLIEFMDRVLPNEDPEVSKVIAKAYKKMGIKLLPGHATTAVRDNGDSVEVDYQKKGSDKTETITVDRVLISVGFRPRVEGFGLENTGVKLTERGAIDIDEHMRTNVDGIYAIGDVTAKLQLAHVAEAQGIVAAETLAGAETQTLGDYMMMPRATFCNPQVASFGYTEEQAKEKWPDREIKVSSFPFSANGKAVGLAETDGFAKIVADAEFGELLGGHIVGANASELLNELVLAQNWDLTTEEISRSVHIHPTLSEAVKEAAHGVNGHMINF

SEQ ID NO: 17506 - protein, 250 aa, Corynebacterium efficiens YS-314
MVMTNGKLILLRHGQSAWNASNQFTGWVDVDLTTIGEAEAKRGGELLVENNVLPDVVYTSLLRRAIRTANLALDAADRHWIPVVRDWRLNERHYGALQGLNKAETKDKYGDEQYMAWRRSYGTPPPELADDAEYSQAGDVRYKDLESVPRTECLKDVVERFIPYFEEEILPRVKKGENVLIAAHGNSLRALVKHLDNISDDDIAELNIPTGIPLVYEITPEGTVVNPGGTYLDPEAAAAGAAAVANQGGK

SEQ ID NO: 17507 - protein, 442 aa, Corynebacterium efficiens YS-314
MVDMSASPSGTSANVSRSIEWFEKAKMFTPGGVNSPVRAFGSVGGQARFIDRAHGSTLIDVDGNEYVDLVCSWGPMLMGHAHPAVLEAVQKTIVDGLSFGAPTIGEVELAQDIINRTSVEEVRLVNSGTEATMSAVRLARGYTQRPKILKFDGCYHGHVDSLLASAGSGVATFALPDSPGITGAQTRDTIVVPYNDIEAVRAAFAEFPGQIACIISEAAAGNMGTVAPQDHFNEHLLAIAHADGALLILDEVMTGFRTSYRGWFGVDKVRADLVTFGKVVSGGLPAAAFGGRAEIMNMLAPQGPVYQAGTLSGNPVAVAAGRASLSAATEEVYRTIDANADRLHGLISDALTREGVAHHIQRASNMLSIRFAEGEGHNFTDMKNADTFRFAPFFHALLDHGVYAPPSVFETWFVSSALTDDDFQKIDDALVPAARAAAAATA

SEQ ID NO: 17508 - protein, 502 aa, Corynebacterium efficiens YS-314
MTAVIPAALQRREQLNLPYTHVDDFYINGAWVTATGEKRNPVVDPATGQEWGSVPEAGQVELDHAVGAAREALPGWGSLTAADRAEYLVRIAEEIEKRAEVLALTNTRENGSPISETRGAAANAAGIFRYFATLAPFLDDPDIRPFPAGGAESLVDKDPIGVCALIAPWNFPINLVVIKLAPALLAGCSVVIKPASPTPLSIRFIIEAVEAAGVPAGVINLLTGSGRFGDAMVRHPGVNKVAFTGSTPVGRKIASACGELLRPVTLELGGKSSAIVLPDADMSVLSARLIRSCMRNTGQTCYISTRIIAPASRYEEVVQVVADTIAAGRQGDPLDEDTIFGPVATASQYATVMEYIESGHAEGARAVTGGAATAGLTGGLENGVFIEPTVFADVTPDMRIAAEEIFGPVISILRYDDSAGVEEAIAIANNTEFGLGGLVFGADEDRALDVARRVDSGSVGINFFGSNHSAPFGGRHDSGMGVEYGIEGLSAYLSYKSIHRMV

SEQ ID NO: 17509 - protein, 424 aa, Corynebacterium efficiens YS-314
MSTDATTTGLLIVGANQAGVQLAVSLRATGFTDHITLLGEEDHRPYQRPALSKEFLQGKIDKERLIFRSNEYWEDNNISLVKGVRIERIDKNDDGSGVAVGRDGSTYAFRRLALAVGARPRRLDLPGSDLRGVTYLRNADDALELKALVGDVRDAVVIGGGFIGLEAACSLQELGKNVTVLEHGPRLVGRAVGEETAGFFLEQHRARGIDIRLNARLSGFVGEGGAVTGVELDDATIIPAQLVIVGIGVIPNTELAEQMGLEVDNGIVVDEHAVASDGTTIAIGDVANIPNPIPGSPAGERIRLESVNNAIEHAKIAAYSLAGTPEAYSGIPWFWSNQGDLKLQIAGLTLGYDQTLIRRDDAKKKFSVLYYRDGQIIAADCVNSPLDFMAVRGALSKRQNIPFDAAGDINTPLKKLAVDLEVAS

SEQ ID NO: 17510 - protein, 181 aa, Corynebacterium efficiens YS-314 [sequence omitted]

SEQ ID NO: 17511 - protein, 513 aa, Corynebacterium efficiens YS-314
MRRNCRKMTTQSRVSTGGDDPNKVALVGLTFDDVLLLPDASDIVPSDVDTSTQVTRNIRLSTPIISAAMDTVTEARMAIAMARQGGLGVLHRNLSIEEQAENVELVKRSESGMVTDPVTCTPDMTIEEVDNLCARFRISGLPVVDKDGTLLGICTNRDMRFESDPNRLVTDVMTPMPLIVAEEGVAKEDALQLLSTHKVEKLPIVDKNNKLVGLITVKDFVKTEQFPNSSKDASGRLLVAAGIGTGDESYQRAGSLVDAGVDILVVDSAHAHSRGVLEMVSRVKKDFPGVEIIGGNLATREAAKAMIEAGADAIKVGIGPGSICTTRVVAGVGAPQITAIMEAAVPAREAGIPIIADGGMQFSGDIAKALAAGASSVMLGSMLAGTAEAPGDTITINGKQYKRYRGMGSMGAMQGRGLSGEKRSYSKDRYFQADVRSEEKLVPEGIEGRVPFRGSIENIIHQQVGGLRAAMGYTGSATIADLQRARFVQITSAGLKESHPHHIQQTVEAPNYH

SEQ ID NO: 17512 - protein, 449 aa, Corynebacterium efficiens YS-314
MDIRKTIDTTPMSGFQWYIVGLATFLNALDGYDVLAMAFTANAVSEEFGLNGSQLGLLLSAGLVGMALGSLILGPFADKLGRRRILIVSLLINLAGLALSATAGSSTELAIWRVVTGIGIGGILATVTVITSEYSNNKNRGMAVSIYTAGYGLGATLGGLLAARLIPEFGWRSVFLAGAAATLVSVILVVVSIPESVDYLRVKRPAGAEEKALQIARRIGKPDTIGLGTVNPADSAQAKLSDLLSGPFKVTTLKLWAAFFFIMFGFYFANSWTPKLLVESGMTENQGIIGGLALTLGGTFGSLIYGVITTRFNSRHTLMVFTVLSALTLVVFITTTSIPMLAFGSGVLVGMLINGCVAGLYTVTPASYPSALRTTGVGWGIGVGRFGAIFAPITVGALLDAGWTPPYLYGAVAVVVVLAAVALIGIRPYLGTEQKIAVTPAQNEAVPTP

SEQ ID NO: 17513 - protein, 475 aa, Corynebacterium efficiens YS-314
MEVPFMAKRIVIIGGGPAGYEAALAGAKYGADVTLIEDFGIGGAAVTLDCVPSKSFIAGTGIKTDLRRADDMGLNRGLGKAHLEIDALNKRVKALANHQSGDIAGQLKRAGVRMIDGYGRFDDYNTKQTTHYVQVTHNGTGETESLECDLVLIATGATPRILKGAEPDGERILTWRQVYDIDELPTHLIVVGSGVTGAEFVSAFAELGVKVTMVASRDRILPHDDADAADVLETVLAERGVSLEKHARVDSVTRTPDGGVCVRTADGREIYGSHALMTVGSIPNTQNLGLENIGVELAPSGHIKVDRVSRTSVAGVYAAGDCTDLFPLASVAAMQGRIAMYHALGEGVSPIRLKTVATAVFTRPEIAAVGVTHAQVDAGEVTARTVVLPLVTNPRAKMRSLRHGFVKLFCRRNSGLIVGGVVVAPTASELILPIAVAVTNRLTVADLAETFAVYPSLSGSITEAARQLVQHDDLG

SEQ ID NO: 17514 - protein, 410 aa, Corynebacterium efficiens YS-314
MSAPTLSPATVPPVTEHPDFLLLDSDLSAEDIALRDRIRAFGQEHILPIINEYWERAEFPMEVLEPLADLGIVGTFIQGYGCPGLSRQAAGIVARELGRIDGSVNTFFGVHSNLGMGAIYTLGNEEQRQRWLPDMAKLKKIGAFALTEPNHGSDSVALETSARREGDHWVLNGHKRWIGNGHAADVIVVFARDEADGNVKAFVVEKNEDGTYPEGYQPEVITGKVGKRAILQGDIVIDNLRVPVENRLENCESFAGVNRVLSATRGGASWEAVGHGMAAFELASQYALSREQFGAPIAGYQLVQEKLATMLSDVTQMQLLCTRMAQLQERGEFTGSMAAMIKMVTSRKALAACREARDMFGGNGLLLENHIARHLTDMEVVSTYEGTDSIQALLVGREITGISAFTTKKR

SEQ ID NO: 17515 - protein, 420 aa, Corynebacterium efficiens YS-314
MTTHLADQTAKPTTTTPKHVTDLMNIEGLLTPGEIEVRDRIAAFVDRRIRPNIAEWYDNAVLPRELLPEMAAEGLFGMHIEGYGCGGRTATEYGIAMQELEAGDSGLRTVVSVQGSLAMTAIAKHGSEEQKQTWLPGMAKGEIIGCFGLTEPTAGSDPASMGTRATWENGEWVLNGEKRWIGLANIADVAIIWAKVSDEDARAAGVLAGPGSDNGEKVRGFIVPTGTDGFHAEAITQKLSMRASIQCEIHMDNVRLDGDAILPKNPGLKGPFMCLNEARFGIAWGALGAARDSIEAAIEYSSTRMQFDRPLSSFQLTQKKLADMTVELNKGQLLALQLGRAHDAGTLENHQISVGKLANCRTAIEICREARTILGGNGISLDYSPLRHANNLESVRTYEGTDEVHTLIIGQKLTGESAFR

SEQ ID NO: 17516 - protein, 387 aa, Corynebacterium efficiens YS-314
MRNKYVVERLRPFGETIFATMTQRANEAGAINLGQGFPDEDGPAPMLEIASQQILGGNNQYSGGRGDLGLRTAVASDRHKRFKLDYDPDTEVLITVGATEAISASVLGLVEPGDEVIVLEPYYDAYAAAIALAGATRVAVPLKEEDNTWVLDTDAVHAAVTKKTSMIIVNSPHNPTGSVFSKRSLEALAGIARAYDLLVLSDEVYEHLTFDKVSHTAVASLPGMWDRTITVSSAAKTFNVTGWKTGWALAPAPILEAVIRAKQFMSYVGATPFQPAVAHAVAHEKPWVKQMRKGLQNKRDILTDALTQAGLKVHDSHGTYFVVADIGERDGAEFCFDLIDRVGVAAIPVQAFVDKPEQWSSKVRFAFCKQEDTLREAAQRLRAAGSL

SEQ ID NO: 17517 - protein, 121 aa, Corynebacterium efficiens YS-314
MNLMEKPQIEAQTGPVPEDLVIKDLIVGDGAEAQPGGVVEVHYVGVDFETGEEFDSSWDRGQTNQFPLTGLIAGWQEGIPGMKVGGRRQLTIPPEAAYGPEGSGHPLSGRTLVFIIDLISA

SEQ ID NO: 17518 - protein, 193 aa, Corynebacterium efficiens YS-314
MGVADSMVRETRTGVLKWFYAGVMTDTHGTFIPTADLVDIIGDDVRSCDTQFRNLGGRTDFHGTITTVKCFQDNALLKSILGEDNPGGVLVIDGDASLHTALVGDIIAGLGRDHGWSGVVVNGAIRDSAVIGEMEFGCKALGTNPRKSSKTGAGERDVVVSFGGVDFTPGHYLYADSDGIVVTENPVKAPASN

SEQ ID NO: 17519 - protein, 425 aa, Corynebacterium efficiens YS-314 [sequence omitted]

SEQ ID NO: 17520 - protein, 366 aa, Corynebacterium efficiens YS-314
MGTHDTDHPLYSSVTLGNVELNNRIVMAPLTRIRANTDGTPTEMMREYYAQRADFGMIITEGTWPIREGRTWGQQPGIETAEHVTAWRGITDAVHERGGKIIMQIMHGGRISHPELTGTGRTVAPSAIAAPDPIRISTGKVDPVIPHELGLDELATVIDQFVAGARNAMAAGMDGVQIHGANGYLLHEFLAPTTNLRGDAYGASPEKRASFVAEVVTAVAREIGAGNTGLRLSPQHNIQGAIETDDADVLATYTALARSLKHLGLAHVELVHHEPEGELIQTLRREFGAPLIVNTGFSRFTQREVAEELVDKQAADAVSVGRLALANPDLVRRWQLDGPLNEPNPETFYVGGEKGYTDYPVMEYSL

SEQ ID NO: 17521 - protein, 370 aa, Corynebacterium efficiens YS-314
MTRTPRTPLATILPDFPWDSLATAKARAGEHPDGIVNLSVGTPVDPVAPGIQIALSEAAGFSGYPQTIGTPELRSAIRAALERRYGMTGLVDASVIPVVGTKEAIALLPFMLGLAGHTVVIPEIAYPTYEVSAVAAGARVLRSDSLLKLGPEVPSMMFLNSPSNPTGKVLGVEHLRKVVGWARDNDVIIAADECYLGLGWDDDNEPLSILDPRVCDGDHTNLLAIHSLSKTSNMASYRAGYIVGDTALVGELTEARKNLGLMVPYAIQQAMIAALNDDEQEAGQKLIYARRRATLMKALLGAGFRIDDSEAGLYLWATRDEPCRDTVDWFAERGILVAPGDFYGPRGTHHVRVAMTETDERINAAAARLA

SEQ ID NO: 17522 - protein, 486 aa, Corynebacterium efficiens YS-314
MAMSEVPAAAQPGAAPGSSETTSDPNRRQELGTGLRTRHLTMMGLGSAIGAGLFLGTGVGIRAAGPAVLLAYIAAGVIVVLVMQMLGEMAAARPHSGSFSKYAEDAFGHWAGFSLGWLYWFMLIMVMGAEMTGAAAIMGAWFGVDPWIPALVCVVFFAIVNLAAVRGFGEFEYWFAFIKVAVIVVFLIVGVGLIFGLLPGSTFVGTSNFIGDHGFMPNGLSGVAAGLLAVAFAFGGIEIVTIAAAESDQPRRAISLAVRAVIWRISLFYLGSVLVITFLMPYESIDNAETAAESPFTRILDMANIPGAVGLMEAVIVLALLSAFNAQIYATSRLVFAMSRNQDAPRVFSVLSRSGVPTAAVLLSMFFAFVSVALQYFNPAGLLDFLLNAVGGCLLVVWAMIALSQLRLRPKLEHNGEISTVRMWGHPWLGILTLVLLAGLVLLMLGNEGSRSQVFSVAVVYGFLVALSFTTTRSPLRGKRTGLIDR

SEQ ID NO: 17523 - protein, 476 aa, Corynebacterium efficiens YS-314
MKGVVGKASMSKKRVAIIGAGPSGMAQLRAFESAEKKGQEIPELVCFEKQDDWGGQWNYSWRTGTDHYGEPVHSSMYRNLWSNGPKEILEFAEYTFDEHFGKPISSYPPREVLWDYINGRAEQSDVKKYVKFAHAVRWVDFDEGTKLFTVRVENLRTGETTSDTYDNVIVAAGHFNFPNIPHFEGIETFPGQVMHAHEFRGAETLADKDILLIGASYSAEDIGSQAYKMGARSITYSYRTKPMGHGWPEEMEELPLVERFEGSTAHFKNGEKRDFDAVILCTGYKHHYPFLPSSLALESPNNIYPDTLYRGVVSEKNNQLFWLGSQDQWLTFNMFDAQAWYARDVILGRIELPTAEEQRAHMDQWLERFNAMEDEFDQIDFQCDYVKDLIEQTDYPMFDLDEVAKIQRQWLQSKKDDIMNFRDATYTSVITGTKAAEHHTPWMLELDDSLERYLSEPDEDEARQVFRGQIREGQAR

SEQ ID NO: 17524 - protein, 465 aa, Corynebacterium efficiens YS-314
MNASPTVTDQLVQTRKFKGLRARHIHFIALGSAIGTGLFYGSAGAIQAAGPSVLLVYLLGGAVVYFMLRALGEMSVRHPVRGSFAVYTRAHLGGWAGYITGWMFAFEMLIVCLADLTAIGIYMKFWFPDTAQWVWVAATLLIVGGANLASVRWFGELEFVFTLIKVTAVIAMIVGGAAILAFGLGNSPEVSGISNLWEHGGFFPNGIEGMIAAFILVLFAFGGTEIIGVAGSEAEDPEKSIPKAVNTVPARILLFYVGAILVILALNPWQTITGEESPFVQIFSTLGVNWAAGLLNLVVITAALSAINADLFGAGRVLTGLAKENLAPKIMGRVAGNGVPIMTTVIMIIVLILGVVLNVILPERVFEIVASLATFATVYVWLMILLAQVASRRQMSAQEVAGLKFPVPFYPFGQYFAILFIAFTFGIMVWYDNYHLALGVGVGFLVVMTILYYATGRPKAIAPAQ

SEQ ID NO: 17525 - protein, 433 aa, Corynebacterium efficiens YS-314
MTNARDHHTPLTTDPPVATSPTRETPGAYRVLTMATLGFTLMFAAWMMFGVLGIPIQEEFGLTDVQLSLISSVAILNGSLWRLPAGIIADRLGGRIVMTVLLVASAVFSYMVSLADSYSMLLGLAFAVGLAGNSFSVGNTWVAAWFSKRRNGLAMGVFGAGNVGASVTKFIGPVIIAATAGSLYFGGLVEGGWRLVPVIYAVALLATAVMLWFITPAQDKKPGQGRKLSEMLAPLKQGRVWRFSLYYVAVFGAYVALSSWMPKYYIDMYGVSTSTAALLTALFIFPASLMRPVGGSLSDRFGARQTTIFALLIMLTASGILALPLTINIVLFTLLLFTLGVGMGIGKASVFKYIPDYFPGNVGSVGGLVGMFGGLGGAFLPPLFAGVKTATGLEQATFLVIFVLVAFCLAWLLRAISLMKRTSPDPLWRRFGI

SEQ ID NO: 17526 - protein, 343 aa, Corynebacterium efficiens YS-314
MAEAPTVVHPVPPHVTSIMRKLACMNGTTGLKAPGLTIADTIGNTPLVRLDRLTRDRDFTLWAKLEYFNPGGSAKDRTAQAMVTAGTLKPGDMVVESSSGNLGIALAREAVLGDWTFHCVVDPRANRSTVKHMQALGAVVHQITEPDEETGDWLVARRKRVAQLLQEIPEAICLDQYSNTEAFRAHQEGTMAEIVQQLGHAPDHLLVAVSTTGTIGGCLRHIEAHHLPTQVTAVDAMGSVLFDGNPGPRHLPGFGAGMVPELSRQITPHRVLRVADRESVEGARTLVRKETILPGASGGAVIAAVDKLKDVFESGSDVVVILHDSGTRYMDTIYNDDWVEETL

SEQ ID NO: 17527 - protein, 254 aa, Corynebacterium efficiens YS-314
MTPLMIDAQQVCKNFGRLEVLKGIDLQVPKGSVTCLIGPSGSGKSTMLRCVNHLEKVNAGRLYVDGDLIGYRERDGVLYEISEKDAARQRADIGMVFQQFNLFPHRTVIDNIIEAPIHVKRQPEKAARARAMELLEQVGLAHKADAYPVQLSGGQQQRVAIARAVAMDPKLMLFDEPTSALDPELVGEVLRVMRQLADDGMTMLVVTHEMGFAREVADQVVFMADGVVVEAGTPAQVLDNPQQTRTQEFLSSLL

SEQ ID NO: 17528 - protein, 446 aa, Corynebacterium efficiens YS-314
MFMGAGKTISLAGPSVILVYAIIGFMLFFVMRAMGELLLSNLNYKSLRDAVSDILGPGAGFVTGWTYWFCWIVTGMADLVAITGYVQYWWSGVPLWLPGAGAILLLFVLNLAAVRLFGEMEFWFAIIKILAIVALIFTGLVMVVSHFESPDGSVAQFSNLVDHGGFFPNGITGFLAGFQIAIFAFVGIELAGTAAAETEDPVRTLPRAINSIPVRIVVFYVLSLAVIMMVIPWDRVHTDSSPFVQMFALAGLPAAAGIINFVVLTSAASSANSGIFSTSRMLFGLSLEGAAPRRWAKLSANQVPARGLLFSIVCLIPGVAVMYAGSSIIEAFTLITTVSSVLFMVVWAYILVAYIVYRRRNPQLHAASVFKMPGGVAMAVVVLVFFVGMVGVLTLENDTRSALLATPVWFLILGAGWWFSGGARGAASRSQLTGPTTPVTPATTAS

SEQ ID NO: 17529 - protein, 402 aa, Corynebacterium efficiens YS-314
MKNLATVEDTLTSWPQVLLNTYGTPPVELVTGKGSTVTDADGNVYIDLLAGIAVNALGHAHPAIIEAVTTQLSQLGHVSNLFATRPVVEVAAELVQRFALDDATIASQTQVFFCNSGAEANEAAFKLARLTGRHRILAATNGFHGRTMGSLALTGQPDKRIPFAPLPSGVEFYPYGDLDYLTTLVESDPTDTAAIILEPIQGETGVIPAPEGFLTGVRELCDKHGLLFIVDEVQTGIGRTGDFFAHQHEGVTPDVVTMAKGLGGGLPIGACLATGEAAKLFGPGKHGTTFGGNPVSAAAARAVLSVIDEEFCADVARKGELFAEQLRGVAGVADVRGRGLMLGVVLDQPVAKQAVTAGFKHGLILNAPADNIIRLTPPLVITDDEIRDAVRALAAVLAELNA

SEQ ID NO: 17530 - protein, 490 aa, Corynebacterium efficiens YS-314
MRMIITMTNPDSLAQIGVVGLAVMGSNLARNFARNGHTVAVYNRSTDKTDKLISDYATDGNFIPTKTVEDFVAALEKPRRAIVMVQAGAATDAVINQLADAMEEGDIIIDGGNALYTDTVCREKEMAARGRHFVGAGISGGEEGALNGPSIMPGGPKESWEALGPLLESIAAKVDGVPCVTHIGPDGAGHFVKMVHNGIEYADMQVIGEAYQLLRFGAGMEPAEIADVFAEWNKGDLDSYLIEITAEVLRQVDAETGKPLVDVILDAAGQKGTGRWTVKEALDLGVPVTGIGEAVFARALSSSLDQRKAAQGNLPTGALTTFEELGLDKAEFVEDVRRALYASKLVAYSQGFDEIKAGSDEHNWGVDPRDLATIWRGGCIIRAKFLNRIVEAYDNDPELPSLLLDPYFKGELEDLMDSWRRIVIYVTQLGLPAPVFTSSLAYYDSLRAERLPAAIIQGQRDFFGAHTYHRIDKPGSFHTLWSGDRSELEV

SEQ ID NO: 17531 - protein, 262 aa, Corynebacterium efficiens YS-314
MSPMARKPLIAGNWKMNLDHQQAIGTVQKLAFALHKDYYEKVDVAVIVPFTDLRSVQTLVEGDKLQITYGAQDVSQHESGAYTGEVSASMLAKLNCSWVVVGHSERREYHNETDELVAAKAKAALSKGISPIVCVGEPLEIREAGTHVDYVVEQTRASLAGLSADELANTVIAYEPVWAIGTGKVASAADAQEVCKAIRGLVTELAGEEVAEGMRILYGGSVKAETIAEIVSQPDVDGGLVGGASLDGEAFAKLAANAANAV

SEQ ID NO: 17532 - protein, 405 aa, Corynebacterium efficiens YS-314
MAVKTLKDLLDEGVDGRHVIVRSDFNVPLNDDREITDKGRIIASLPTLKALTEAGAKVIVMSHLGRPKGEVNEKYSLAPVAEALSDELGQYVALAADVVGEDAHERANGLTEGDILLLENVRFDPRETSKDEAERGAFADELAALAADNGAFVSDGFGVVHRAQTSVYDIAKRLPHYAGRLVENEISVLEKIAENPEAPYTVVLGGSKVSDKLGVIEALASKADSIIIGGGMCYTFLKAQGHDVQKSMLQDEMIDTCKDLLERFGDKIVLPVDLTWASEFAKDAEKKVTDLDSAPEGWLSLDIGPKSVEKFADVLGASKTIFWNGPMGVFEFEAFSDGTRGVAQAIIDATANNGAFSVVGGGDSAASVRVLGLDEEGFSHISTGGGASLEFLEGKELPGVAILKD

SEQ ID NO: 17533 - protein, 221 aa, Corynebacterium efficiens YS-314
MAQQRKPIIAPSILAADYARLGEEIAAVPDADWIHVDIMDGHFVPNLSFGYDVTRAVHRVTDKPLDVHLMIENPEKWVDHYIDAGAACVIFHVEATDKHVELAQHIRSKGVRAGFSLRPGTPIEDYLDDLEHFDEVIVMSVEPGFGGQSFMPDQLDKVRTLRRVIDERGLDIIIEIDGGISATTIEQAAEAGVDAYVAGSAVFGADEPNAAVQELRALASK

SEQ ID NO: 17534 - protein, 269 aa, Corynebacterium efficiens YS-314
MDSITGFTPHDPTFLYAIPMTQTTNHPMIKMTGVQKFFDDFQALTDINLEVPAGQVVVVLGPSGSGKSTLCRTINRLETIEEGTIEIDGKLLPEEGKDLAKIRADVGMVFQSFNLFPHLTIKDNVTLGPMKVRKMKKSEANEVAMKLLERVGIANQAEKYPAQLSGGQQQRVAIARALAMNPKIMLFDEPTSALDPEMVNEVLDVMASLAKEGMTMVCVTHEMGFARRAADRVLFMSDGAIVEDSDPETFFTNPQTDRAKDFLGKILAH

SEQ ID NO: 17535 - protein, 288 aa, Corynebacterium efficiens YS-314
MLAGHGSGFTVMAGCRGARRGVWAIRLDWWGSTTQREGVFMAIKVGVLGAKGRVGQTIVAAVNDTDDLELVAEVDHDDDLSLLVDSGAEVVVDFTTPNAVMGNLEFCINNGISAVVGTTGFDEDRLAQVRSWCASNEGVGVLIAPNFAISAVLTMVFARQAARFFESAEVIELHHPNKLDAPSGTAIHTAQGIAEARREAGMAAQPDATEQALDGSRGADVDGIPVHAVRMSGMVAHEAVIFGTQGQTLTIKQDSYDRNSFAPGVLVGIRNIAQHPGLTVGLEHYLDL

SEQ ID NO: 17536 - protein, 461 aa, Corynebacterium efficiens YS-314
MTETKHYDLIIIGTGSGNSIPGPEFEDKSIAIVEKGTFGGTCLNVGCIPTKMFVYTADIAREISDSSKYGIDATYNSVDWPSIVDRVFTRRIDLIAEGGEAYRRGPETPNIDVYDMHARFIGEKTIATGQAGEEKVISGDQIVIATGSRPFIPPVIKESGARYHTNEDIMRLPTLPSSLVIVGGGFIALEFAHVFSSLGTKVTLINRSEVLLRDADADISARIAKITRERVDVRMSTSVTGVTDNADGSVTVSLDSEDPITADVLLVATGRTPNGDQMDLDTAGIEMDGRRIKVDEYGRTTAPGVWALGDVSSPFKLKHVANAEMRAVRHNLLHPDALQTMPHDHVPSAVFTNPQIAQVGMTEAEARAAGHNLTIKVQNYGDVAYGWAMEDTTGFVKLIADRDSGRLLGAHLIGPQASTLIQQLITVMAFDLDVREVATRQYWIHPALPEVIENALLGLEF

SEQ ID NO: 17537 - protein, 487 aa, Corynebacterium efficiens YS-314
MSPPHPQRVRLVDVERRTKIVCTLGPAVASADGILRLVQDGMDVARLNFSHGDHPDHEQNYKWVREATDKTGRAVGILADLQGPKIRLGRFKEGSTVWETGETVRITVDDVEGTHDRVSTTYKNLAKDARPGDRLLVDDGKVGLVCVSVEGNDVICEVTEGGPVSNNKGVSLPGMDISVPALSEKDIKDLRFALKLGVDFIALSFVRSPADVELVHAIMDEEGRRVPVIAKLEKPEAVAALESIVLAFDAIMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRLARLHSHLPLLVFTPDPSVRSQLALTWGAQTFLCPKVDDTDGMMREVDRALLAMDEYQKDDMMVVVAGSPPGVTGNTNMIHVHLLGEDTRIPK

SEQ ID NO: 17538 - protein, 129 aa, Corynebacterium efficiens YS-314
MSHDPTPISDNPAEFTLDPVIAARLKLNDAGLIPAVVQAVDTREVLMMAWMDTHALAYTLATRRGTYYSRSRDEYWIKGLTSGNVQEVTDVALDCDGDTVLVTVHQTGGACHTGARTCFDADPLLGPGQ

SEQ ID NO: 17539 - protein, 477 aa, Corynebacterium efficiens YS-314
MAFNTPEEVTKFIKDENVEFVDVRFTDLPGIEQHFSIPASALDEDAIEEGLAFDGSSIRGFTTIDESDMNLLPDLATAKIDPFRKAKTLNIKFFVHDPFTREAFSRDPRNVARKAEQFLASTGIADTCNFGAEAEFYLFDSVRYSTDINSGFYHVDTNEGWWNRGRETNLDGTPNTGSKNRLKGGYFPVAPYDQTVDVRDEMVRNLRDAGFHLERFHHEVGGGQQEINYRFNTLLHAADDIQTFKYIVKNTAALHGKAATFMPKPLAGDNGSGMHAHQSLWKDGKPLFHDESGYAGLSDIARYYIGGILHHAGAVLAFTNPTLNSYHRLVPGFEAPINLVYSQRNRSAAVRIPITGSNPKAKRIEFRAPDPSGNPYLGFAAMMMAGLDGVKNRIEPHAPVDKDLYELPPEEAASIPQAPTSLEASLKALQEDSDFLTESDVFTEDLIEAYIQYKYDNEITPVRLRPTPQEFELYFDC

SEQ ID NO: 17540 - protein, 481 aa, Corynebacterium efficiens YS-314
MASSPTTNPDEILKFIRDNDINWVDVQFTDVPGTEQHLSVPAAAFDESAMENGLAFDGSSISGYTTVDDSDMMLLPDLSTAFIDPFRRSKTLNIKFFVHDPYTREPFSRDPRNIARKAEEYLASTGFADSCNFGAEAEFYIFDSVRFSSQSNAAFHEVDSVEGWWNSGSRENPDGSRNLGHKVRQKGGYFPVAPYDHFQDLRDTIGETLAEIGFTVERSHHEMGSGGQQEINYRFNTLLRAADDLQTFKYVVKNTAKAVGKSATFMPKPLADDGGSGMHIHQSLWKDGKPLFHDEAGYANLSEMARHYVGGLLKHAPAVLAFTNPTLNSYNRLVPGFEAPVSLAYSQQNRSAAIRIPASGPNPKATRIEFRTPDPSGNPYLAFTASMMAGLDGIRNRIEPDAPLDKDLYELPPEEAAKVAEAPTSLEQALKALEEDHEFLTEGDVFTDDLIEAYVAYKHEHEITPERLRPTALDFELYYDC

SEQ ID NO: 17541 - protein, 378 aa, Corynebacterium efficiens YS-314
MARDYYGILGVDRNATDSEIKKAYRKLARKYHPDVNPSEEAAEKFREASVAHEVLTDPDKRRIVDMGGDPMEQGGGAGHPGGFGSGGLGDIFDAFFGGGAGSRGPRSRVQPGSDTLWRTSITLEEAFTGVKKDLTLDTAVLCSKCHGSGSASNAKPKTCGTCHGSGEIQEVQRSFLGNVMTSRPCHTCNGTGEVIPDPCDECAGDGRVRARRDIVADIPAGIQSGMRIRMAGQGEVGAGGGPAGDLYVEVMVRPHAVFTRDGDDLHASIRVPMIDAALGSELEVESLTGEEITVVIPAGTQPNQVITLEGEGMPRLRAEGRGDLMAHVDLFVPTEIDDRTRELLEQIRDYRRDNSSVHREGEEHGGLFDKLKSKFRNR

SEQ ID NO: 17542 - protein, 345 aa, Corynebacterium efficiens YS-314
MVSMTHVPSGHISPAPVPPVPDPSGEEKENRSAALIVVAFPAFILIGAIVAFMFPATFAPLTNYINLFLTIIMFTMGLTLTVPDFQMVLKRPLPVFIGVVAQFVIMPGLAVLVAKMMGLNPALAVGLLMLGSVPGGTSSNVIAFLCRGDVALSVTMTSVSTMVSPIMTPILMLLLSGTATEVDGAGMAWSLVQTVLLPVVIGLTLRVFLSRWINRIMPVLPWLSILGIGGVVFGAVANNAERLLSVGLIVFAAVIVHNVLGYVLGYYTGRLFRFSEPVNRTMAVEIGTQSAGLASGMAGRFFSPEAALPGAVAAVVHNITGAIYTAIVRNRPVEPVAVPEKVAVG

SEQ ID NO: 17543 - protein, 282 aa, Corynebacterium efficiens YS-314
MTARNPGRFGSFDQLLFVRSANSCALDEHYDSMDRMIDKTFSSTAEAVADIPDGASIAVGGFGLVGIPTLLINALREQGAGELTIISNNCGTDGQGLGLLLEDGRIVKTIGSYIGSNKEYARRYLEGELTVEFTPQGTLAERMRAGGAGIPAFYTTAGVGTQVAEGGLPQRYNKDGSVEIYSKPKETREFNGQLYVMEEGIRADFALVHAHKADRFGNLVFRKTARNFNPDAAMSGKITIAQVEHLVDDLDPDEVHLPGIYVNRVVHVGPQETGIENRTVSN

SEQ ID NO: 17544 - protein, 470 aa, Corynebacterium efficiens YS-314
MATSSPDVWQSPRHRRTVYSVLAIVGISILFDGYDLVIYGAVLSTLLNDPSHIGALSPAVAGTLGSYALIGVMIGALTAGAICDWVGRRKVMLTAIIWFSVGMALTAMATSITMFGFLRFLTGLGVGMIVATGGAIIAEFAPRNRRNLFNAIVYSGVPAGGVMASVFALLFEDYLGWRGLFFIGATPLLFLFPLALFALPESPRWLASRGRRAEAIALCERKGLPIADFVPSTPAPVASESVAVTAPAATERTGFAGIFSRAYLPGTLLIGAMSFIGLLSTYGLNTWLPKIMESNGASAHDSLYSLLFLNGGAVIGGLIASWFADRIGAKTIITSTFFLAALCLGALPFISAWPLMYTAIALAGIGVLGTQVLTYGLTSNYFGTACRAAGVAWCAGFGRLGGIVGPAVGGLIIGMGLGPTVAFFIFAGAAILGAICTALIPRSPAEVTISTLPSASREPVAPRRTPQPQS

SEQ ID NO: 17545 - protein, 469 aa, Corynebacterium efficiens YS-314
MIAMSAAPTGYTNFNGDFIEFGSPEALAEEARTTALDRDHVFHSWSAQDKITPKAWATADGAILYDYEGRAFIDMGSQLVSANLGHNHPALVEAIRTQAGRITNLNPAFANDIRSELAGQIIACAQGEFSHVFFTNGGADAIEHAIRMARLHTGRNKILSAYRSYHGATGSAMMLTGEHRRLGNPTTDGDIYHFWAPFLYRSSFFAENEEQECERALTHLAETIAFEGPGMIAAIVIEPVVGSSGIIVPPAGYLAGVRELCDQHGILLIADEVMVGLGRTGKFFAYEHAGADVEPDMITFAKGINAGYAPLGGVVMTRAIRDTFDAQAYSGGLTYSGHPLAVAPALAALKVYEDEKIFERVASLGENLIGPRLAEIGQKYAAVGDVRGIGFFWALEFVSDAQAKTPAGADAMAAGAAALKEHGVWPMVSGHRFHIAPPLITTETQLEQLLEAIDVAAAAVDAEIFALAR

SEQ ID NO: 17546 - protein, 423 aa, Corynebacterium efficiens YS-314
MTTHPLTMPIPEYFEEILESVRSDVSGEVAQYIPQLKDADPNPLALAMCTVDGHIYGAGDDEHEFTMQSVSKPFAYALALQEQGPEKVFATVGLEPSGEAFNELSLDGSTNRPMNPMINAGAIAVNQLINGSESSVEDRVEKIRSYFSALAGRELNIDRQLSETEIEGADRNLSIAHMLRNYGIIEDDAHDAVLSYTLQCSVKVTARDLAVMTATLAAGGTQPLTGEKLVDARVARLVLSTMASAGMYDEAGQWLATVGIPAKSGVSGGLVGVLPGQLGLATFSPRLNSQGNPVRGVEIFKALSEDMGLHLMSAELLTQHAVRAIEERGDTTVIQLQGAMNFSAAENFLFTVTDHDFTGEKVVLDISRVPMFRPMGRRLVKEGLRRIRDNGFKVAIYDPEDILPDFDFSDGTKSPQVDDPEEL

SEQ ID NO: 17547 - protein, 488 aa, Corynebacterium efficiens YS-314
MIAGSATARVVSLSIITKAVNTRTARMSTTGLGMTVLSGLVLVEVMVDRGSFHVTGGWDLSRLMRPGDPISVPTIPFRSQPGHKAGPTVDIPALLPVPRKTVAIRDSQAHNYRMEHSRPTGPMGSTEPTPQSTDTSSPAPEDPADPPEAPDQPTHSPSWLLALGALGVVFGDIGTSPLYALHTAFSMEHNAVTIAPDNVYGLAVTGNLLLVTVLFSLFAARVWHWAAWRISLFAVIMGSVEIWLFSASATKLFDGGWLPLLIALILMVVMTTWESGSRHVARTRRALEGPLHQFMASLPHRQIRRVPGVAVFPHASAGTTPLALVKFVTDFHILPGHVVIVRIIHENVPHIQPGDRITVDEVGSASDGIVHVGIRVGFTDDQDIPRNLALAVDTTPELTIDLEQASYVLSVLTLRPSRVSRLRDWRQRLFLSLEKNQANRTEIFHPPTHPHHCAGHRTASVIHPELWERRNPPCGPPTVHRAGLAHRV

SEQ ID NO: 17548 - protein, 445 aa, Corynebacterium efficiens YS-314
MKSTASSIPPERSTALLTDKYELTMLQAALADGTADRQVTFEVFSRRLPNERRYGVVAGTARVLHAVKDFTFTDEQLADLDFLDQRTRDFLASYRFTGQIDGYREGELYFPHSPLLTVRGTFAECVVLETVILSIMNADSAVASAAARMVTAADGRPIIEMGSRRTHEYAAVTSSRAAYLAGFSATSNLEASFRYGIPASGTSAHAWTLLHINDDGTPNEAAAFRSQVDQLGVETTLLVDTYDIARGVETAIEVAGTDLGGVRIDSGDLGVLARQVRQQLDDLGAHNTKIVVSSDLDEFTIAGLRGEPVDVFGVGTSVVTGSGAPTAGLVYKLVEVDGHPVAKRSRNKASHGGAKKAVRTHRSTGTAIEEIVYPYHSDRPDTGKLATLDLTIPLMRDGEAVDGLATLEQSRSYLADQLVTLPWEGLALSRDEPVLHTRFTGFPAS

SEQ ID NO: 17549 - protein, 311 aa, Corynebacterium efficiens YS-314
MGNVYNNITETIGRTPLVKLNRLTEGLDATVLVKLESFNPANSVKDRIGLAIIDAAEASGELKPGGTIVEATSGNTGIALAMVGAARGYKVVLTMPETMSTERRVLLRAYGAEIVLTPGAAGMQGAKDKADEIVAERENAILARQFENPANPEIHRETTAKELMEDTDGNFDIFVAGFGTGGTITGVGGVLKEHNPEAQVYAVEPEASPLLTSGKAGPHKIQGIGANFIPENLDRKILDDVITISNEDAVTWSRKLATEEGILGGISTGANIKAALDLAAKPENAGKTIVTTVCDFGERYVSTVLYEDIRD

SEQ ID NO: 17550 - protein, 162 aa, Corynebacterium efficiens YS-314
MEAMTSIHDIPVTLTDGTETTMADWAGHLVMVVNVASRCGLTPQYEGLQRLFEDYQDRGFFVIGVPCNQFMGQEPGTDAEICTFAQEKYDVTFPLLAKTDVNGENEHPLYTELKRFGEGGDIEWNFEKFLINADGETIARFGPRMDPEDDEVTSVIEDNLPV

SEQ ID NO: 17551 - protein, 466 aa, Corynebacterium efficiens YS-314
MAMVKKARSVHECSECGYSSPKWLGRCPECGSWGSMEERTVGATTGAAKAAVSGAAPTGLTPTSPAVPIGRIVASTATSISTGIGELDRVLGSGIVPGSVVLMAGEPGVGKSTLLLEVASRWSSMKEGDGTRTALYVTAEESAGQVRLRAERTNAVKDTLYLAAESNLDVVFGHVNQLKPSLLIVDSVQTMHAAGVEGVAGGVAQSRAVTAALTTLAKTSGVPILLVGHVTKDGNVAGPRVLEHLVDVVLNFEGDRHSSLRMLRGIKNRFGATDEVGCFEQQSDGIKEVPDPSGLFLSHRGSTPDGTAVTVAMDGVRPLLAEVQSLLVDAPSKNPRRVVTGLDANRVPMVLAVLSARAGRATQGKDAYVATVGGMKVGEPATDLAVALATASALAKKPLPDKTVVLGEVGLAGEIRRVPNVERRLAEAERLGYEKAVVPAGSGVKKTGLQVMETSTLVDALAAVKL

SEQ ID NO: 17552 - protein, 212 aa, Corynebacterium efficiens YS-314
MRTLEQRRCTLHMVNNVEMAGEKDFNVPTNPYGDDIESVLISENKLKERIREMAARVSEDYRDSEEDLILVCVLKGAFYFLSDFSRELTIPSQSEFMAVSSYGNSTSSSGVVRILKDLDKDIEGRDVLIVEDIIDSGLTLSWLMRNLKNRHPKSLNVITLLRKPERLTANIDMYDIGFDIPNEFVVGYGLDFAERYRDLPYVGTLEPRVYSD

SEQ ID NO: 17553 - protein, 479 aa, Corynebacterium efficiens YS-314
MRFGCPPLPSGRDRQPMFKERKLSMSRPLRVAVVGAGPAGIYASDLLMKSDHDVQIDLFERMPAPFGLIRYGVAPDHPRIKGIVKSLHNVLDKEQLRLLGNIEIGKDITVDELREFYDAIIFSTGATGDQDLRVKGADLEGSWGAGEFVGFYDGNPDFARSWDLSAEKVAVIGVGNVALDVARILAKTGDELKVTEIPDNVYESLSQNKAREVHVFGRRGPAQAKFTPLELKELDHSPNIEVVVNPEDIDYDAASEQARRDSKSQDLVCQTLEQYAIRDPKGAPHKLFIHFFESPVEILGEDGKVVGLKTERTRLDGNGGVVGTGEFTTWDVQAVYRAVGYRSDAVRDVPFDDERAIIPNDGGRVIDPSTGSPVTSLYATGWIKRGPIGLIGNTKSDAKETTEMLLADYAAGSLPAPANPETDAIIELLDDRKIPYTTWDGWHLLDAAEREAGEREGRERKKIVEWNDMVRFARPEYEI

SEQ ID NO: 17554 - protein, 395 aa, Corynebacterium efficiens YS-314
MNNAEWANKDYYADLGVSKNASAEDIKKAYRKLARENHPDKNPGDKVAEDRFKKAAEAYDVVGDETKRREYDDLKKLLASGGIRGGFGSGGADFPGGFRSTQGFDASDLFGGAGPGGGFSADGGLGDIFGGIFNRGSSPRQSARPTRGADVETDITLEFREAAKGTTIPVELTGEAPCNTCHGSGSASGQPSKCGQCNGSGFTSENKGAFGFSAPCTNCGGTGEVITDPCVDCRGRGTVRRTRSITVRIPAGVEDGQKVRLAGQGEAGPNGKPAGDLFVRVHVKEDPVFEREGNNIHVTVPVSFSELALGGAISVPTLDKPVKLKLAPGTPDGRTLRVRGRGVETRTAKGDLMVTVQVTVPPTLSDEAAEALRTYAEAEKKSGFDPRANWAGNNR

SEQ ID NO: 17555 - protein, 457 aa, Corynebacterium efficiens YS-314
MTTPLRVAVIGAGPAGIYASDLLIRNEEHEIHVDLFEQMPAPFGLIRYGVAPDHPRIKGIVKSLHNVLDKPRLRLLGNITIGRDITVDELRDYYDAVVFSTGAVRDRDLNIPGVDAEGSFGGADFVGFYDGNPRFPRDWDLSARSVAVIGVGNVGLDVARILAKTGDELKVTEIPDNVYENLKRNQAKEVHIFGRRGPAQVKFTPQELKELDHSDTINVVVDPEDIDYDAASEEARRSSKSQDLVCQILEQYAIREPKDAPHTLQIHLFENPVEILEKDGRVVGLRTERTELDGNGGVNGTGKFTEWPVQAVYRTVGYKSDAIEGVPFDDQKHVIPNDGGHVLQAPGTDPVPGLYATGWIKRGPIGLIGNTKSDAKETTDMLVADAAAGKLDAPKYTDRDAIVELLDERNIPYTTWEGWYRLDAAERALGEAEGRERKKIVDWEEMVKHAREVPVVV

SEQ ID NO: 17556 - protein, 442 aa, Corynebacterium efficiens YS-314
MDIRTLIDTRAMTRYQWFIIAIATFLNAMDGYDILAMAFTANSVATEFGLSGAQLGLLISLGFIGMGIGSLSFGPLGDRLGRRPILLAALTLDGIGLLWSGVAGSATELGLARLLTGIGVGGVLTVVTVITSEYSNKRNRGMAISIYAAGYGVGATLGGLLAAQLIPTTGWRGVFLAGAALSAVGIAAVWAFIPESFDYLRTRGDLPRARQIAVRLGIREEVTFPSAPASAAFPRRGLPAVLSPALLRNTLRLWGAFALITIGFQVASSWTPKLLEDAGMSAQQSIVGGLLLTLGGSFGSLIYGWLTTRFSAQGTLIAFSLGSAVLLVGFISSIPLPALAFTLGVLTGMLLNGCIAGLYSIAPQIYPAGMRTTGVGVALGVGRVGAILAPLGVGVLIDAGISSLHIYLAVGCIMLLGATTLRGITLHRETTVVIAEPALVEK

SEQ ID NO: 17557 - protein, 318 aa, Corynebacterium efficiens YS-314
MSSEATTPTVVSYLGPAGTFTEAALIRFAERGEFGDGEITQLPVNSPQQAVDAVREGAADFAVVAIENFVDGFVTPTYDALDQGSDVQIFAEEAIEVSFTIMARPGTELADIRTLATHPVAHQQIKNWMAATVPDARFVSASSNAAAAQLVAENGADAAAAPERAADLFGLSKLVDDVADIRGARTRFVAVRRRIAPPPRTGHDHTAVVFALPNVPGSLVRALNEFALRGVDLARIESRPTRKTFGTYRFHLDFIGHIEDLPVREALRALHMQAEDLVFLGSWPAPRDSDDENTWADDIARLEKADDWVRAVLEGREY

SEQ ID NO: 17558 - protein, 480 aa, Corynebacterium efficiens YS-314
MFGGRTHPGPTRTPSRTGVVLCAGMLIDAGYPRPTGVVFPHMNLTRNDRLDRLPVTSKHRKLLGGSGIGWALDAMDVGLISFIMAALVTHWDLSPTEASLLGSIGFVGMALGATFGGLLADKVGRRQVFALSLLVYGLATGASALSVSLVMLMALRFVVGLGLGAELPVASTLISEFSPRRIRGRMVVILEAFWALGWIMAAIIGTFVVTIGENGWRWALALGCVPAAYAIYVRLGLPESVRFLESKGRHEEAEAIVVSFEEQAVREGKPLTDSLPESRDVEVEGSESIWAKNLRRRTAALWVVWFCINLSYYGAFIWIPSLLVADGFTLVRSFQFTLIITLAQLPGYAAAAWLIEKWGRRATLSTFLAGSAVSAAMYGMADAEWQILVAGCLLSFFNLGAWGALYAIGPELYPTDVRGTGTGAAAGFGRIASIIAPLIVPPVISLGGPVLLFALFASAFALAAVAAFTLPEQKGKALAD

SEQ ID NO: 17559 - protein, 235 aa, Corynebacterium efficiens YS-314
MKDMAQGDTNITVVGNLVADPELRFTPSGAAVANFRIASTPRTFNRTTNQWEDGEGLFLTCNVWREAAENVAESLTKGMRVIVQGRLRQRSYETREGEKRTIFEVEVDDVGPSLKYAKAEVTRIPRGGGQGGFGGNQGGGFGGQGGNQGGNPGGGQGGFGQNTGGFGGQQGNQGGFGGGQGGNPGGNQGQSGNNFNQGGFGGGGNQAAAPDNDPWNSAPPAGSGGFGGADDEPPF

SEQ ID NO: 17560 - protein, 280 aa, Corynebacterium efficiens YS-314
MSRYTDMFTRLDEAGEGAFVPFIMLNDPSPEDSFQIISTAIEAGADALELGVPFSDPVADGPTVAESHLRALDGGSTVDSCLALIARVREAYPEIPIGMLIYGNVPFTRGLDKFYREFAEAGADSILLPDVPVREGAPFIQAAEGAGIDPIFIAPAQASETTLEGVSAASKGYIYAISRDGVTGTERESSTTGLTDVVDNIKRFGGAPILLGFGISSPKHVADAIAAGAAGAITGSAITKIIASHCEGEHPNPSTITDPEGLRKELTEFISAMKAATKKQ

SEQ ID NO: 17561 - protein, 383 aa, Corynebacterium efficiens YS-314
MLPASRWEIRWTIVDIMTSLFSPLQLRGLTVRNRVWMAPMCQYQVTTGDGVPNDWHLVHYGARAAGGFGLIIAEATGVSPEGRISPACTGLWNDEQVHAWKRITDFAHTQGAPMGVQLNHAGRKAGTYPWLPGNPSGTVPVAEGGWRILGPSAVAQKGLDVPEEMTLADIRKVVEDFAAASRRAVEAGFDSIEIHGAHGYLLHQFLTPLANKRTDDYGGSFDNRTRLIREVVTAVRATIPEEMPLVVRLSATDWIDDEPSWDADQTVRLVEILKGLGVDAVDISTGGAAPARIPVGPGYQVDFAARVKREVGIPTSAVGLITEPAQAQELLDDGLADIISLGRAVLRDPSWPLRAAHELGLPNEEIPYPASYWRGVWPEKVTV

SEQ ID NO: 17562 - protein, 313 aa, Corynebacterium efficiens YS-314
MSEEQSKIHDVAIIGSGPAGYTAAIYAARADLKPIMFEGYEYGGSLMTTTDVENFPGFQDGIMGPELMENMRAQAERFGTDLRMELVDRVDLTGDIKKIWVGDDEYQARAVILSMGSAPRYLGIPGEKELLGRGVSACATCDGFFFRDQDIAVIGGGDSAMEEATFLTKFARSVTIVHRREEFRASAIMLERAQKNEKIRFVTNKTVEEVIENDGKVAGLKLKDTVTGELSDLDVTAMFVAIGHDPRSEMLVGQVELDSSNYVVAEHPSTRTNVPGVFAAGDLVDSHYQQAITAAGSGCRAAIDAENYLANQI

SEQ ID NO: 17563 - protein, 343 aa, Alicyclobacillus acidocaldarius
MTIEFVGVEKIYPGGARSVRGVSFQIREGEMVGLLGPSGSGKTTILRLIAGLERPTKGDVWIGGKRVTDLPPQKRNVGLVFQNYALFQHMTVYDNVSFGLREKRVPKDEMDARVRELLRFMRLESYANRFPHELSGGQQQRVALARALAPRPQVLLFDEPFAAIDTQIRRELRTFVRQVHDEMGVTSVFVTHDQEEALEVADRVLVLHEGNVEQFGTPEEVYEKPGTLFVASFIGESNVWTRAVQNGRIEVAGAALPVDPAVSEGSEVAVVVRPKDVELQPASEREAHAQVVRSAFKGSYSACWIRTKDGEVWEVHVPSADRHRWSPGAWVHMNVTRWFIFPR

SEQ ID NO: 17564 - protein, 226 aa, Staphylococcus aureus
MIIMKNVTRSFKNGSDTVEILKNINLTISENEFLSIMGPSGSGKSTLINILGFVDREYTGEYYFRNENFKEISDDKIAFIRNKTVGFVFQNFKLIQNNTVFENVEIPLIYSNRSKKDRKKLIKNVLQSVGLEGKENMLPKNLSGGQQQRVAIARSIVNNPDLLIADEPTGALDTETSKEIMDIFIDLNSKFNTTIVLVTHDYEVAKKTKRIINIIDGKIVEKGRSH

SEQ ID NO: 17565 - protein, 374 aa, Petroselinum crispum
MESSSAATADHTHIKGVPTHGGRYVQYNVYGNLFEVSRKYVPPIRPVGRGAYGIVCAAMNSDTREEVAIKKIGNAFDNRIDAKRTLREIKLLRHMNHENVIAIKDIIRPPQIESFNDVYIVYELMDTDLHQIIRSNQQLTDDHCRYFLYQLLRGLKYVHSANVLHRDLKPSNLLLNANCDLKIGDFGLARTTSETDFMTEYVVTRWYRAPELLLNCSEYTAAIDIWSVGCILGEVMTRQPLFPGKDYVHQLRLITELIGSPDDASLGFLRSDNARRYVRQLPQYPKQQFSARFLNKSPGALDLLEKMLIFDPNRRITVDEALCHPYLAALHDINEEPVCPRPFSFDFEQPTCTEENIKELIWKESVKFNPDPIL

SEQ ID NO: 17566 - protein, 475 aa, Oxyria sinensis
MSPQTETKAGVGFKAGVKEYKLTYYTPDYEPHDHDILAAFRVTPQPGVPPEEAGAAVAAESSTGTWTTVWTDGLTSLDRYKGRCYHIEPVPGEESQFIAYVAYPLDLFEEGSVTNIFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIFKAQSETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFVEKDRSRGIYFTQPWVSLPGVIPVASGGIHVWHMPALTEIFGDDSVLQFGGGTLGHPWGNAPGAVANRVALEACVQARNEGRDLAREGNDIIRKAAKWSPELAAACEIWKEIKFEFQAMDTL

SEQ ID NO: 17567 - protein, 348 aa, Escherichia coli
MTQKNFVELRNVTKRFGSNTVIDNINLTIPQGQMVTLLGPSGCGKTTILRLVAGLEKPSEGQIFIDGEDVTHRSIQQRDICMVFQSYALFPHMSLGENVGYGLKMLGVPRAELKARVKEALAMVDLEGFEDRFVDQISGGQQQRVALARALILKPKVLLFDEPLSNLDANLRRSMRDKIRELQKQFDITSLYVTHDQSEAFAVSDTVLVMNKGHIMQIGSPQDLYRQPASRFMASFMGDANLFPATFSDGYVDIYGYHLPRPLHFGTQGEGMVGVRPEAITLSDRGEESQRCVIRHVAYMGPQYEVTVEWHGQEILLQVNATRLQPDVGEQYYLEIHPYGMFVLADAA

SEQ ID NO: 17568 - protein, 499 aa, Escherichia coli
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 17569 - protein, 1015 aa, Escherichia coli
MDVSRRQFFKICAGGMAGTTVAALGFAPKQALAQARNYKLLRAKEIRNTCTYCSVGCGLLMYSLGDGAKNAREAIYHIEGDPDHPVSRGALCPKGAGLLDYVNSENRLRYPEYRAPGSDKWQRISWEEAFSRIAKLMKADRDANFIEKNEQGVTVNRWLSTGMLCASGASNETGMLTQKFARSLGMLAVDNQARVCHGPTVASLAPTFGRGAMTNHWVDIKNANVVMVMGGNAAEAHPVGFRWAMEAKNNNDATLIVVDPRFTRTASVADIYAPIRSGTDITFLSGVLRYLIENNKINAEYVKHYTNASLLVRDDFAFEDGLFSGYDAEKRQYDKSSWNYQLDENGYAKRDETLTHPRCVWNLLKEHVSRYTPDVVENICGTPKADFLKVCEVLASTSAPDRTTTFLYALGWTQHTVGAQNIRTMAMIQLLLGNMGMAGGGVNALRGHSNIQGLTDLGLLSTSLPGYLTLPSEKQVDLQSYLEANTPKATLADQVNYWSNYPKFFVSLMKSFYGDAAQKENNWGYDWLPKWDQTYDVIKYFNMMDEGKVTGYFCQGFNPVASFPDKNKVVSCLSKLKYMVVIDPLVTETSTFWQNHGESNDVDPASIQTEVFRLPSTCFAEEDGSIANSGRWLQWHWKGQDAPGEARNDGEILAGIYHHLRELYQSEGGKGVEPLMKMSWNYKQPHEPQSDEVAKENNGYALEDLYDANGVLIAKKGQLLSSFAHLRDDGTTASSCWIYTGSWTEQGNQMANRDNSDPSGLGNTLGWAWAWPLNRRVLYNRASADINGKPWDPKRMLIQWNGSKWTGNDIPDFGNAAPGTPTGPFIMQPEGMGRLFAINKMAEGPFPEHYEPIETPLGTNPLHPNVVSNPVVRLYEQDALRMGKKEQFPYVGTTYRLTEHFHTWTKHALLNAIAQPEQFVEISETLAAAKGINNGDRVTVSSKRGFIRAVAVVTRRLKPLNVNGQQVETVGIPIHWGFEGVARKGYIANTLTPNVGDANSQTPEYKAFLVNIEKA

SEQ ID NO: 17570 - protein, 387 aa, Mycoplasma genitalium
MEAILKIGDIVENKYQIEKLLNRGGMDSYLFLAKNLNLKNYGPVQKKQYGHLVLKVVQKNPKINENNWKKFLDEMVTTTRVHHSNLVKSFDVVNPFLKIVRGNKTIALNQIVMIAMEYVDGPSLRQLLNRKGYFSVSEVVYYFTKIVKAIDYLHSFKHQIIHRDLKPENILFTSDLTDIKLLDFGIASTVVKVAEKTEVLTDENSLFGTVSYMIPDVLESTVNKAGKKVRKPPNAQYDIYSLGIILFEMLVGRVPFNKSINPNKERETIQKARNFDLPLMQATRSDIPNSLENIAFRCTAVKRENNKWLYSSTKELLEDLANWENEQAMIKPANERVLEGQVEIREMMLEKPLAWYFKTWALSIFTIVFIGLIIAAIVLLLIFNARF

SEQ ID NO: 17571 - protein, 329 aa, Pyrococcus furiosus
MHPKVQSLLSKFPRVELIPWETPIQYLPNISKLVGADIYVKRDDLTGLGIGGNKIRKLEYLLGDAIIRKADVIITVGAVHSNHAFVTGLAAKKLGFDVVLVLRGKEELRGNYLLDKIMGIETRVYEAKDSFELMKYAEEVAKELEEKGRKPYIIPVGGASPVGTLGYVRASGEIAEQGNRIGVNFDSIVVATGSGGTLAGLSVGLAILRKETRAIGMAVGKFGETMVNKVEELAKATGEFIGVKNLKLKIELYDYSFGEYGKITREVAETIRLVGTKEGVILDPVYTGKAFYGLLDLAKKGELGEKILFIHTGGISGTFHYGDKILSFL

SEQ ID NO: 17572 - protein, 449 aa, Arabidopsis thaliana
MDIFDNSDLEYLVDEFHADFDDDEPFGEVDVTSESDSDFMDSDFDFELSESKTNNETSALEARNGKDIQGIPWESLNYTRDRYRENRLLHYKNFESLFRSREELDKECLQVEKGKNFYDFQFNTRLVKSTIAHFQLRNLVWATSKHDVYFMNNYSLMHWSSLLQRGKEVLNVAKPIVPSMKQHGSLSQSVSRVQISTMAVKDDLIVAGGFQGELICKKINEPEVAFCTKLTSADNDITNSVDIYNAPSGSLRVMTANNDCTVRLFDATNFALLNRFAFHWSVNNISTSPDGKLVAVLGDSPECLLADTGSGKVIHGLEGHLDYSFSSAWHPNGQILATGNQDTTCRLWDVRNLSQSLKVLKGNMGAIRALRFTSDGRFLAMAEPADFVHLFDTEAGYSQCQEIDLFGEIAGISFSPDTEALFVGVADRTYGSLLEFNRKRNHSYVDSIF

SEQ ID NO: 17573 - protein, 375 aa, Brevibacillus choshinensis
MKRDYYEVLGVGKGADADEIKKAYRKLARQYHPDVNKAADAEEKFKEVKEAYDVLSEPQKRAQYDRFGHQDPNQGFGGGGFDASGMGGFGDIFDMFFGGGGRRANPNAPRKGSDLQFGLSIEFTETVFGKETDVEIPKEAECDTCHGSGAKPGTGVETCKTCSGTGQQEVAANTPFGRIVNRRVCTTCEGKGKVFKEKCSSCRGSGRVKVRRKIHLNIPAGVDDGAQLRVTGEGEPGVNGGPPGDLYVVLRVKSHEFFEREGNDIYCEVPLTYAQAALGDEIEVPTVDGRVKLKIPSGTQTETFFRLRGKGVPHLRGNGRGDQHVKVRVITPTKLSDKQKELLRELAELSGEKPGQHGGEDEGFFEKMKRAFRGE

SEQ ID NO: 17574 - protein, 423 aa, Kluyveromyces lactis
MRVIRQLHTSKRLLQSLVDKQKYQATTYARPNHLVLTRGKNAILYDDVNNKEYIDFTAGIAVTALGHANPEVAEIMYKQSKKLIHSSNLYYNEECLKLSENLVEATKSFGGQYDASRVFLCNSGTEANEAALKFAKRYGILKSPSKQGIIAFQNSFHGRTMGALSVTSNPKYREPFGSLIPGVEFLNINDELTKLDQQVSSLKEKTAGLIVEPIQGEGGVFPIPLDSLVGLKKICEDHDIIVIYDEIQCGLGRSGKLWAHSYLPKEAHPDIFTTAKALGNGFPIAATVTNDKVNDILKVGDHGTTYGGNPLGSAVGNYVVNVIAEQKFLDEVNKKGEIITNRLRKLQERFPEHIKDIRGKGLMIGCDFDEAPAKIVDAARDSGLLIITAGKTTVRFVPALTIEDNLLEKGLNIFEKAVEKVYS

SEQ ID NO: 17575 - protein, 107 aa, Cynara cardunculus
GVMSQQCKSLVDQYGKSMIEMLLSEEQPEKICSQMKLCSFDGSHDTSMIIESVVDKSKGKSSGLHDEMCTMCQMAVVWMQNQIRQNETEENIINYVDKLCERLPSPM

SEQ ID NO: 17576 - protein, 348 aa, Hordeum vulgare
MTVVDAAAAVAQELPGHGQTVCVTGAAGYIASWLVKLLLERGYTVKGTVRNPDDPKNAHLKALDGAAERLVLCKADLLDYDAICAAVEGCHGVFHTASPVTDDPEQMVEPAVRGTEYVIDAAADAGTVRRVVFTSSIGAVTMDPNRGPDVVVDESCWSDLEFCKKTKNWYCYGKAVAEQAAWEKARARGVDLVVVNPVLVVGPLLQPTVNASAAHILKYLDGSARKYANAVQAYVDVRDVAGAHLRVFEAPQASGRYLCAERVLHRQDVVHILAKLFPEYPVPTRCSDEVNPRKQPYKMSNQKLQDLGLKFTPVNDSLYETVKSLQEKGHLPVPRKDILAPQLDGATA

SEQ ID NO: 17577 - protein, 332 aa, Solanum tuberosum
MPSESGKVVCVTGAGGFIASWLVKLLLEKGYTVRGTVRNPDDPKNGHLKELEGAKERLILLRADLLDYQSLREAIYGCDGVFHTASPVTDDPEQMVEPAVIGTKNVITAAAEAKVGRVVFTSSIGTVYMDPNRAPDKVVDETCWSDLGFCKNTKNWYCYGKTVAEKTAWDEAREKGVDLVVINPVLVLGPLLQPTVNASVLHILKYLTGSAKTYANSIQAYVHVKDVALAHILLYEAPSASGRYICAESVLHRGDVVEILAKFFPEYPIPTKCSDETRPRAKPYKFTNQKLKDLGLGFTPVKQCLYETVKSLQEKGHLPIPTQNDEPIKIHS

SEQ ID NO: 17578 - protein, 221 aa, Solanum tuberosum
MAEKSRVCVTGAGGYVASSLVKLLLSKDYIVHGTVRDPSDDKYAHLKNLDKAAENLKLFKADLLDPNSLAGAIKGCNGVFHVACPVPSGSVPNPEVELVEPAVNGTLNVLKACSEENIKRVVFVSSVAAASRPHWPKGQVKDETCWSDSEYCKATNNWYCFSKTMAEKEAWSYAKQGGLDMVTVLPSLVIGPMLQKTTNASSLFLIKLLKEGYEELENRNG

SEQ ID NO: 17579 - protein, 476 aa, Arabidopsis thaliana
MALQRQLLKRATSDIYHRRAISLLRTDFSTSPSIADAPPHIPPFVHQPRPYKGPSADEVLQKRKKFLGPSLFHYYQKPLNIVEGKMQYLYDESGRRYLDAFAGIVTVSCGHCHPDILNAITEQSKLLQHATTIYLHHAIGDFAEALAAKMPGNLKVVYFVNSGSEANELAMMMARLYTGSLEMISLRNAYHGGSSNTIGLTALNTWKYPLPQGEIHHVVNPDPYRGVFGSDGSLYAKDVHDHIEYGTSGKVAGFIAETIQGVGGAVELAPGYLKSVYEIVRNAGGVCIADEVQTGFGRTGSHYWGFQTQDVVPDIVTMAKGIGNGLPLGAVVTTPEIASVLASKILFNTFGGNPVCSAGGLAVLNVIDKEKRQEHCAEVGSHLIQRLKDVQKRHDIIGDVRGRGLMVGIELVSDRKDKTPAKAETSVLFEQLRELGILVGKGGLHGNVFRIKPPMCFTKDDADFLVDALDYSISRL

SEQ ID NO: 17580 - protein, 435 aa, Wigglesworthia glossinidia endosymbiont of Glossina brevipalpis
MIKNSITNKLYVEAKKIIPGGVNSPARSFYFVKEIPVIAKRSKGPYIFDVDNNKYIDYICSWGASILGHNNYYITSKIIEYSKKGLNFGLLTEIEIKIARLISKYIPSIEMIRMVNSGTEATMSAIRLARSYTKKNKIIKFDGCYHGHADFLLANSNLDPYDLFSSNPISSGIPKNILKDTLICPYNDYESIEKIFDLYPNKIACIIVEPIAGNMGCVLPEKNFLYKLRMLCNKFNSLLIMDEIITGFRISLGGAQSYYNIYPDITCLGKIIGGGLPIGAFGGKKRIMNHVSPSGSVYQAGTFSGNPISMISGYACLKLLKSPDLYNKLNKKTEYLVNELRSSACDNKIPVVINSLGSMFSIFFTNLDKIKCYKDVSSCNYKKFILFFNEIKKLGILFSPSLFESNFITLMHKKKDLEKTIDSANKVFKILKNKV

SEQ ID NO: 17581 - protein, 479 aa, Wigglesworthia glossinidia endosymbiont of Glossina brevipalpis
MHRIIRRTKIVATLGPSTDLNNNLEKMILAGANMVRMNFSHGNFYDHARRTKQVRNISHKLGKNIAILGDLQGPKIRISTFMTGKVFLSPGDQFILDASLSKDLGTVESVGIDYKYLPKDVFPGDVLLLDDGRIQLKVKKIVNKKIFTTVYIGGYLYNNKGINKLGGGLSANSLTEKDKKDIICAAKIGIDYLAVSFPRTGKDLKYARNLLNNVESHAKIISKIERAEAVANNDIIDEIITESDAIMVARGDLGIEIGDPELVGVQKKLIQRARDLNRAVITATQMMESMVYNPMPTRAEVMDVANAVLDGTDAVMLSAETAIGKYPVETVESMSNVCIGAEKISNINSLKNRLNIKFKTVEESMAVSAMYIANHLNMIKAIISLTESGKTPLIMSRISSGLPIFALSKHEHTLNLTALYRGVTPVYFKNNEKGISAADSAINLLKEKKFLFSGDFVVITQGDVMGTIGKTNTSRILIV

SEQ ID NO: 17582 - protein, 448 aa, Wigglesworthia glossinidia endosymbiont of Glossina brevipalpis
MKTKGFTKKICYFDLNKNQLKIVLITIFITLAEFFDLFIISFVVSFISEKEMYKDMSDNTGIILSSSGFGIILGYLIFGYISELYGRKSTIIISIFIISFFNSLFIFINENDWMLFSFIRLMIGLGSGGINVTILPYLHEFIPYKRRGVISGISSLFVPIGLFLGSFATSYFIDKIGWKGVIILGSFPIVLLIWIYNLPESPYFLIKKNRIENAIKSYSWAFMLSREKVLKNFIKLKHKKVSIKKIIKKNKFNLIIISLGFFCFTLSSFFIQSCGQILLKNIFFIKINEISKIFLYLSLGNLSGRLLSSFISDYIKRKYVIFIFGFFGSIGYIFLFFSVFHEMNSEYDFPNIKIFIIGLFIIMIFGDGAFGVINTFGSEIFIKEAKSICLGISHGIGATAKIIGPIYFSNIYKINYFSYFDLPKYFILLSFFFLFGCIIYLFSKEIKL

SEQ ID NO: 17583 - protein, 257 aa, Wigglesworthia glossinidia endosymbiont of Glossina brevipalpis
MNSKIYKKNSEIIIEFINVNKKFKNQLILKNINLKIKSGEIIVICGPSGSGKSTLIRLINKLEMFDSGEIFVYGNPISNLKGHKLRILRTKIGFVFQQFNLYANLNVLENVALSLIKIQKWEKNHAYDYSISKLKEVGLINKNKCYPHELSGGQQQRVAIARALATDVKIMILDEPTSALDPEMISEVMVVIKKLVNHGITMVIVTHEIQFAKKIADTIVFISSGEIIEKSDPESFFSSPKHPRTKKFLDKILFPIK

SEQ ID NO: 17584 - protein, 476 aa, Wigglesworthia glossinidia endosymbiont of Glossina brevipalpis
MKENKINTEVLVIGSGPGGYSAAFRCADLGLKTVLVERFSSLGGVCLNVGCIPSKSLLHIANNLNSINKLKKIGIKFNEREIDMNQIRKWKCDVVLKLTNGLNMMSKARNVKIIHGYGEFIDPYTVNVKSLKENTKIKFEHAIIAVGSSPIKNHFMLQPDEKIWDSTDALKIKFIPKKLLIVGGGVIGLEMATVYNSFGSEVYIAEMSNQLIPAVDTDIINIFYKSIKNNFNIMLNTELKSVYLEDNNIYAELVNNDKKIEKICCNAVLFSTGRKSNGDLIKAKEIGIKLNNLNFIEVNNQMRTNIPHIYAIGDVTGHPMLAHKASYQSHIAAEVISGENHFFDPRVIPSVAYTNPEISWVGITEKEAINLNIPYETALFPWNALGRAIASDHHEGGMTKLIFNKENKKIIGGSIVGYNSSELLGEISLAIEMGCDVDDISLTIHAHPTLYESIGRASEIFSGTITDFLNKKSKNK

SEQ ID NO: 17585 - protein, 1316 aa, Wigglesworthia glossinidia endosymbiont of Glossina brevipalpis
MDTRILGIKLDNKLSHRIENISSRLNRTPHWIIKQAIFLHLDDLEKKSKSSEKLIENKNEIQDYQDKINEKIIFKPFFEFAQQILPQSYLRFNTTNAWSTPEKEIVPKLLELSKCEEETEKKIHELSKYLAKGLREKSKKYNREQMVQDLLREFPLSSKEGIALMCLAEALLRIPDVNTRNSLIKDKIKNKDWKSHFGSNKGLFINSAVWGLCITNNLIKRHKEKNLSSYLNKVIQKIGEPIVGKAINVAMKLMGKQFVVGENIQQALKNTNILEKKGFSYSYDMLGEAALTEEDAQKYMTSYENAIHCIGKSSLGKGIYKGPGISIKLSAIHPRYSRNKYEKVMSELYPRLRSLTLLARHYDIGMNIDAEEANRLEISIDLLDKLCCEPSLFGWSGIGFVVQAYQKRCMYVIEELIDIAKRTKRRLMVRLVKGAYWDSEIKNAQIEGIEDYPVFTRKAYTDISYLACAKKLLSESNHIYPQFATHNAHTVSSIYHFAGENYYSGQYEFQCLHGMGEQLYEKVVGNAIDKKLDRPCRIYAPVGTHKTLLAYLVRRILENGANNSFINRISDNNVSIEKLVLSPIKESISISKKENVEIGTSHPNIPLPKNLYGNNRENSHGFNFSNENVLAKLSSDLLKNSDKFWKVTPIIHSKLDKGSISKIINPANKKDIIGECQSSTLKDVESALESSVKGIELWSSKEPLERSKILYDISNKIEKNTNIFINLLVRESGKTFPNAVSEIREAVDFLRYYSNQIKPFNNKTHIPLGCVLCISPWNFPLAIFLGQISAALASGNAVIAKPAEQTPIVAYEAIKLMIDSGIPSESLQFLPGSGKIIGNSLSKDHRIHGVMFTGSTQVARLLQLNLSDRLSKGRPVPLIAETGGLNAMIVDSSALTEQVVSDIIVSAFDSAGQRCSALRLLCIQEDVSEKTLNMIKGAIDSYTVGNPEYFSTDIGPVIDKNAKINIDQHILNMKKSNHSVWQSEMSYDTKQDLGNFVLPTLIELDDIDQIKEEVFGPVLHIVKFKYEEMNNIFEKINSSGYGLTIGIHSRIEENIEKVTTSTKVGNYYVNRNIVGAVVGVQPFGGEGLSGTGPKAGGPLYLYRLLSDRKEKNILSSLEELDKNKKVDLTRCEKIQESCVSLIEWISVNYPDLEKYCNYFISQSQSGSSRVLQGPTGEKNTYLLLPRERILCLSNDENDLLIQLAAVTSIGGKAILSHNPITQKIFSILPQSVLKNVILIPNWKREDSMFDIVLFHGDELQLKEVLEILSKKRGPVINVHSHKNGDKKIFLEKLLIERTISLNTTAAGGNTTLLSMV

SEQ ID NO: 17586 - protein, 433 aa, Wigglesworthia glossinidia endosymbiont of Glossina brevipalpis
MNINEVNFDRYYIWHPYSSITKPLKTYHVVSAKKCKLKLINGKKLIDGMSSWWTVIHGYNHPKINQAIINQIKKVSHVMFGGITHSPAIKLCKKIIKLTPKGLECVFLSDSGSVSIEVALKMALHYWFSKNERKKVKFLSLRGGYHGDTFGALSVCDPKNSMHNIYQGYLPNQEFTNTFDRKFNEKWESGDDLNLVKLIEKHHKKLAAVIIEPIVQGVGGMNFYHKQYLISIKKLCKFYKILLIVDEIATGFGRTGKLFACNYSKITPDILCIGKALTGGAITLAATITKRKVSETICNKKTPEFMHGPTFMANPLSCAASCANLSLIEEGKWIQQVKFIYQEMCKYLYPLIEHSYVKDVRILGAIGVVETKFFVNLENIQNWFVRHGAWIRPFRKLIYLIPPYIISSYELKFLIKLISLSLNDDKNFLYIKN

SEQ ID NO: 17587 - protein, 233 aa, Wigglesworthia glossinidia endosymbiont of Glossina brevipalpis
MNNNFFISPSILAANFANLGEEIRKVIDAGADIIHFDAMDNHYVPNLSIGPIVLKSIRKDGIIIPIEVHLMAKPIDELVVSFIKTKANCIIFHPESTKNVNFLLKLIRKNNCKAGLAFTLTTSLNYLKNKNIVKNLDIVLIMSVSPGFSGQKFQKSAIKRLKIARKLIDDSGYNILIGIDGGVNDDNIYDVAYAGADIFVIGSSIFSKNNYFKTIKNMKKKIKSAKINILKNL

SEQ ID NO: 17588 - protein, 467 aa, Wigglesworthia glossinidia endosymbiont of Glossina brevipalpis
MSINEIINIIEKNNIKFIDFRFTDMVGKEQHITVPFLKKEKINKILKNGKIFDGSSILGWKKIQNSDVLLIPDLTTAVLDPFYNDSTLIIKCDIFESNKSESYNKDPRSIAKNAEKYLQYSKIGDKMYFGPELEFFLFDDIRFYTAIHGSQVIINDIESSWNSGKYYSQGNKGYRPSVKSGYLPVPPVDSSQNIRSSMCLFMEKMGIEVEAHHHEVATSGQNEISTKYNTLTKKADEVQIYKYIVHNTAYFFKKTATFMPKPIRGDNGSGMHCHISIEKEGKNIFFGKEYGNLSKYALFSIGGIIKHAKSINAFANPTTNSYKRLIPGFEAPVSLSYSLNNRSAAIRIPTFNDDKSCRFEIRFPDSSSNPYLLFSAILMASIDGINNKIFPGNPIEKNLYKFKEKNLNKMSSSLEESIYHLDKDREFLTKNNVFTNDFIDSYIELKQKEINIVKSTPHPVEFELYYM

SEQ ID NO: 17589 - protein, 487 aa, Wigglesworthia glossinidia endosymbiont of Glossina brevipalpis
MLHIVKKGLTFDDVLLSPSRSNILPKNVDVSTKLTKKIKLKIPILSAAMDTVTESSMAIALAQEGGMGFIHKNMSIKNQIKEIKKVKRYENGMIMNPKCVTPNTSISTIKNITIINGFGSYPVVTENGKLIGIVTRRDALCAKDINQSVCTVMTPKDKLVTVYQGEKQEIVLSKMYDKRVEKALVVDRFFNLIGMITVKDFKKSEKKPYACKDKYGRLRVGAAISLEKNYIERINLLINSGIDVLLIDSSHGHSENILKKIRSIRDAYPDVQIIGGNVATGEGALDLIKSGVDAVKVGIGPGSICTTRIVTGVGVPQLTAISDAVDAIGSKDIPVIADGGIRFSGDIAKAIAAGAKCVMLGSLLAGSKESPGDIELYHGRSFKIYRGMGSVGAMFHGSSERYFQKNNKIDKLVPEGVEGRVPYKGCVKNIIYQQIGGLRSCMGLTGSSNIEDLRTKTTFVQITRAGIQESHVHDVSITKESPNYNLK

SEQ ID NO: 17590 - protein, 306 aa, Oenococcus oeni
MKKVLVFDGIAQVAIDYLKSNHIEVISNQQKNDDDFLANQDLNGIILMMHPVDKHILSQLPDLKIVARYGVGYDNVNLEDASQQHVIVTNTPGANATAVAETALMHMLMSGRLFYQERQSITGETDAPAKGQEVSHKKIGIIGFGAIGQKVDELLTGFNVEVLAYARHSKSVKNGRMATLEEIYSQSDFIVLALPATSDTQNMIDAEVFKKMKNTAVLVNIARGAIVDENALFNALKSGEIAGAGLDVVTNEPISDNNALLGLSNTFITPHIAAKSREAFDAVGLAAAKEVVRVLNNEAPLNQVNA

SEQ ID NO: 17591 - protein, 450 aa, Arthrobacter nicotinovorans
MLATLASATSEDAVAALEAACAAQTSWARTAPRVRAEILRRAFDLVTARSEDFALLMTLEMGKPLAEARGEVAYGAEFLRWFSEETVRDYGRYLTTPEGKNKILVQHKPVGPCLLITPWNFPLAMATRKVAPAVAAGCTMVLKPAKLTPLTSQLFAQTMMEAGLPAGVLNVVSSSSASGISGPLLKDSRLRKVSFTGSTPVGKRLMSDASRHVLRTSMELGGNAPFVVFEDADLDKAVEGAMAAKMRNMGEACTAANRFLVQESVAQEFTRKFAAAMGALSTGRGTDPASQVGPLINNGARDDIHALVTAAVDAGAVAVTGGAPVDGPGYFYQPTVLADVPNNAAILGQEIFGPVAPVTTFTTEQDAIKLANASEYGLAAYLYSRDFNRLLRVAEQIEFGMVGFNAGIISNAAAPFGGVKQSGLGREGGSEGIAEYTTTQYIGIADPYEN

SEQ ID NO: 17592 - protein, 502 aa, Persea americana
MAILVSLLFLAIALTFFLLKLNEKREKKPNLPPSPPNLPIIGNLHQLGNLPHRSLRSLANELGPLILLHLGHIPTLIVSTAEIAEEILKTHDLIFASRPSTTAARRIFYDCTDVAFSPYGEYWRQVRKICVLELLSIKRVNSYRSIREEEVGLMMERISQSCSTGEAVNLSELLLLLSSGTITRVAFGKKYEGEEERKNKFADLATELTTLMGAFFVGDYFPSFAWVDVLTGMDARLKRNHGELDAFVDHVIDDHLLSRKANGSDGVEQKDLVDVLLHLQKDSSLGVHLNRNNLKAVILDMFSGGTDTTAVTLEWAMAELIKHPDVMEKAQQEVRRVVGKKAKVEEEDLHQLHYLKLIIKETLRLHPVAPLLVPRESTRDVVIRGYHIPAKTRVFINAWAIGRDPKSWENAEEFLPERFVNNSVDFKGQDFQLIPFGAGRRGCPGIAFGISSVEISLANLLYWFNWELPGDLTKEDLDMSEAVGITVHMKFPLQLVAKRHLS

SEQ ID NO: 17593 - protein, 1034 aa, Sinorhizobium meliloti; identical to SEQ ID NO: 13019
  misc_feature (205)..(205): Xaa can be any naturally occurring amino acid

SEQ ID NO: 17594 - protein, 1016 aa, Salmonella enterica subsp. enterica serovar Typhi
  misc_feature (196)..(196): Xaa can be any naturally occurring amino acid
MQVSRRQFFKICAGGMAGTTAAALGFAPGVALAETRQYKLLRTRETRNTCTYCSVGCGLLMYSLGDGAKNAKASIFHIEGDPDHPVSRGALCPKGAGLVDFIHSESRLKFPQYRAPGSDKWQQISWEEAFDRIAKLMKEDRDANYQAQNAEGVTVNRWLTTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTASVADFYAPIRSGTDIAFLSGVMLYLLTNEKYNREYTEAYTNASLIVREDFGFDDGLFTGYDADKRQYDKTSWHYELDENGFAKRDTTLQHPRCVWNLLKQHVSRYTPDVVENICGTPKADFLKVCEYIAETSAKDKTASFLYALGWTQHSIGAQNIRTMAMIQLLLGNMGMAGGGVNALRGHSNIQGLTDLGLLSQSLPGYLTLPSEKQTDLQTYLAANTPKPLLKDQVNYWGNYPKFFVSMMKAFFGDKATAENSWGFDWLPKWDKGYDVLQYFEMMKQGKVNGYICQGFNPVASFPNKNKVVASLSKLKYLVTIDPLNTETSTFWQNHGESNDVDPSKIQTEVFRLPSTCFAEENGSIVNSGRWLQWHWKGADAPGIAMTDGEILAGIFLRLRKMYSEQGGANPEQVLNMTWNYTKPYEPASEEVAMESNGKALADLIDPATGAVVVKKGQQLSSFAQLRDDGTTSSGCWIFAGSWTPEGNMMARRDNADPSGLGNTLGWAWAWPLNRRILYNRASADPQGNPWDPKRQLLKWEGGKWAGWDIPDYSAAAPGSDVGPFIMQPEGMGRLFAIDKMAEGPFPEHYEPFETPLGTNPLHPNVISNPAARIFKDDADALGKADKFPYVGTTYRLTEHFHYWTKHALLNAIAQPEQFVEIGEKLANKLGIAHGDTVKVSSNRGYIKAKAVVTKRIRTLKADGKDIDTIGIPIHWGYEGVAKKGFIANTLTPFVGDANTQTPEFKSFLVNVEKV

SEQ ID NO: 17595 - protein, 1015 aa, Escherichia coli; identical to SEQ ID NO: 10264
  misc_feature (196)..(196): Xaa can be any naturally occurring amino acid

SEQ ID NO: 17596 - protein, 1016 aa, Escherichia coli; identical to SEQ ID NO: 10623
  misc_feature (196)..(196): Xaa can be any naturally occurring amino acid

SEQ ID NO: 17597 - protein, 310 aa, Arabidopsis thaliana
MSPRPSRLGPLNLTMSQINTATGNFADSHQIGEGGFGVVFKGVLDDGQVVAIKRAKKEHFENLRTEFKSEVDLLSKIGHRNLVKLLGYVDKGDERLIITEYVRNGTLRDHLDGARGTKLNFNQRLEIVIDVCHGLTYLHSYAERQIIHRDIKSSNILLTDSMRAKVADFGFARGGPTDSNQTHILTQVKGTVGYLDPEYMKTYHLTAKSDVYSFGILLVEILTGRRPVEAKRLPDERITVRWAFDKYNEGRVFELVDPNARERVDEKILRKMFSLAFQCAAPTKKERPDMEAVGKQLWAIRSSYLRRSME

SEQ ID NO: 17598 - protein, 369 aa, Arabidopsis thaliana
MSIEKPFFGDDSNRGVSINGGRYVQYNVYGNLFEVSKKYVPPLRPIGRGASGIVCAAWNSETGEEVAIKKIGNAFGNIIDAKRTLREIKLLKHMDHDNVIAIIDIIRPPQPDNFNDVHIVYELMDTDLHHIIRSNQPLTDDHSRFFLYQLLRGLKYVHSANVLHRDLKPSNLLLNANCDLKIGDFGLARTKSETDFMTEYVVTRWYRAPELLLNCSEYTAAIDIWSVGCILGEIMTREPLFPGRDYVQQLRLITELIGSPDDSSLGFLRSDNARRYVRQLPQYPRQNFAARFPNMSVNAVDLLQKMLVFDPNRRITVDEALCHPYLAPLHEYNEEPVCVRPFHFDFEQPSLTEENIKELIYRESVKFNP

SEQ ID NO: 17599 - protein, 464 aa, Arabidopsis thaliana
MSVARFDFSWCDADYHQETLENLKIAVKSTKKLCAVMLDTVGPELQVINKTEKAISLKADGLVTLTPSQDQEASSEVLPINFDGLAKAVKKGDTIFVGQYLFTGSETTSVEEVKGDDVICISRNAATLGGPLFTLHVSQVHIDMPTLTEKDKEVISTWGVQNKIDFLSLSYCRHAEDVRQARELLNSCGDLSQTQIFAKIENEEGLTHFDEILQEADGIILSRGNLGIDLPPEKAALYKCNMAGKPAVLTRVVDSMTDNLRPTRAEATDVANAVLDGSDAILLGAETLRGLYPVETISTVGRICCEAEKVFNQDLFFKKTVKYVGEPMTHLESIASSAVRAAIKVKASVIICFTSSGRAARLIAKYRPTMPVLSVVIPRLTTNQLKWSFSGAFEARQSLIVRGLFPMLADPRHPAESTSATNESVLKVALDHGKQAGVIKSHDRVVVCQKVGDASVVKIIELED

SEQ ID NO: 17600 - protein, 488 aa, Nostoc sp. PCC 7120
MQIQTPNWVKNAVFYQIFPDRFARSKQPHKRLLRDARWEDWDAMPTLQGYKGGDLWGIMEQLDYIQDLGIDAIYFTPIFQSASNHRYHTHDYYQVDPMLGGNAAFKELLDASHERNIKVVLDGVFNHSSRGFFFFHDVLENGPHSPWVNWFKIEGWPLAPYTGELPANYVGWADNRALPVFNHDNPEVREYIMEIAEYWIKFGIDGWRLDVPFEIKTPGFWQEFRDRVKAINPEAYIVGEVWGDSSEWLDGTQFDGVMNYLFAGPTIAFAAGDRVVLEQVQSRDYQPYPPLFAAEYATKIQEVLQLYPWDIQLTQLNLLASHDTARLLTIAGGDQASIQLATLLLLTFPGAPSIYYGDEVGLPGGIDPDSRRGFPLEANWDREIYQTHRQLIALRRTYPALRTGDYQVIWAQGALYIFARTLGKEELIIAVNVGTATAQANVDVASLQTQPNKILYGQAEFHWHNTEETKQLFLSLPPRSGCILGLGD

SEQ ID NO: 17601 - protein, 362 aa, Aspergillus awamori
MHSFASLLRYGLAAGATLASASPIEARDSCTFTTAAAAKAGKAKCSTITLDSIKVPAGTTLDLTGLTSGTKVIFEGTTTFDYEDWAGPLISMSGKDITVTGASGHLINCDGSRWWDGKGTSGKKKPKFFYAHGLDSSSITGLNIKNTPLMAFSVESDDITLTDITINNADGDSLGGHNTDAFDVGNSVGVNIIKPWVHNQDDCLAINSGENIWFTGGTCIGGHGLSIGSVGDRSNNVVKNVTIEHSTVSNSENAVRIKTISGATGSVSEITYSNIVMSGISDYGVVIQQDYEDGKPTGKPTNGVTITDVKLESVTGTVDSKATDIYLLCGSGSCSDWTWDDVKVTGGKKSSACKNLPSVASC

SEQ ID NO: 17602 - protein, 441 aa, Bacillus sp.
MRRWYTNIFLVVLLACLSIPMQANAKELGHEVLKPYDGWAAYGEGTTGGAMASPQNVFVVTNRTELIQALGGNNHTNQYNSVPKIIYVKGTIDLNVDDNNQPVGPDFYKDPHFDFEAYLREYDPATWGKKEVEGPLEEARVRSQKKQKDRIMVYVGSNTSIIGVGKDAKIKGGGFLIKNVDNVIIRNIEFEAPLDYFPEWDPTDGTLGEWNSEYDSISIEGSSHIWIDHNTFTDGDHPDRSLGTYFGRPFQQHDGALDIKNSSDFITISYNVFTNHDKVTLIGASDSRMADSGHLRVTLHHNYYKNVTQRLPRVRFGQVHIYNNYYEFSNLADYDFQYAWGVGVFSQIYAQNNYFSFDWDIDPSLIIKVWSKNEESMYETGTIVDLPNGRRYIDLVASYNESNTLQLKKEVTWKPMFYHVIHPTPSVPALVKAKAGAGNLH

SEQ ID NO: 17603 - protein, 180 aa, Spinacia oleracea
MASSVLSSARVATVSRTPAQASMVAPFTGLKSTVGFPATKKNDDITSLASNGGRVQCMKVWPTQNMKRYETLSYLPPLTTDQLARQVDYLLNNKWVPCLEFETDHGFVYREHHNSPGYYDGRYWTMWKLPMFGCTDPAQVLNELEECKKEYPNAFIRIIGFDSNRQVQCVSFIAYKPAGY

SEQ ID NO: 17604 - protein, 388 aa, Staphylococcus carnosus
MNKSKGGLQLTVQTLSLVAGFMVWSIIAPLMPMISQDIKITSSQISIVLAIPVILGSVLRIPFGYLTNIIGAKWVFFSSFIILLFPIFLLSQAQSVNMLMLAGFFLGVGGAVFSVGVTSIPKYFPKDKVGLANGIYGMGNLGTAVSSFLAPPIAGAIGWQSTVRLYLIVMAVFAIVMFFLGDAKEPKVKIPLVAQTKDLLKDLRTYYLSFWYFITFGSFVAFGIFLPKYLVDHYELTTVDAGIRAGIFIAIATFLRPLGGIIGDKIDAVKALKVDFLFMIIGAIILGIANDMILFTVGCLTVSVCAGIGNGLVFKLVPQYFQKEAGVANGIVSMMGGLGGFFPPLVITYVTSITGTSHLAFIFLALFGVLALVTMWHLSKKNRSLAYK

SEQ ID NO: 17605 - protein, 258 aa, Gibberella moniliformis
MSKLPSATRTLVAPKKCLPAEYTVIEQPIPKITKPNQLLLRMKAVAINTGETGFAAGHFPILFGIEGSGVVVEIGSEITEFKVGDAVYGMEFEKPHLSRPPAAWASTYALTEPQFLHKKPDHVSFEEAAAVPALAVTAYQGIKRGLQLQGRDSLAGQTVYIPAALSASGNTAIQIARNYFGAEKIISTVSTPKMGLVEEYLPGMVTQLYDYKTQDIVQLIGRGTVDFAISTQFSTLNESISVLKNRRHPHEHRQHPQK

SEQ ID NO: 17606 - protein, 493 aa, Gibberella moniliformis
MDTLTHVLVLPEALERLDSPSIIIPRTANTSEEVVPYAHLTDLTQSLQHDLATLGISVGSKVAIVLPNGLAFVTVLLATIRQRAISAPIHPNSTREECKQIFSLMTPDLVAVMPSEASPAAAAVLAAQDLGLPVASCHRYPQSGRLSFCLALKLVNRGDETSNPSPCMVYSRDHVLAEDKVLELFTSGTTGAPKSVQLTHTNILVAMRIITSAHKITFKDRSFLITPLFHIIGIAGSLLPTLFTGGCAVIPASLPATFWQDCQDYSITWYHAVPTLHHLLLSFPMPKGGVPATLRFIRSGGSDMSLDLFNRLQKLGVPLLEVYGMTETAPAIFCNPFPVTETSTAIKRHPGQYPIPDAVDVMILPPERAPGLEPNGDLDGIENTEPVARLTKELGVKGEICLRGKNIMAGYTNNPAANREAFLPNGFFRTGDLGVIKPRQYLALIGRVKEIINKGGEKISPAEIEHVARLHDQVNDAACFRISDEIYGEVIGT

SEQ ID NO: 17607 - protein, 369 aa, Gibberella moniliformis
MSRGQELVLLTGATGHVGYAVLVKTLQAGYNVRATLRDMSRADAILSSGPVQEALSAQDLDLSFVRVPNFTAPDAFGLVLSNVTHVVHVASALRRGTSTDLKEAIIDVAVQGTRNILRAAHNCPSVRRVVITSSVSAIVDQHPVVSQSPAGRCVTPLDRHADYDAEYYKGDSLKAYTAAKTAALNATDAFLATADGGPTTLPLHFDVINIMPSFVFGPKGLAATPSDVTNGSNIFGIGLVMRHKPWDGIRLEAVCCHVDDVAQVHVNALNDHELLPLKVGAHRDFILGVKFKPEEIGEIVRRRFPREWWESESATFGARGTYDWYHTDYDVGSAERLLGRPFKCLEEQIYDSGSQVMEMLKGMTTRSYN

SEQ ID NO: 17608 - protein, 444 aa, Bacillus subtilis
MSSYLIKPELSSAYPVVSYAKGSYVYDQTGKKYLDGSSGAVTCNIGHGVRDVTEKLKEQLDQVSFAYRSQFTSEPAEQLAALLAQELPGDVNWSFFVNSGSEAIETAMKIAIQYWQEKKQTQKSIFLSRWSSYHGITLGALSLSGFYERRYRFTHLIERYPAISAPHIYRLNHETEEDFVQTAADELDTMIKRIGSQFIAGFVAEPIIGAAGAAITPPPGYYERLSEVCRTHDVLFIADEVMTGLGRTGRMLATEHWDTVPDIAVLGKGLGAGYAPIAAAVVSDSIIETIKQGSGVIMSGHTYSAHPYSAKAALEVLRYVLKHGLIKQSEKKGAVLKKKLDEAASQSGIIGEVRGKGLLLGIEFVQTKKRRKCFRQQQAITQLIVSEAKKRGLIVYPSKAGIDSGEGDAVIIAPPFTISDGEMEELISIFSETVAAVEKNLKKD

SEQ ID NO: 17609 - protein, 210 aa, Paeonia lutea
IVESVGEGVTDLKPGDHVLPVFTGECKECRHCKSEESNMCDLLRINTDRGVMLNDGKSRFSINGQPIFHFVGTSTFSEYTVVHIGCVAKINPEAPLDKVCVLSCGISTGLGATLNVAKPKKGSSVAIFGLGAVGLAAAEGARIAGASRIIGVDLNPKRFEEAKKFGVTEFVNPKDYNKPVQEVIAEMTGGGVDRSVECTGSIMAMISAFE

SEQ ID NO: 17610 - protein, 214 aa, Paeonia rockii
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYNKPVQEVIAEMTGGGVDRSVECTGSIMAMMSAFECVHD

SEQ ID NO: 17611 - protein, 382 aa, Escherichia coli
MFKSDAARTRQRLSARKGRTLPPGRGKFPHSTTESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLESDQSAAICEELANFDYLYLSGISLAILSPTSREKLLSLLRECRANGGKVIFDNNYRPRLWASKEETQQVYQQMLECTDIAFLTLDDEDALWGQQPVEDVIARTHNAGVKEVVVKRGADSCLVSIAGEGLVDVPAVKLPKEKVIDTTAAGDSFSAGYLAVRLTGGSAENAAKRGHLTASTVIQYRGAIIPREAMPA

SEQ ID NO: 17612 - protein, 472 aa, Arabidopsis thaliana
MTSNNKKKKTELCDLPKCLAPHILSWLPTKTAVTVSLLFMKGWWRSEMKNLSSLKFSFSDDQEEEHFVRFVDQVLRQRGNRKLDSFSLTLNDEIDGGFVTHLVDYPLDNGVEKLKLSIYDIKGNFQLSSRVFSQATLVTLKLATNRSLIWINGDDVAAAHLPCLKTLWLDDVLVADVKVFVRLLSRCPILEELVMIDMKWHNWEACFVVSASLRRLKIVWTDYVEMDEYDRCPQSVLFDTPNVLYLEYTDHIAGQYPLLKFSSLIEAKIRLEMIDEKEEEDEGQEVIVGDNATAFITGITSVRKLYLYANTIQVLHHYFDPPIPEFVYLTHLTIQSDKELGWDAIPELLSKCPHLETLVLEGLFHLATDVCGDVCPCRRNMEQAISYLVKSPVTHLEIYEGVVGKKRGEVTEDAARFGEQVRWFLMRMLHLQQVKIYGQTEDSVTALYDIATELRRLEGKASPNVQISVLQA

SEQ ID NO: 17613 - protein, 482 aa, Arabidopsis thaliana
MDFGRSRDIISGLPDSLLCHILSFLNTKEAASTSVLAKKWRYLFASVPNLDFDDSVHLRLGKRNPAVSDQVLRLQDNSPLHKFSLKIRDCVDIVRIICWILKVLERGVSDLELDMHLKWKSSLPSKIFLSETLVRLKLSVERGPFIDVEDVHLPKLKTLHIVSVKFEKHGIGLNKLLSGCHILEELNLEYISWCLWDFVSVSLTTLKRLTFCGEVMQDENPISVSFNTPNLVYLMFTDAIADEYSTVNFDSLVEAHINLQMSEDQVEQTRFSDSEGNMEGCMVANATELIMGICNVKILYLSVYTLEVLTYCCEAIPLFNNLTHLTIESNSEVGWESVSGLLKNSPNLETLVFKGLVHRFTDKCGDMCLCKPWEEDEEEEEDEETPTCLSSCPVKVLKILEFGKIYDDEIEKRIDQVKHFLEKIPDIEQLILHYNTPVDEDVIKVYQQLRRHPKVASSKCKLQLISDNLSLSSKDCALFGID

SEQ ID NO: 17614 - protein, 183 aa, Arabidopsis thaliana
MDPAGASVASAIGGEGEKFAVGNIYSVKVITGDEFRGIVMAYDPIPNFGTKPRPGHLKNTRMVNASFITGLSYLGKTEDPLDSDNFSVDLNGLRAKEALAIRQAEADAERMGVGVTAEAQSIFDALSKTLPVQWENSDILVMKEVRVRSPYLSDCVFGGTDAANNRVKKVLELERRRLQLFGT

SEQ ID NO: 17615 - protein, 127 aa, Arabidopsis thaliana
MSKDENVESKETIRVDKRVREDEEEEEEKKIDTFFKLIKHYQEARKRRREELAENSGVVRRKSNGGERSGIVVPAFQPEDFSQCRTGLKPPLMFVSDHKEENTKVEQEEDQTEERNEDKALDLNLAL

SEQ ID NO: 17616 - protein, 1530 aa, Schizosaccharomyces pombe
MNQNSDTTHGQALGSTLNHTTEVTRISNSSDHFEDSSSNVDESLDSSNPSSNEKASHTNEEYRSKGNQSYVPSSSNEPSPESSSNSDSSSSDDSSVDRLAGDPFELGENFNLKHYLRAYKDSLQRDDIITRSSGVCMRDHSVYGVGSGYEFLKTFPDIFLQPYRAITEKQVVEKAILSHCHALANAGELVMVLGQPGSGCSTFLRSVTSDTVHYKRVEGTTHYDGIDKADMKKFFPGDLLYSGEHDVHFPSLTTAETLDFAAKCRTPNNRPCNLTRQEYVSRERHLIATAFGLTHTFNTKVGNDFVRGVSGGERKRVTISEGFATRPTIACWDNSTRGLDSSTAFEFVNVLRTCANELKMTSFVTAYQASEKIYKLFDRICVLYAGRQIYYGPADKAKQYFLDMGFDCHPRETTPDFLTAISDPKARFPRKGFENRVPRTPDEFEQMWRNSSVYADLMAEMESYDKRWTETTPASSEDPEKDNFGSDISATTKHELYRQSAVAEKSKRVKDTSPYTVTFSQQLWYCLARSWERYINDPAYIGSMAFAFLFQSLIIGSIFYDMKLNTVDVFSRGGVLFFSILFCALQSLSEIANMFSQRPIIAKHRASALYHPAADVISSLIVDLPFRFINISVFSIVLYFLTNLKRTAGGFWTYFLFLFIGATCMSAFFRSLAGIMPNVESASALGGIGVLAIAIYTGYAIPNIDVGWWFRWIAYLDPLQFGFESLMINEFKARQFECSQLIPYGSGYDNYPVANKICPVTSAEPGTDYVDGSTYLYISFNYKTRQLWRNLAIIIGYYAFLVFVNIVASETLNFNDLKGEYLVFRRGHAADAVKAAVNEGGKPLDLETGQDTQGGDVVKESPDNEEELNKEYEGIEKGHDIFSWRNLNYDIQIKGEHRRLLNGVQGFVVPGKLTALMGESGAGKTTLLNVLAQRVDTGVVTGDMLVNGRGLDSTFQRRTGYVQQQDVHIGESTVREALRFSAALRQPASVPLSEKYGYVESVIKLLEMESYAEAIIGTPGSGLNVEQRKRATIGVELAAKPALLLFLDEPTSGLDSQSACSIVCFLRKLADAGQEILCPIHQPSAVLFDQFDRLLLLQKGGKTVYFGDIGEHSKTLLNYFESHGAVHCPDDGNPAEYILDVIGAGATATTNRDWHEVWNNSEERKAISAELDKINASFSNSEDKKTLSKEDRSTYAMPLWFQVKMVMTRNFQSYWREPSILMSKLALDIFAGLFIGFTFYNQGLGVQNIQNKLFAVFMATVLAVPLINGLQPKFIELRNVFEVREKPSNIYSWVAFVFSAIIVEIPFNLVFGTLFFLCWFYPIKFYKHIHHPGDKTGYAWLLYMFFQMYFSTFGQAVASACPNAQTASVVNSLLFTFVITFNGVLQPNSNLVGFWHWMHSLTPFTYLIEGLLSDLVHGLPVECKSHEMLTINPPSGQTCGEYMSAFLTNNTAAGNLLNPNATTSCSYCPYQTADQFLERFSMRYTHRWRNLGIFVGYVFFNIFAVLLLFYVFRVMKLRSTWLGKKITGTG

SEQ ID NO: 17617 - protein, 1154 aa, Arabidopsis thaliana
MSIFFFFISFVVFSVADLPSCFSADQQYEECRSRNLTCGSGHRVFESTTYPFWGGFNKPKFCGHSSFKLSCEGDQNLTLAIGNITLRVVSANLEDHKISVADDSLLDGGCLNIWNFNGKNQFTLDSNTETIDVFVNCSGVAPLQISCEESYEDPVTYHVLRSSDSDEGCMKYAEIPMLRSAKDELQRSELTFVEALRKGFDLRYIMEDKACRRCIDSGGICGSALDSESFRCLCADRPHNSSCDDNTNQATQTLSLDPKFKACEPKSCGKGPQISYPFYLSGKQESFCGYPSFELTCDDEEKLPVLGISGEEYVIKNISYLTQSFQVVNSKASHDPCPRPLNNLTLHRTPFFVNPSHINFTILYNCSDHLLEDFRTYPLTCARNTSLLRSFGVFDRKKLGKEKQIASMSCQKLVDVPVLASNESDVMGMTYVEILKRGFVLNWTANSCFRCITSGGRCGTDQQEFVCLCPDGPKLHDTCTNGKNDKRRRVIVKVLIGLIAASIFWYVYHRRKTKSYRNSSALLPRNISSDPSAKSFDIEKAEELLVGVHIFSYEELEEATNNFDPSKELGDGGFGTVYYGKLKDGRSVAVKRLYDNNFKRAEQFRNEVEILTGLRHPNLVALFGCSSKQSRDLLLVYEYVANGTLADHLHGPQANPSSLPWSIRLKIAVETASALKYLHASKIIHRDVKSNNILLDQNFNVKVADFGLSRLFPMDKTHVSTAPQGTPGYVDPDYHLCYQLSNKSDVYSFAVVLMELISSLPAVDITRPRQEINLSNMAVVKIQNHELRDMVDPSLGFDTDTRVRQTVIAVAELAFQCLQSDKDLRPCMSHVQDTLTRIQNNGFGSEMDVVDVNKSGPLVAQSPDSVIVKWDKRDRNIQNFVIGPDRTKSAILYCYLLPTETIFLLVTIAMDIYSSITQAADLNNNNSNLHFQTFHPSSTSLESLFLHHHQQQLLHFPGNSPDSSNNFSSTSSFLHSDHNIVDETKKRKALLPTLSSSETSGVSDNTNVIATETGSLRRGKRLKKKKEEEDEKEREVVHVRARRGQATDSHSLAERVRRGKINERLRCLQDMVPGCYKAMGMATMLDEIINYVQSLQNQVEFLSMKLTAASSFYDFNSETDAVDSMQRAKARETVEMGRQTRDGSPVFHLSTWSL

SEQ ID NO: 17618 - protein, 240 aa, Arabidopsis thaliana
MSLFRIFINQLEEDDEDMATSKKMITREEWEKKLNAVKLRKEDMNTLVMNFLVTEGYVEAAEKFQRESGTKPEIDLATITDRMAVKKAVQNGNVEDAIEKVNDLNPEILDTNPELFFHLQQQRLIELIRQGKTEEALEFAQEELAPRGEENQAFLEELEKTVALLVFDDASTCPVKELLDLSHRLKTASEVNAAILTSQSHEKDPKLPSLLKMLIWAQTQLDEKAVYPHINDLSTAIGNQ

SEQ ID NO: 17619 - protein, 453 aa, Arabidopsis thaliana
MAPAPSPINSQHVAVIGAGAAGLVAARELRREGHTVVVLDREKQVGGLWVYTPETESDELGLDPTRPIVHSSVYKSLRTNLPRECMGYKDFPFVPRGDDPSRDSRRYPSHREVLAYLQDFATEFNIEEMIRFETEVLRVEPVNGKWRVQSKTGGGFSNDEIYDAVVMCCGHFAEPNIAQIPGKISKFSYTLFQKKLLVVVVIGNFASGADISRDISKVAKEVHIASRASKSNTFEKRPVPNNNLWMHSEIDTAHEDGTIVFKNGKVVHADTIVHCTGYKYYFPFLETNNYMRVDDNRVEPLYKHIFPPALAPGLSFIGLPAMGLQFYMFEVQSKWVAAVLSGRVTLPSVDEMMDDLKLSYETQEALGIPKRYTHKLGKSQCEYLDWIADLCGFPHVEHWRDQEVTRGYQRLGNQPETFRDEWDDDDLMEEAYEDFARLNLINFHPSRFLESGR

SEQ ID NO: 17620 - protein, 1270 aa, Arabidopsis thaliana
MNPREFISNLPDEILGKILSLLPTKLGVSTSVLSKRWRNLILLVDNFDLEDSSTSGFSAFLEQTVARLNTCPIKRLSLNGRHYRFSSADSWISTAFERGCLELHLQSQYLDTGILSSNTLVKLTLSDQIYLQGLVPHDGTVFFPALKTLSLGAVVADRDVYESLISGCPVLDELSIRDGCDDPPTWKKSVVNKSVKRLTVSFHHPMSAWAYEDNVWFKTQSLVFLDYSAFVSQGYTIVDRMDSLVEARLDLRLWVSTDSYDSDYEDKDFDVYRPYDVFGDVTSLVSGIRKVKTLHLSPDSLEAFFFCCNHMPVFNNLRNLSLESDEEKGWQALPLLLNNSLNLHTLSIKGLVHRVTSRCGDACACISERKTGMCCLSACRIKVLEITGYGGSFIELKQMRHFLGKLQCLETVRIGVERDGNNEHLRANLSSLHRASSECNIHFCGILNLVASVLAMTEVASSVVYEVLGRRAQDVDEPIMDYIINVLADEDFDFGEEGEGAFDAVGELLVAAECVSDFEECRLVSNHSQLVCSKLSDKFGKHGLVKPTPTVRSLAMPVRMNDGMDDGPVKKKKPEPVDGPLLTERDLAKIERRKKKDDRQREVYSNGSFFTGFELRICFLSCVYLLLQYQQHVAEMEAAKAGMPTVSVNHDTGGGSAIRDIHMDNFNVSVGGRDLIVDGSITLSFGRHYGLVGRNGTGKTTFLRYMAMHAIEGIPTNCQILHVEQEVVGDKTTALQCVLNTDIERTKLLEEEIQILAKQRETEEPTAKDGMPTKDTVEGDLMSQRLEEIYKRLDAIDAYTAEARAASILAGLSFTPEMQLKATNTFSGGWRMRIALARALFIEPDLLLLDEPTNHLDLHAVLWLETYLTKWPKTFIVVSHAREFLNTVVTDIIHLQNQKLSTYKGNYDIFERTREEQVKNQQKAFESSERSRSHMQVSFLLLENELINSVSNSSLAFIDKFRYNAKRASLVQSRIKALDRLAHVDQVINDPDYKFEFPTPDDKPGPPIISFSDASFGYPGGPLLFRNLNFGIDLDSRIASKKAPPLSLDYEITQMIHVYKPSSIICGNNKCSIKEHNFNLYIWFSRRFAVVGPNGIGKSTILKLISGDLQPSSGTVFRSAKVRVAVFSQHHVDGLDLSSNPLLYMMRCYPGVPEQKLRSHLGSLGVTGNLALQPMYTLSGGQKSRVAFAKITFKKPHLLLLDEPSNHLDLDAVEALIQGLVLFQGGICMVSHDEHLISGSVDELWVVSDGRIAPFHGTFHDYKKLLQSST

SEQ ID NO: 17621 - protein, 2025 aa, Arabidopsis thaliana
MESSLPQVAALDRSTLLKAFDETKTGVKGLIDAGITEIPSIFRAPPATLTSPKPPSSSDFSIPTIDLKGGGTDSITRRSLVEKIGDAAEKWGFFQVINHGIPMDVLEKMIDGIREFHEQDTEVKKGFYSRDPASKMVYSSNFDLFSSPAANWRDTLGCYTAPDPPRPEDLPATCGFLRPHYSLVCLKDFGGHFFREMMIEYSKEVMKLGKLLFELLSEALGLNTNHLKDMDCTNSLLLLGHYYPPCPQPDLTLGLTKHSDNSFLTILLQDHIGGLQVLHDQYWLITNDKFISVEHRVLANVAGPRISVACFFSSYLMANPRVYGPIKEILSEENPPNYRDTTITEYAKFYRSKGFDACLIRVLGTLIICVMPSFMTVKAMHETVTRSIFGYIIGLCVNSRQLNHLMFQVLLFISMDAKKLDTGPRDAINWLPDEILGKILSLLATKQAVSTSVLSKKWRTLFKLVDTLEFDDSVSGMGEQEASYVFPESFKDLVDRTVALQCDYPIRKLSLKCHVGRDDEQRKACVGRWISNVVGRGVSEVVLRINDRGLHFLSPQLLTCKTLVKLTLGTRLFLGKLPSYVSLPSLKFLFIHSVFFDDFGELSNVLLAGCPVVEALYLNQNGESMPYTISSPTLKRLSVHYEYHFESVISFDLPNLEYLDYSDYALYGYPQVNLESLVEAYLNLDKAEHVESPDVTKLIMGIRNVEILSLSPDSVGVIYSCCKYGLLLPVFNNLVSLSFGTKKTRAWKLLADILKQSPKLETLIIEDLNGYPLDVSMPLNQVKELQILEYGESDDERLQSRLESKNKLGSFDFEKFLFPIPPPIKITVSPHPSDSGGDGSNSKSSSDDEFVSLDSSTSGLCSSSGKFFDLIKFLIALSVLRETKTMESTKIAPSFDRASELKAFDETKTGVKGLVDSGISKIPRIFHHSSVELANPKPLPSDLLHLKTIPTIDLGGRDFQDAIKHKNAIEGIKEAAAKWGFFQVINHGVSLELLEKMKDGVRDFHEQPPEVRKDLYSRDFGRKFIYLSNFDLYTAAAANWRDTFYCYMAPDPPEPQDLPEICRDVMMEYSKQVMILGEFLFELLSEALGLNPNHLKDMECLKGLRMLCHYFPPCPEPDLTFGTSKHSDGSFLTVLLPDNIEGLQVCREGYWFDVPHVPGALIINIGDLLQASLRNQYMFASSDFTSLFTMLDLFKKSSSWFKLITNDKFISLKHRVLANRATRARVSVACFFHTHVKPNPRVYGPIKELVSEENPPKYRETTIRDYATYFNGKGLGGTSALLDFKQLVPSLNLRKMFHSCSVIREAKTMETKNIAPSFDRASELKAFDETKTGVKGLVDSGISQIPRIFHHSSVKLANPEPVSSDLLHLKTIPTIDLGGRVFEDELKHKNAIEKIKEAAEKWGFFQVINHGVSLELLEKMKDGVRGFHEQSPEVRKDFYSRDLTRKFQYSSMSPFLILDLMCNLYSYMVNCFRDVTIEYSEQVMNLGEFLFTLLSEALGLNPNHLNDMDCSKGLIMLCHYYPPCPEPDLTLGTSQHADNTFLTVLLPDQIEGLQVLREGYWFNVPHVPGALIINIGDLLQASLHNQYIFLLCFAELITNDKFVSLEHRVLANRATRARVSVAETKTMEMMKIDPLFDRASELKAFDETKTGVKGLVDSGVSQVPRIFHHPTVKLSTPKPLPSDLLHLKTIPTIDLGGRDFQDAIKRNNAIEEIKEAAAKWGFFQVINHGVSLELLEKMKKGVRDFHEQSQEVRKEFYSRDFSRRFLYLSNFDLFSSPAANWRDTFSCTMAPDTPKPQDLPEICRDIMMEYSKQVMNLGKFLFELLSEALGLEPNHLNDMDCSKGLLMLSHYYPPCPEPDLTLGTSQHSDNSFLTVLLPDQIEGLQVRREGHWFDVPHVSGALIINIGDLLQASSLMHFCSVLHCITYLPYCSFLGFVVLMQLITNDKFISLEHRVLANRATRARVSVACFFTTGVRPNPRMYGPIRELVSEENPPKYRETTIKDYATYFNAKGLDGTSALLHFKI

SEQ ID NO: 17622 - protein, 480 aa, Arabidopsis thaliana
MEAKIVKVSDSSYKDGLGKKRKHPGNYTPYDSGRSYAKLQWVLSPNSSTQKLEKRRNLDGENKVIVSENHVEKSLVRYFSYYKKTGVPKRVMFHENGEWIDLPDHILCDIRNDLEAKRATIEFNWCGRHFLLDFLHMYRLDLETGVKTQLAWIDIAGKCFFPETFDTLERDGCHHIRGEDPEQHDQREIKLHIEIDVNSGELPRLNLNVVTDESGDNMDDFQAVQRSSNGPNDEASEDSCSRELDDAVEKWDKTETDRFSGVKPAEEELDKDAVKQMFALGAATLGHVESLDVYQFSSEIAKARLSLFQKQADITKKHRGDANIRYAWVPAKKEVLSAVMMHGLGVGGAFIKKSMYGVGVHAANCPYFSARYCDIDDNGVRHMVLCRVIMGNMEPLRGDNTQYFTGGEEYDNGVDDVESPKHYLIWNMNMNTHIYPEFVVSFKLSIPNAEGDYHLSQEGYQMEVQGAKRIAPAVEGPDLL

SEQ ID NO: 17623 - protein, 2021 aa, Arabidopsis thaliana
MSTEDEKLLKEAKKLPWEDRLGHKNWKVRNEANVDLASVFDSITDPKDPRLRDFGHLFRKTVADSNAPVQEKALDALIAFLRAADSDAGRYAKEVCDAIALKCLTGRKNTVDKAQAAFLLWVELEAVDVFLDTMEKAIKNKVAKAVVPAVDVMFQALSEFGSKVIPPKRILKMLPELFDHQDQNVRASAKGVTLELCRWIGKDPVKSILFEKMRDTMKKELEAELANVTAGAKPTRKIRSEQDKEPEAEASSDVVGDGPSEEAVADAPQEIDEYDLMDPVDILTPLEKSGFWDGVKATKWSERKEAVAELTKLASTKKIAPGDFSEICRTLKKLITDVNLAVAVEAIQAIGNLACGLRTHFSASSRFMLPVLLEKLKEKKQSVTDPLTQTLQTMYKAGCLNLVDVIEGKNVKTAVKNKVPLVRSSTLTWLTFCLETSNKALILKAHKEYVPLCMECLNDGTPDVRDAAFSALAAIAKSVGMRPLERSLEKLDDVRKKKLSEMIAGSGGGDQAGTSSVTVQSSVGSTATGCLHNRYTTSKFMQNSDASFVRKSAASMLSGKRPAPSAQASKKVGTGKPGGGKKDGSVRNEGSKSVEPPEDVEPAEMGLEEIENRLGSLVKPETVSQLKSSVWKERLEATLALKEEIEGLQELDKSVEILVRLLCAVPGWNEKNVQLFSFENYFFSNLPDFSINSLGTSERVADIKTRASAMKCLTAFCEAVGPGFVFERLFKIMKEHKNPKVLSEGLLWMVSAVDDFGVSLLKLKDLIDFCKDVGLQSSTAATRNATIKLLGALHKFVGPDIKGFLNDVKPALLSALDTEYEKNPFEGTAAPKRVVKTSVSTSTSSGGLDSLPREDISTKITPNLLKGFESPDWKMRLESIEAVNKILEEANKRIQPTGTGELFGGLRGRLLDSNKNLVMQTLTTIGGVAAAMGPAVEKASKGILSDVLKCLGDNKKHMRECTLAALDLWLGAVHLDKMIPYIIIALTDGKMGAEGRKDLFDWLTKQLTGLSDFVDAIHLLKPASTAMTDKSADVRKAAEGCISEILRVSGQEMIEKNLKDIQGPALALVLEKVRPGFVQEPFESSKAMAGPVSKGVTKISKSTSNGTLKQGNRSRAVPTKGSSQITSVHDIAIQSQALLNTKDSNKEDRERVVVRRIKFEELRPEQIQDLENDMMKFFREDLQKRLLSPDFKKQVDGLEILQKALPSVSKEIIEVLDVLLRWFVLQFCKSNTTCLLKVLEFLPELFNTLRDEEYCMTEAEAAIFLPCLAEKLGHNIEKVREKMRELMKQIIQAYSVGKTYPYILEGLRSKNNRTRIECTDLIGYLLETCGTEIGGLLKYLNIVASLTAERDGELRKAALNTMATGYQILGADIWKYVGKLTDAQKSMIDDRFKWKVSSKYEPFFCFRLAKDMEKRREGKPGEARAALRRSVRDSGCVGAEKESMMGLVSIIYDFLFVSRPEVAEQSGDISQTVPGPLFPRQSYGISEQMLERTPVPRTIAGVNGPTDWNEALDIIMFGSPEQSVEGMKVVCHELAQASNDPEESAIDELVKDADGLVSCLANKVAKTFDVSLMGASSRSCKYVLNTLMQTFQNKKLAHAVKEGTLESLITELLLWLLDERVPRMEDGSQLLKALNVLMLKILDNADRTSSFVVLISLLRPLDPSRWPSPATAEVYAVRNQKFSDLVVKCLIKLTKLLQSTIYEVDLDRLLQSIHVYLQDLGMEEIRRRAGADDKPLRMVKTVLHELVKLRGAAIKGHLSLVPIDMRPQPIILAYIDLNLETLAAARMLTATGPVGQTHWTDSTANNPSPPANSADVQLKQELGAIFKKIGDKQTSTIGLYDLYHITKSYPKVDIFSQLQNASEAFRTYIRDGLAQVEKNAAAGRTPSSLPLSTPPPSSLALPSPDIPSLSSLDVKPLMNPRSDLYTDDIRASNMNPGVMTGTLDAIRERMKNMQLASSEPVSKPLMPTNDNLSMNQQSVPPSQMGQETVHTHPVVLPMDEKALSGLQARMERLKGGSLEHM

SEQ ID NO: 17624 - protein, 377 aa, Arabidopsis thaliana
MAQILSPVCTDLLKFQNSALSSRSGASPRFSAKTTGASSSWYLPRYAGKRRTDSIGRLRVATEDASSLSTGDVADDYYAVLGLLPDATQEEIKKAYYNCMKSCHPDLSGNDPETTNFCMFINDIYEILSDPVQRMVYDEIHGYTVTAINPFLDDSTPRDHVFVDEFACIEAACFDDLESDYICVWCLTGCKNCANVAPDIFQIEEDFGRARACNQRGNPDLVQQAVETCPVDCIHQTSAAQLSLLEDEMRRVERVNLLELSLIDQVALMLSGMGSGAVDVFRMARSRWEKRQAKVLNQARSRMMKRKNTDETPSYWDNLWGKQNEYQKSGKIDDKEEVQERAQRAAAAARRWREYSRRGVDKRPTFKLPDSASRGDN

SEQ ID NO: 17625 - protein, 243 aa, Cyanidioschyzon merolae
MLIAYLTAGAPDINTTKEAVMKLAKKGADVIEIGVPYSDPLADGAILQKASKQALMNGFHLDHLWNLLSEVNEIEVPLVILAYYNQIWHYGVEKWVKKLVAHYVKGLIVPDLPYEESKTLRQICDRYGLNIIWLISPTTNKTRAQELARACKDWIYVISRTGVTGLETEFDKQIPKLIGELKKVTKAPIALGFGISKSEQVKLVKSWGADGVIIGSACMQILLEKGVDQLSEWISVMKKSFCP

SEQ ID NO: 17626 - protein, 394 aa, Pseudomonas syringae
MLKMSGLSASEARGDGAWVEDTQGGRWLDFGSFGVHLLGHSHSGVVSALVEQIQRFGLSDENLSNEPIVLAAERLLVMAGPEKDKVIFGNTGSEVVEAALKLARIVTGRRRVIAFEQAYHGRTAAALSVSHGYMRHAGLLTEGDVVFCPIDDLDAVANALEAGDIAAIIIEPIQGEGGIRPVENEFLRGLGDLAQAFDCRLIFDEIQTGLGRIGSLRVDVPCDILLLGKVLGGGVFPISAALFTSKRFDAAARDPVVHASSFAGSALAGAVVNAVLDVVSAPDFTLRVQRLGDRVLSYLGQRLADNPLITDIRGQGLMIGVEFKRLDHVGEMIIEAAKRDLLLAFCLTDPKVLRLYPPAVISDADLETGLEHFCQSVEAITRTEFDKEIPLCQQ

SEQ ID NO: 17627 - protein, 318 aa, Diospyros kaki
MESFPVINMEKMNGEERAATMGLINDACENWGFFELVNHGIPPELMDTVERVTKAHYKKCMEQRFKELVASKALEGIQAEVTDMDWESTYFLRHLPQSNISEVPDLDEEYRRVMKDFAERLEKLAEYLLDLLCENLGLEKGYLKKAFYGTKGPNFGTKVANYPPCPKADLIKGLRAHTDAGGIILLFQDDKVSGLQLLKDDQWIDVPPMKHSIVINLGDQLEVITNGKYKSVLHRVVAQTDGTRMSIASFYNPGNDAVIYPAPALVEKEVEEKEVYPKFVFDDYMKLYAALKFQAKEPRFEAMKAVEANVNLGPIATV

SEQ ID NO: 17628 - protein, 493 aa, Prosthecochloris vibrioformis
MDKILYDALTFDDVLLVPAYSNVLPKETVVKSRVTRNIEVNLPLVSAAMDTVTEAELAIALARAGGIGIIHKNLSIDVQARHVAKVKRFESGIIRNPITLFEDATIQEAIDLMLRHSISGIPVVERPTPEGCLLLKGIVTNRDLRMTTSSNEKITTIITTDLITAQEDIDLLAAEEILMQNKIEKLLVIDEEGYLKGLITFKDIQKRKQCPDACKDMHGRLRVGAAVGIRSNTITRVDALVEAGVDVVAVDTAHGHSQAVLDMVATIKEKYPELEVIAGNVATPEAVRDLVKAGADAVKVGIGPGSICTTRVVAGVGMPQLTAIMNCAKEAAKTDTPIIADGGIKYSGDISKALAAGADTVMMGSIFAGTDESPGETILYEGRRFKAYRGMGSLGAMSEPEGSSDRYFQDASAETKKYVPEGIEGRIPQRPLDEVVYQLIGGLKSSMGYCGVKNIEELKKNTRFVRITSAGLRESHPHDVMITREAPNYSTSH

SEQ ID NO: 17629 - protein, 214 aa, Paeonia anomala
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAEKFGVTEFVNPKDYNKPVQEVIAEMTDGGVDRSVECTGSIMAMISAFECVHD

SEQ ID NO: 17630 - protein, 379 aa, Clostridium acetobutylicum
MKSTKILILGAGPAGFSAAKAALGKCDDITMINSEKYLPYYRPRLNEILAKNKSIDDILIKKNDWYEKNNIKVITSEFATSIDPNNKLVTLKSGEKIKYEKLIIASGSIANKIKVPHADEIFSLYSYDDALKIKDECKNKGKAFIIGGGILGIELAQAIIDSGTPASIGIILEYPLERQLDRDGGLFLKDKLDRLGIKIYTNSNFEEMGDLIRSSCVITAVGVKPNLDFIKDTEIASKRGILVNDHMETSIKDIYACGDVAEFYGKNPGLINIANKQGEVAGLNACGEDASYSEIIPSPILKVSGISIISCGDIENNKPSKVFRSTQEDKYIVCMLKENKIDAAAVIGDVSLGTKLKKAIDSSKSFDNISSLDAILNNL

SEQ ID NO: 17631 - protein, 489 aa, Nostoc sp. PCC 7120
MTIDYDVVIIGGSLAGRYAALTATQMGAKVALVESQLNNSLIVHQAIGEIANLTQNLHNLAGCGIDAVHPDTSEKCQISLKWAAALFSAQGIAANVQEQMSLAHLSAQGVDVIVDSGQFQRSPHLAFVVGQRLLRGRTYLLASGSLPAIPKIEGLQATDYLTPANIWQYLYKQHSPSSELPQNWVIIGGTPQSIEISQTLARLGCSITLVVKSLHLLPQLDPEIAQLLQAQLEIDGVRILTQKMVTQVKRIDDKKWVQAGEKAIEADEILVAIGQKPNIESLNLPEVGVKWQQHRLLVNEKLQTTNHRIYACGDVICGYDLPNVANYEARIALNNALFLPRLQVNYQNTPWAILSHPTLAQVGVTENQAKRQFSQQEVIVLRHYYKSIAAAQLKNEITGICKLVVLGNGKILGATIFSTQARELINLIALAMSRNISVKHLGNLSAVYPSFSELLEQTARDFSQHRFNNNTAWQDWLENLFYLRRNWNL

SEQ ID NO: 17632 - protein, 358 aa, Nostoc sp. PCC 7120
MYDNMSSPLFPVILAGGKGERFWPLSRQDRPKQFLSLDGSSRSLLQSTAERLVKFAGEWNDLWVITSSQLGQGVQQQLPELPSQNLLTEPQGRDTAAAVAWASLEIQKRYGDDAIIGFFPSDHWIADPEAFKRTLDAASQLATSTEAIVTLGIKPTFPSTGYGYIEQGEKIGTFNELPAYHVNRFTEKPIREKAESFLSTGRYSWNSGMFVFRAGVVLKELYTYAPEIIEPLVKHGVDVYPQLPKQSIDYALMEKTNLVYVLPADFGWDDLGDWNAIERLLKKPDNPNVELATHVGLDTQGAIVYATNPEDVIVTIGLEDVVIVRDRNVTLIVNKERTQEIKQILKTLQSDPRFTDLL

SEQ ID NO: 17633 - protein, 228 aa, Nostoc sp. PCC 7120
MCPSPQQPSHITKSPRDVLDSIFAFPPNRDTLGGTSYLIVGNEGNILIDCPALDQTNLNFLRSHGGVRWLFLTHRGAIGRTAEIQQNYGCDILIQEQEAYLLPGLTVTTFTQEFAVTPTAKAIWTPGHSPGSSCLYYNHQGGVLFSGRHLLPNQKGEPVPLRTAKTFHWPRQIKSLQTILETLTPETLQYICPGANTGFLRGKRSIDTAYQRLASLDLKALLQTQPLI

SEQ ID NO: 17634 - protein, 431 aa, Nostoc sp. PCC 7120
MLSIPINQHLPYTPRLVTSLPGPRAKAIVERDRAVTSPSYTRDYPLVVNRGEGCMVEDVDGNVFLDMTAGIAVTSTGHAHPEVVRAIQEQSARLIHMSGTDFYYEPMVELAENLASQAPFVHDTKVFFTNSGAESNEGAIKLARYYTKRSLIIAFLGAFHGRTYGAMSLTGSKTVQRANFGPLVPGVTHIPYGTHASLDYLENNLLTTIIPAHEVAAIVVEPIQGEGGYIVPEDGFLQRIRNICDRYGILMVVDEVQSGMGRTGRLFAIEHWNVTPDIITTAKGIASGMPLGAILARAELMTWPPGSHATTFGGNPVACAAGIVTLKLLESGLMDNATQMGELLQTGLTQLHEQFPRMSLPRGKGLMVAVDLLDEDGNFDSTLRDRIIQEAFYHGLLLLGCGKAAIRFCPPLVINREQIQTSLDILAGILR

SEQ ID NO: 17635 - protein, 1206 aa, Nostoc sp. PCC 7120
MINRQRQILSLTPHHAATLVDVLRAWTQQKGDAVGFAFWQDDKQVHLTYTELDHKARAIAVHLQAMRWQGERVLLMYPPGLELIAALMGCFYAGLVAVPVYPPRPNNNITRLLSIGEDAQAKGILTKVSLENSLKQVSKNTAFEALPKVATDSIILSVGEAWQNPQLTADSLALLQYTSGSTGTPKGVMLSHGNLLHNLGQIYQRFGHSANTHVVSWLPPYHDMGLIGGILQPLYGGFPVTLMSPVAFLQKPLRWLQAISQTQATTSGAPNFAYEMCVRNIRLDECLDLDLSSWELAFTGAEPIRQETLERFATTFKTYGFRREAFYPCYGLAEATLFVTGKNKDEIVFNHTSQSLVSCGSPSDDQTIIIVNPESREPCAAGEEGEIWLKGASVAQGYWQNPQETKATFQGALASGTGGFLRTGDLGYLNSGELFVTGRIKDVMIIRGQNYYPHDIEAAVSQCHPALSAYWGAAFSVEVDGEERLVVVQEVERSSWRRLDEDGIIAAIRGAVSCEFGLQVYGICLLKPGSIPKTSSGKVQRFACREGFVCGGLDVVFGWELAHAEAQRRREERGEEKEKIVDGLIGWLRDYANHHINSRLMDERRCISPHVVLDFGNKGLLGMQVPSCYGGLGLGYTDTIRIIQQLGAIDPTLALFVGLNNVLGVRPILMYGTDALKAELLPILATGRELAAFALTETGAGANPQAIQSQAISDGDGWLLRGEKIWSGSAAWAGVINVFVKHQQGISGFVVRRGSPGLRQGAEALTMGMRGMVQNTVYLEDIPVTSAQVLGEVGKGMNVAQDAMMYGRLAIASACVGGMQRCVQLMWRYSQRRQIATGKLLDHPIVLHRLQELTCAITVVQSLVMRVGKLLDAGETVPAEVYAACKISAPEFYWQAADLLVQTLGGRGYIESNIAPQILRDARVLRIFEGPTETLCGFLGARVLKQGETLQNFLCQTLGAVEVGTRLRDAVDKIRGRCFDGANITVQRWVYHQVGKLATEAILWAVLDDKSAINWVKHRFDEQLQEILSFNTDNLLFLNGQSLVHHLNEYTKTIGDIEQNLAGEAQELDELLRQSGENPQFIPTTADLPASSEIQTWLKTWISQKLRQPISTIDVNRAFAEYGMDSVTAIELTQDLQEWLKISQPLDATIAWNFPTINALANYLGEVTKENAVPSDNNLDDLSTTDIAQLLSQEIAIARHRKPQMK

SEQ ID NO: 17636 - protein, 2478 aa, Nostoc sp. PCC 7120
MRVTTDSAPLCVYLRAPLRLKNPMTNSPNYQTLLKDALVEMRQLRAEITALEAQQTEPIAIIGMACRFPGGANNPEAFWQLLRDGVNAVGEIPDARWDIEKYYDANPDTPGKMYTRYGHFLDKVDEFDAQFFGISPREAQSLDPQQRLLLEVSYEALERAGQSPAKIKGSQTSIYIGLCFDDYAKHSLSHPTQIDAFSSLGNTRSIAAGRIAYVLGLQGTVMQLDTTCSSSLLGVHLACQSLRNGESDMALAGGVNLILSPEPMIGFCKLKALAVDGRCKTLDAAADGYGRGEGCGIVVLKKLRDAIANRDPILAVIRGSAVNHDGSSNGLTAPNGTAQEAVIHQALQNAQVEPHQIQYSELHGTGTVLGDPIEVLALAKVLGEGRSKNQPLSIGSVKTNIGHLEGAAGVAGLMKVILALQHQQIPAHVNFQQPNPYIPWQKLPLTVPTQLTPWQSANSQRLAGVSSFGMSGTNVHLILEEFTPVPNSQQDTGYQLLTISAKTPQALRELVGEYIKYFASQPEDNLDDICFTSNVGRSHFPYRLTIPANSYNSVYEQLSNYLNNTAKTFDSQLIPPNTLKIAFLFTGQGSQYLNMARELYDTHPYFRQQVDKCCELLHPYLDVDLREILFTPETPNSSNYELRITNYELSHTIYTQPALFVIEYALTQLWRHWGVTPDFLIGHSLGEYVAACIAGVFTLPDALKLIAHRARLMQQLPENGKMLAVSASATEIAEYIQAYSENVGIAAINSPENTVISGEQTAIAQLAEILQNQGIKTTPLSVSHAFHSPLMETMVEEFRQVAESITFHPPKTPIISNITGTVIGEEIANAEYWCHHILQPVQFALGIETLAKDNCKIFLEIGVKPTLLSIGKTCFPDAENYSWLPSLRPRQSDRQTILSSLASLYMQGIDINWENFTDNQPHQRVILPTYSFQRQRFWVDKPEFTPPYPTPNLHPLLGQKLKLAKSEKIYYQNKISPKKPDFLQQHQVQSNSIMPAAGYIEIAITAAEQIFPSHSYNLQNIQIIQPLPTTQEITLQLILTPLEKQTYQFEILSLCAFAPLREKETTHATGIIQTSPPLPNSPQLPTTCTQKIDPTTYYQTCQKLGIEYGKYFQAIQQLWRGENQALGEIKLSPEIDTTPYQIHPIILDACLQVTGAIFLDSQPLTAYLPIAIEQFQWYGEKHQTHLWSYVKLRERYIADIQIFNANNKLIATITGLKIQPVKQLNNWQDWLYSIAWKENPLTYHHLLTPTKVSNSSILNQSELDNYLSLSSQLEKLSIACILQTLQAGEELSIVTQHKKLYQYLLQILQNQEQRETPLSFTQLRQTYPNATSELNLLKRCTSHLAEVLQGKIDPLQLLFPNGDFSDLTHLYQNSPIAKMMNTLVKQAITTAITDIPPEQPLRILEIGAGTGGTTAHLLPELAQRNIEYFFTDVSPLFLSKAQQQFADYSCVRYQLFDVEKPPTTQGFTENSFDIIIAANVLHATEDLRQTIIHIKQLLSRGGLLILLEGVQPVWWLDLIFGLTEGWWRFQDYDLRPHHPLISSEQWQKLFTQEGFDSTTLLETIGNQAVITAQTPKLPDNCVILADKQGLGEKLATHLQTQGVTCHLIFADSQPPTLPTPASHLINLWGLDVPHPDELTTAELIKQQQILCESLLYSLQNNIKYQQLPQWWLVTQGAVNTDQDTSIKGLAATTLWGISKVIQLEHPEINCHCLDLDPNHTPIEQLDILLKELLTNSPEKEIAWRTNIRYTPRLSQNSLCVSAPLREKNNSLMQRLTIPQRGTLENLTFQTVNRTSPNPGEIEIRIQATGLNFRDILNALDLYPGEPGMLGCECVGEIVAIGTDVKHLQIGQTVIALASGSFSQYVTIKAAMASPAAGIAIPLPQNLNIIDGATIPAAFLTAFYTLRHLAKIRPGDKVLIHAAAGGVGQAAIQIAKLAGAEIFATASPQKWETLRNLGVTKIFNSRTLDFAEEILTQTQGEGVDIVLNSLRGDFIAASFAVLKPQGRFVEIGKIDVWTEEQVKQVKPNANYFLVDLVDLCQQQPELIQNMLKQLVEEFEQHRLQPLAAKVFPMNQIVDAFRYMQQGKHIGKVVVDWGLGNSLYPLKENCTYLITGGLGGLGLLVAEWLVKMGACHLLLLGRNAPTADAVSKIQELETTGARIAIAQIDVSQTAALSNILTQIENSAYPLAGIIHAAGVLDDGALLQMNWERFQKVMAAKVMGAWNLHTLTQHLPLDFFVLFSSATALFGSPGQANHVAANTFLDTLAHYRHTKGLPAMSINWGIWSEIGSATQATKQMQQRGIEAIAPADGIQILQHLMTQPLTQIGVVPINWQKFPINSPFFENFYPTNNPETRQTPPPKTDLLEKLSQLDKQTGYELLETYLQEQIAKVLGFPPHEINPQTGFFDLGMDSLTAIEFKNRLQTDLKITLPSTIAFDYPNIQTLAHHLNNQLQPTPEPQTEPSTAEIAQLLAQELEQLN

SEQ ID NO: 17637 - protein, 303 aa, Anabaena sp.
MTQAKAHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNEKTHTYICGLRGMEEGIDAALSAAAAKEGVTWSDYQKDLKKAGRWHVETY

SEQ ID NO: 17638 - protein, 361 aa, Rhizomucor miehei
AAADGSVDTPGYYDFDLEEYAIPVSIGTPGQDFLLLFDTGSSDTWVPHKGCTKSEGCVGSRFFDPSASSTFKATNYNLNITYGTGGANGLYFEDSIAIGDITVTKQILAYVDNVRGPTAEQSPNADIFLDGLFGAAYPDNTAMEAEYGSTYNTVHVNLYKQGLISSPLFSVYMNTNSGTGEVVFGGVNNTLLGGDIAYTDVMSRYGGYYFWDAPVTGITVDGSAAVRFSRPQAFTIDTGTNFFIMPSSAASKIVKAALPDATETQQGWVVPCASYQNSKSTISIVMQKSGSSSDTIEISVPVSKMLLPVDQSNETCMFIILPDGGNQYIVGNLFLRFFVNVYDFGNNRIGFAPLASAYENE

SEQ ID NO: 17639 - protein, 1182 aa, Cryptococcus neoformans var. grubii
MFVTRPPSSSVDHRGSLLDGHTNHTNTPGSSRDDVPSSDSTSTAFHKFKNSSRFSPHYLNIPPGLAFKSYLEKWGPEQVIGFLAIHGCEHHSGIFIKNSIDGKLLLDLDMGILTSLGITKVGERIRLMAGIKCLRQRVAHEAEKHNIPSAHLCNGSLEMDRVKVIIHPKLSASLYVHRHGPFDSGPITARRCPLTPSSSADPEGDPSPMQRSQEVMKHSFITRSSRRQVIPPLPPGQIHNHGIDNSPMPSLRHIPLRSGVSYSDIDVKGMPPLVTQSTNSVFNHTFAVTGSHDTTSCLGGHLRRPDYFRSTNDTFQTCTKRGDNTISELPQRNQESSPSMWKQSGVICEDKAMRNGSLFAPTSHKPFAISITGDNVMEYPHNLPIKNGLPLRSFQSPDKSADDDRLNINPSAPSLDDLRRQLVKFVNAEDGTTRTVNVMKTTSGVEVLERALRKFGKTGTGRALLLDDESHNGGKHEGPLCIDGWGVFAENLQGEEMGPMSEEDLLDICASLRNGAAMQRDALILRQTSKSQKRKDMRFYLGSMPVLPTPVNLPISFSSSHSGQFEQNSALQYTAQHQPLRSKNRSRASMMSIMSGLGVSHPDIKQPTHDSLQSPASVTMPSSKKKSMYNFFGHRPPSELISSHLTDYFPSAKKRDVAKARGSMLRLNIAHSAERNPRSVENLGMIEADDVPFSSTEQSLTEQRDHYFDSSTCQPADTSSPGHVDHNITDPAGNSEGNYRLPYDQKVLPTPITQELHSANSVNPILRTYPPNLPSTYLSARLTDLHRDSFLSQLQPLQHSSSLSSAQPFSSHRRTVDEITAEMQHRQTSLSCDRPTSTIDSDISGPPCNSEISLDHTSEASGISESSSEYCDDHSSVSSEDSEDNSAAHTRAFTTKRNIKWIKGALIGAGSFGSVFLGMDAQSGLLMAVKQVELPRGIAKMEARRRDMLSALEREIELLKDLQHDNIVQYLDSSMDANHLNIFLEYVPGGSVAALLNNYGAFEEALAGNFVRQILTGLNYLHERDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPEIPSDISVHAADFLSRAFALDYRMRPSAASLLKHAFMVHDGNGGNDEPIQNTYA

SEQ ID NO: 17640 - protein, 511 aa, Cryptococcus neoformans var. grubii
MFARQPLSRNLLRPLSRPSSSFSRASTIPKLAFLQSARGFASASEPYDVVIIGGGPGGYVAAIKAAQLGFKTACIEKRGALGGTCLNVGCIPSKAMLNNSHIFHQTQHDLKNRGIDVSGIQLNLPKMLAAKEASVKALTGGIETYLFKKNGIDYIKGEASFETANKVNVKLLEGGETQVEAKNIIIATGSEVTPFPGLEIDEERIVSSTGALELKEVPKKMVVIGGGVIGLELGSVWSRLGAEVTVVEYLGAIGAGMDSEVGKQFQKILTKQGFKFKLNTKVVSGHREGDIVKLKVDSAKGGKEETIEADVVLVAIGRRPVTTGLNLEAIGVETDKRGRIIIDDEFNTSAKGVKCIGDVTFGPMLAHKAEEEGIAAIEILKSGHGHVNYDAIPSVVYTHPEVAWVGKNEEELKAAGVQYKIGKFPFAANSRAKTNQDSEGFVKFVVEKETDQVLGCHIIGPAAGELIASAVLAMEYKASAEDIARTCHAHPTLSEAFKEAALSSYDKPINF

SEQ ID NO: 17641 - protein, 1230 aa, Cryptococcus neoformans var. grubii
MNGFMPALRLHHTHSSSVSPTASNDAASSSPTSSQPHQLAAYSPLYATSPNRGSKITKGSSLSSSTAHHGLKYVRPSTSPLLKPPKGKSFSEYLGDWGSQELFTFLDIHKCGQYLAIFQENDINGKILLDLDVTALKSMGIDKISERVRLIGGIKDLRKRIADETIRAPFIQRCYPPERTLLPSLPSHSNVFLDKWDYSSSASRLGKGQIAFRPPPLDLQGHMPRKLLPHASQGIATIDTHDIRTTKPKIEAYIQQNPLGQPQSVPTKRSDSLTLCAPPSRNVRRRSPSSRHFEGRESQTDGFTILNMASDRQVPSSTMNSVTLGEDCHLQREEGLPLFLKVPQFRNTFASSHKTLIAGRGPLTRGDTISHQPSGPAIAGQDSPVNYRISKTVTTTKEASQGDLEHPFAVKSIGSQLGLLVGVSGMAHDPVTDGSKSKGKTSVPLTGTSSSDISAVNANSAALSLADLRRQLVKFINTEDDTIRTVNVMHVTSGEEILERALKKFGKWGTGMHSSPDVYGDEDGDETLEIDGWEVYTERTPDESSKPLSESSLLKTCTFHREGTAIQDKGLFLRKKQRLQKRKNIQHFFGETLPPPMSPTSPTLITGPHLGIVQGKSQLASEPAFSSSNRLSTLTNKGPNRASMISVMSGLGVPVINTLPSPQGNGLCPTGSVHSHKKKSMYNFFGHRPPSELISNHLADYFPSAKKSDVEKARHSLLRLSGDTVAYKKNGIDEGDNAPDHWSKPGNNQPPSLPPFEPSQDTLSDSLQAYASSTPVYLSRPKHNVALRRRRDSDSSSRSHTSVLMQTRRNRDRSDTASLLTVDEITAEVENRRASTIPKGDYIEETEDSSFIEGDTLPEYEESKGLLRTVCSDSNSIVDSGKSFQRDSDVDQQQELEDEEEDELDDEEEEEEEEKEDEDEQGKAFTSTGSKRIIKWIKGALIGAGSFGSVYLGMDAQSGLLMAVKQVELSAGSVKSEDRKKSMLSALEHEIELLKELQHENIVQYLDSSVDTNHLNIFLEYVPGGSVAALLNNYGAFEEGLVRNFVRQILTGLNYLHMRGIVHRDIKGANILVDNKGGIKISDFGISKKVENSLISGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKDPFIDSPRVRTTASNFISEAIVSEKMEVQVVEEM

SEQ ID NO: 17642 - protein, 511 aa, Cryptococcus neoformans var. grubii
MFARQPLSQNLLRPLSRPSSSFCRTSTIPKLAFLQSARGFASASEPYDVVIIGGGPGGYVAAIKAAQLGFKTACIEKRGALGGTCLNVGCIPSKAMLNNSHIFHQTQHDLKNRGIDVSDIQLNLPKMLAAKEASVKALTGGIETYLFKKNGIDYIKGEASFETANKLSVKLLEGGETQVEAKNVIIATGSEVTPFPGLEIDEERIVSSTGALELKEVPKKMVVIGGGVIGLELGSVWSRLGAEVTVVEYLGAIGAGMDGEVGKQFQKILTKQGFKFKLNTKVVSGHREGDIVKLKVDSAKGGREETIEADVVLVAIGRRPVTTGLNLEAIGVETDKRGRIIIDDEFNTSAKGVKCIGDVTFGPMLAHKAEEEGIAAVEILKTGHGHVNYDAIPSVVYTHPEVAWVGKNEEELKAAGVQYKIGKFPFAANSRAKTNQDSEGFVKFIVEKETDQVLGCHIIGPNAGEMIASATLALEYKASAEDIARTCHAHPTLSEAFKEAALASYDKTINF

SEQ ID NO: 17643 - protein, 496 aa, Medicago sativa
MATSNKNMLLNYVPVYVMLPLGVINVNNVFEDPDGLKEQLVQLRAAGVDGVMIDVWWGIIEQKGPKEYDWSAYKSLFQLVQKCGLKLQAIMSFHQCGGNVGDVVNIPLPKWVLDIGESDPDIFYTNRSGIRNQEYLSIGVDNKPIFHGRTAIEIYSDYMKSFRENMSDLLKSEVIIDIEVGLGPAGELRYPSYPQNQGWQFPGIGEFQCYDKYLRESFKAAAAKAGHSEWELPDDAGTYNDVPESTEFFKTNGTYLTEKGKFFLTWYSNQLLNHGDQILDEANKAFLGCKVKLAIKVSGIHWWYKAPNHAAELTAGYYNLDDRDGYRPIAKIVSRHHAILNFTCLEMRDSEQSSDAHSSPQKLVQQVLSGGWRENIEVAGENALSRYDATAYNQIILNARPQGVNKDGPPKLRMYGVTYLRLSDDLMQQSNFDIFKKFVVKMHADQDYCSDPEKYNHGIPPLKRSGPKIPDDVLNEATKPIPPFPWDSETDMKVDG

SEQ ID NO: 17644 - protein, 195 aa, Lactuca sativa
IQVAAQNCWVKKGGAFTGEVSAEMLANLGVPWVILGHSERRALLNETNEFVGDKVAYALSQGLKVIACVGETLEQREAGTTMEVVAAQTKAIADKISSWDNVVLAYEPVWAIGTGKVASPAQAQEVHAGLRKWFCDNVSAEVSASTRIIYGGSVSGSNCKELGGQTDVDGFLVGGASLKPEFIDIIKAAEVKKSA

SEQ ID NO: 17645 - protein, 218 aa, Hordeum vulgare subsp. vulgare
MTVAAARCLILTPTISSSSSAAAAVLRLPRVARRRPLSCSASPLAVFASMDSPPEGYRTNVGICLADPSLTKIFSASRIDIPTAWQMPQGGIDPGEEPRAAAIRELREETGVRSAEIVAEAPNWLTYDFPADVKDKLNARWGTNWKGQAQKWFLFRLTGGDDEINLMGDGSEKPEFSEWAWMTPKQVIEKAVDFKKPVYEETLKHFAPYLQSDPAASS

SEQ ID NO: 17646 - protein, 300 aa, Pneumocystis carinii
MEQYQRLEKIGEGTYGVVYKAKDLESGTIVALKKIRLEAEDEGVPSTAIREISLLKEMHNDNVVRLLNIIHQESRLYLVFEFLDLDLKKYMNSIPKDMMLGAEMIKKFMSQLVSGVKYCHSHRILHRDLKPQNLLIDREGNLKLADFGLARAFGVPLRGYTHEVVTLWYRAPEVLLGGRQYATALDIWSIGCIFAEMATKKPLFPGDSEIDEIFRIFRILGTPDENSWPGITSYPDFKATFPKWSPKNLGELITELDSDGIDLLQKCLRYYPAERISAKKALDHPYFDDFINLNRSNVVL

SEQ ID NO: 17647 - protein, 300 aa, Pneumocystis carinii
MEQYQRLEKIGEGTYGVVYKAKDLESGTIVALKKIRLEAEDEGVPSTAIREISLLKEMHNDNVVRLLNIIHQESRLYLVFEFLDLDLKKYMNSIPKDMMLGAEMIKKFMSQLVSGVKYCHSHRILHRDLKPQNLLIDREGNLKLADFGLARAFGVPLRGYTHEVVTLWYRAPEVLLGGRQYATALDIWSIGCIFAEMATKKPLFPGDSEIDEIFRIFRILGTPDENSWPGITSYPDFKATFPKWSPKNLGELITELDSDGIDLLQKCLRYYPAERISAKKALDHPYFDDFININRSNVVL

SEQ ID NO: 17648 - protein, 228 aa, Rhodobacter capsulatus
MTFDRSIKIAPSILSADFADFGREIQAIEAQGADWVHVDVMDGHFVPNLTFGPPAVAAFRKHVKTVMDVHLMISPVDAYIDAYAQAGADVLTAHVEAGPHIHRTLQAIRAAGMKSGVAINPGTPAEAIEHVLDIADVVCVMTVNPGFGGQKYIDMTAKVRKLRAMIGDRPVHIEIDGGMDPVTAPLMAAAGADVFVAGSGVFKGGSVSTPEVYGKNIAAIRAAAQAAL

SEQ ID NO: 17649 - protein, 422 aa, Linum usitatissimum
MASLPVSFAKPDKNGVITCKAIMLKEAKLPGMSYADTVQIIDIQVDPPQNVELRVKMLCASVCRTDILTIEGFMAPTQFPKINGHEGVGIIESMGPDTKNFKVGDVIVAPTLGECQTCSSCRSGRTNFCQNYGANESALEPDGTSRFSYIDSDGKKKLLYYKLGCSTWTQYMVVDSNYATKLNEIAPELPPPHGSILSCAFATGYGAVWLDAAVQEGDSVAIFGVGSVGISAVIAAKELKAKQIIVVDRNEYKLKMAMELGATHCINSEKLPEGVTPSQAVRKLTPKEVGVDASIESSGYDVFMNEAMKAAIHGKAKTVITGEGIYENDRIFFDFKDFLFGGNVVGNVTGRVRIHSDFPGLLRKAQEPVIRAGMDKILGYDAATMKCKYEVDIREGTPALLKALEEVENVDCVKLVIKLNDY

SEQ ID NO: 17650 - protein, 492 aa, Gluconacetobacter xylinus
MTFMTATDVTVSTPEPRNRTITPVILSGGTGTRLWPVSRASHPKQFWALASSRTMIGETLQRATGTAFAPPIVVCNNAHRFLVAEQLRENGCEDGRIILEPAVRNTAAAIAAAALLAAQDDPETLLWIMAADAVFRYPERLPAVLEKAMTVAREGYIVTFGMKPDVPETGYGYIRLGAPLHSGDADDNVYRVARFIEKPDRLRATEMLNEGGYLWNSGMFLAPASVILAELKRHEPDVLENVRHALLHSESDLTFRRLETASFMRCPNVSIDYAVMERTDRAVVIPADLGWSDVGNWNALWELGDKDAAGNVVVGDVVLEQSHNCYVRSEGMLTAVAGLTDIVLVVTSDAVLAIHRDYAQDVSALVSQLKMARRTEAEIHNRCYRPWGFYEGLIQGERFQVKRIVVYPGQKLSLQKHFHRAEHWVVVSGTAIVTRNEEKLMLQENESVYLPLGCMHRLENPGRIPLTLIEVQSGPYLGEDDIVRFEDTYGRQ

SEQ ID NO: 17651 - protein, 180 aa, Helianthus annuus
MATQTVFDFPDDVLQQPPMPADNAFSDKDVKGQDVELSKYKGKVLLIVNVASQCGFTNSNYPELTTLYQKYKDQGFEILAFPCNQFGGQEPGSNEEIQVFACTRFKAEYPVFSKVNVNGKEADPLYKFLKSSKGGFLGDSIKWNFTKFLVDREGKVVDRYAPTTSPLSIEKDIKKLLNVA

SEQ ID NO: 17652 - protein, 379 aa, Arabis gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPRKGQSVAIFGLGAVGLAAAEGARIAGASRIIGVDLNSQRFAQAKEFGVTEFVNPRDHGKPVQQVIAEMTNGGVDRSVECTGSVQAMIQAFECVHDGWGVAVLVGVPSKDDAFETHPMNFLNERTLKGTFFGNYKPKTDIPGVVEKYMNKELELEKFITHTVPFSEINKAFDYMLKGESIRCIITMGA

SEQ ID NO: 17653 - protein, 379 aa, Arabis gemmifera
MSTTGQIIRCKAAVAWEAGKPLVMEEVEVAPPQKHEVRIKILFTSLCHTDVYFWEAKGQTPLFPRIFGHEAGGIVESVGEGVTDLHPGDHVLPIFTGECGDCPHCHSEESHMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAIECVHDGWGVAVLVGVPSKDDAFKTHPMNFLNERTLKGTFFGNYKPKTDIPGVEEKYMNKELELEKFITHTVPFSEINKAFDYMLKGESIRCIITMGA

SEQ ID NO: 17654 - protein, 379 aa, Arabis gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFSGNYKPKTDMPGVVEKYMNKELELEKFITHTVPFSEINKAFDYMLKGESIRCIITMGA

SEQ ID NO: 17655 - protein, 379 aa, Arabis gemmifera
MSTTGQIIRCKAAVAWEAGKPLVMEEVEVAPPKKHEVRIKILFTSLCHTDVYFWEAKGQTPLFPRIFGHEAGGIVESVGGGVTDLQPGDHVLPIFTGECGDCPHCHSEESNMCDLLRINTERGGMIHDGESRFSINGKPIHHFLGTSTFSEYTVVHSSQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 17656 - protein, 379 aa, Arabis gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 17657 - protein, 379 aa, Arabis gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPDCHSEESTMCDLLRINTERGGMIHDGESRFSINGKPIHHFLGTSTFSEYTVVHSGQVAKINPDAPLDKVCIVSCGLSTGLGATLNVAKPKKGQGVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEIKKAFDYMLKGESIRCIITMGA

SEQ ID NO: 17658 - protein, 379 aa, Arabis gemmifera
MSTTGQIIRCKAAVAWEAGKPLVMEEVEVAPPQKHEVRIKILFTSLCHTDVYFWEAKGQTPLFPRIFGHEAGGIVESVGEGVTDLHPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKGFDYMLKGESIRCIITMGA

SEQ ID NO: 17659 - protein, 379 aa, Arabidopsis thaliana
MSTTGQIIRCKAAVAWEAGKPLVIEEVEVAPPQKHEVRIKILYTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 17660 - protein, 289 aa, Oryza sativa (indica cultivar-group)
MEGKEEDLRLGANRFSERQPIGTAAQGAGDNKDYKEPPPAPLFEPGELKSWSFYRAGIADFVATFLFLYITILTVMGVSKSSSKCATVGIQGIPWSFGSMIFALVYCTAGISGRHINPAVTFGLFLAKNVSLSRAIFYILMQCLGAICRTGFVKGFQQGLFMGHGGGANVIATGYTKGDGLGAEIVGTFILVYTVFSATDAKRNARDSHVPILAPLPIGFAVFLVHLATIPITGTGINPARSLGAAIIYNKDHAWNDHWIFWVGPFVGAALAAIYHQVIIRAIPFKSRS

SEQ ID NO: 17661 - protein, 298 aa, Schizosaccharomyces pombe
MSTEEQKEEIKDISSKQENSSEVPKAEEAGKVVESQKDTTSEEKKEETTEKKEDDGKKDLSFDEAEVLKQVEFYFSDTNLPHDKFLWTTSQKNDGWVPIQTIANFKRMRRFQPLEAIVNALRKSPELLEVDEAGEKVRRMIPLVRVDNKSVMERSVYCKGFGDEKDDTQIALEKFFEENAGPISAVRIRRDDDKKFKGSVFVEFKEPDVANKFLEKVKTAPLKWGEDELTIMSKKEYVDMKAELHKNDPPKFSSKRRRFDAFKEMDRQRPGKYSNRGRKFKKQRSSNASEEKPSAASE

SEQ ID NO: 17662 - protein, 356 aa, Matthiola incana
MVAVERVESLAESGIKSIPKEYIRPKEELESINDVFQEEKKEDGPQVPTIDLQNIESEDEETREKCVEELKKAALDWGVMHLINHGIPVDLMERVKKSGQEFFGLPVEEKEKYANDQASGKIQGYGSKLANNASGQLEWEDYFFHLVYPQDKRDLSLWPKTPTDYIEATSEYAKCLRSLATKVFKALSIGLGLEPHRLEKQVGGFEDLLLQMKINYYPKCPQPELALGVEAHTDVSALTFILHNMVPGLQLFYEGKWVTAKCVPDSIIMHIGDTLEILSNGKFKSILHRGLVNKEKVRVSWAVFCEPPKDKIVLKPLPEMVSVESPAKFPPRTFAQHIEHKLFRKEQEELVSEKKA

SEQ ID NO: 17663 - protein, 511 aa, Cryptococcus neoformans var. neoformans
MFARQPLSQNLLRPLSRPSSSFSRTSTIPKLAFLQSARGFASASEPYDVVIIGGGPGGYVAAIKAAQLGFKTACIEKRGALGGTCLNVGCIPSKAMLNNSHIFHQTQHDLKNRGIDVSGIQLNLPKMLAAKEASVKALTGGIETYLFKKNGIDYIKGEASFETANKLSVKLLEGGETQVEAKNVIIATGSEVTPFPGLEIDEERIVSSTGALELKEVPKKMVVIGGGVIGLELGSVWSRLGAEVTVVEYLGAIGAGMDGEIGKQFQKILTKQGFKFKLNTKVISGHREGDIVKLKVDSAKGGKEETIEADVVLVAIGRRPVTTGLNLEAIGVETDKRGRIIIDDEFNTSAKGVKCIGDVTFGPMLAHKAEEEGIAAVEILKTGHGHVNYDAIPSVVYTHPEVAWVGKNEEELKGAGVQYKIGKFPFAANSRAKTNQDSEGFVKFIVEKETDQVLGCHIIGPAAGELIASAVLAMEYKASAEDIARTCHAHPTLSEAFKEAALSSYDKPINF

SEQ ID NO: 17664 - protein, 486 aa, Mycobacterium leprae
MQDMSAPESKTAIAQIGVTGLAVMGSNIARNFARHGYTVALHNRSIAKTDTLLKEHGSEGNFVRTETIPEFLAALQTPRRVLIMVKAGDATDAVINELADVMEPSDIIIDGGNSLFTDTIRREKAMRERGLHFVGAGISGGEEGALNGPSIMPGGPAESYTSLGPLLEEISAHVDGVSCCTHIGPGGSGHFVKMVHNGIEYSDMQLIGEAYQLLRDGLGMSAPQIADVFTEWNRGDLNSYLVEITAEVLRQTDIKTGRPLVDVILDKAEQKGTGRWTVQSALDLGVPITGIAEAVFARALSGSVLQRKAAIGLASGKLGNKPTDRETFIEDVRQALYASKIVAYAQGFNHIQTGSTEFGWNITPGDLATIWRGGCIIRAKFLNRIKEAFDAAPDLASLIVAPYFRSAVESAIDSWRRVVSTATQLGIPNPGFSSALSYYDALRTERLPAALTQAQRDFFGAHSYGRVDARGKFHTLWSEDRSEVTV

SEQ ID NO: 17665 - protein, 480 aa, Polytomella sp. Pringsheim 198.80
MLSFKSDTSIFSGRKGPCANLFPPVSRKLNNAKPILMKAASKLVTTKSEEIFNEALELLPGGVNSPVRAFRSVGGKPIVFSKVKGARCYDVDGNSFLDYVGSWGPAIVGHAHDEVNAAIIDQVSRGTSFGAPGPLENELAKVVISRVPAVEMVRFVSSGTEACLSVLRLMRAATGRDGLIKFAGCYHGHADSFLVKAGSGVATLGLPDSPGVPASTTASTFTATFNDLDSVEKIFAAHPTEIAGIIVEPVVGNGGFIPPSPTFLRGLRALCDKYKALLCFDEVMTGFRVHKNCAQKLFGVTPDLVTLGKVIGGGLPVGAYGGRKDLMLHVAPAGTMYQAGTLSGNPLAMAAGLKTLEILDRPGAYEHLDRISKKLVEGVVAAGRAAGHPLVGGSFGGMFGFFLLKQEELGKEVEKKAPQSFEEAQSRADTAKFARFHRLMLEEGVYLAPSQFEAGFTSLAHTDEDIEFTISAAANAFKRL

SEQ ID NO: 17666 - protein, 174 aa, Rhizobium etli
ARKPSIVPIVEPECLMDGKPGDHNIDRCAEVTESTLQIVFEELAEARVSLEGMILKPNMVIDGKNARKASVAEVAERTVQVLKRTVPSAVPGIAFLSGGQTTEEATAHLSAINGFDLPWLVTFSYGRALQDSALKAWNGKPENVAAGQREFTHRAEMNSLAAKGSWKKDLEQAA

SEQ ID NO: 17667 - protein, 477 aa, Stigmatella aurantiaca
MRRAKIVCTLGPASQSQDMLEALIEAGMDVARLNFSHGSHEQHAENIAKLRAASLKLRKAVGILGDLQGPKIRTGRFITGSTVLKEGAIFSITTDESVKGNDDIVSTTYAHLAADVNPGDRILLDDGLLELKVLETDKKQLLRTQVVIGGTLKNNKGINLPGVAVRADALTPKDREDLVFGIKEGVDFLALSFVRQPADIELARQAMAEAGRQVPIVAKLEKPEAIARLDAILDKTDGVMVARGDLGVEIPPEEVPAVQKDIIRRSNQRGLPVIVATQMLNSMIENPRPTRAEASDVANAVFDGADAVMLSGETASGRYPIESVQMMDRIVLAAESAGRAQSSLGRIPDGPIGVPSHFPDVIARVACQAAQASGASLIAAFTLSGVTARLLAHYRPAVPIVAFSPNQEVRRRLALLWGVVPRVLEPIQETEAMVKRVEEELLARGLARKGERIVIVFGAPVGQPGKINSLRLHTIQG

SEQ ID NO: 17668 - protein, 359 aa, Solanum tuberosum
MAKSSENEHPIKAFGWATRHTSGVLSPFNFSRRVTGEKHVQFKVMYCGICHSDLHQLKNEWGNTKYPMVPGHEVVGVVIEVGSKVEKFKVGDKVGVGCMVGSCRKCENCTVDLENYCPRQIPTYNGYSLDGTLTFGGYSDMMVSDEHFVVRWPENLSMDAAPLLCAGITTYSPLKYFGLDKPGMHIGVVGLGGLGHMAVKFAKAFGTKVTVISTSANKKQEAIERLGADSFLISRDPEQMKAAMNTLDGIIDTVSAVHPILPLLMLMKSHGKLVMVGAPEKPVELPVFPLLMGRKLVAGSCIGGMKETQEMLDFAAKHNITPDIEVVPMDYVNTALERLLKSDVKYRFVLDIGNTLNKK

SEQ ID NO: 17669 - protein, 473 aa, Synechococcus sp. WH 7803
MASTAQDVLRQIKDEGIELIDFKFTDLHGKWQHLTICSDLLEADSFEEGLAFDGSSIRGWKTIDASDMAMVPDPSTAWIDPFYSHKTLSMICSIQDPRTGTLYDRCPRALAQRALAYLSGSGLADKAFFGPEPEFFLFDDVRYNSSEGGSFYSVDTIEASWNSGRLEEGGNLGYKIQLKEGYFPVAPNDTAQDIRSEMLLMMAQLGIPIEKHHHELAGAGQHELGMKFAELIKAADNTMTYKYVVRNVAKKYGKTATFMPKPVFNDNGSGMHVHQSLWKAGQPLFFGEGTDANLSQTARWYIGGILKHAPSFLAFTNPTTNSYKRLVPGFEAPVNLVYSEGNRSAAVRIPLTGPNPKAKRLEFRSGDALANPYLAFSAMMMAGIDGIKNQIDPGAPTNEDLFELSAERLSAIDTVPASLNGALEALNADHHYLMEGGVFSKDFINNWIDLKYEEVQQLRQRPHPHEFTMYYDA

SEQ ID NO: 17670 - protein, 124 aa, Escherichia coli
AGGITQHIGAYHVETENGMITFLDTPGHAAFTSMRARGAQATDIVVLVVAADDGVMPHTIEAIQHAKAAQVPVVVAVNKIDKPEADPDRVKNELSQYGILPEEWGGESQFVHVSAKAGTDIDEL

SEQ ID NO: 17671 - protein, 153 aa, Escherichia coli
PVVTIMGHVDHGKTSLLDYIRSTKVASGEAGGITQHIGAYHVETENGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDEL

SEQ ID NO: 17672 - protein, 158 aa, Escherichia coli
LLDYIRSTKVASGEAGGITQHIGAYHVETENGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDELLDAILLQAEVLELKAVRKGM

SEQ ID NO: 17673 - protein, 144 aa, Escherichia coli
GGITQHIGAYHVETENGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDELLDAILLQAEVLELKAVRKGMA

SEQ ID NO: 17674 - protein, 160 aa, Escherichia coli
SLLDYIRSTKVASGEAGGITQHIGAYHVETENGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDELLDAILLQAEVLELKAVRKGMA

SEQ ID NO: 17675 - protein, 115 aa, Escherichia coli
FTSMRARGAQATDIVVLVVAADDGVMPQTIEAIQHAKAAQVPVVVAVNKIDKPEADPDRVKNELSQYGILPEEWGGESQFVHVSAKAGTGIDELLDAILLQAEVLELKAVRKGMA

SEQ ID NO: 17676 - protein, 381 aa, Medicago sativa
MSCSVAVSNSPVFSPSSSLFCNKSETLTLSLSHLKPSSTTTTTTTSSSSSSSSPSPCSSPSSPFCLRLPKLPLVFTSNKDSGSQNDAVLKRKRPTRLNIPVSEHAFCVPATPSAVARDVVEAEGDGYSVYCKRGRREYMEDRYTAGVNLRGENNLAFFGVFDGHGGAKAAEFARNNLEKNILDEVIMTDEDDVEEAVKRGYLNTDSEFMKKDLHGGSCCVTAFIRNGNLVVSNAGDCRAVISRGGVAEALTSDHRPSREDEKDRIETLGGYVDLCRGVWRIQGSLAVSRGIGDRHLKQWVTAEPETKVIRIEPEHDLLILASDGLWDKVSNQEAVDIARQFCVGNNNQQPLMACKKLAQLSVSRGSLDDTSVMIIKFKHYV

SEQ ID NO: 17677 - protein, 174 aa, Escherichia coli
GEVLMLGYMNPEALDKTIESGKVTFFSRTKQRLWTKGETSGNFLNVVSIAPDCDNDTLLVLANPIGPTCHKGTSSCFGDTAHQWLFLYQLEQLLAERKSADPETSYTAKLYASGTKRIAQKVGEKGVETALAATVNDRFELTNEASDLMYHLLVLLQDQGLDLGKLIDNLKNRH

SEQ ID NO: 17678 - protein, 436 aa, Dioscorea quinqueloba
QKIDRMYNGEKINCTENRSVLHIALRAARDKVIESDGKNVVPDVWHVLDKIKEFSERIRSGSWVGATGKALTDVVAVGIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLKGAASIDDHFHSTPFEKNIPVLLGLLSVWNVSFLGYPARAILPYSQALEKFAPHIQQVSMESNGKGVSIDGIPLPFETGEIDFGEPGTNGQHSFYQLIHQGRVIPCDFIGVMRSQQPIYLKGEVVSNHDELMSNFFAQPDALAYGKVADQLLNEKVPDHLIPHKTFPGNRPSLSLLLPSLNAYNVGQLLAIYEHRIAVEGFVWGINSFDHWG

SEQ ID NO: 17679 - protein, 411 aa, Dioscorea tenuipes
MYNGEKINCTENRSVLHIALRAARDKVIKSDGKNVVPDVWHALDKIKEFSERIRSGSWVGATGKALTDVVAVGIGGSFLGPLFVHTALQTDPEAAECAKGRQLRFLANVDPIDVARSIAGLNPETTLVVVVSKTFTTAETMLNARTLREWISAALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVTIDGVPLPFETGEIDFGESGTNGQHSFYQLIHQGRVIPCDFIGIMRSQQPIYLKGEVVSNHDELMSNFFAQPDALAYGKVAEQLLNEKVPDHLIPHKTFPGNRPSLESSITFIKCLQRWTVTSNI

SEQ ID NO: 17680 - protein, 182 aa, Fagus crenata
MASSMISSATVATVSRATPAQATMVAPFTGLKSTAAFPATRKSNNDITSLASNGGRVQCMKVWPPLGLQKFETLSYLPPLSIESLAKQIEYLILKGWIPCLEFELEHPFVYRENNRSPGYYDGRYWVMWKLPMFGCTDATQVLAELQEASKTYPTSHIRIIGFDNKRQVQCISFIAYKPPAK

SEQ ID NO: 17681 - protein, 428 aa, Staphylococcus aureus
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGNDIAGVIVEPVAGNMGVVPPIEGFLQGLRDITTEYGALLIFDEVMTGFRVGYHCAQGYFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFETANKSDLKLFAEMYREMAKEGVFLPPSQFEGTFLSTAHTKEDIEKTIQAFDTALSRIVK

SEQ ID NO: 17682 - protein, 145 aa, Arabidopsis thaliana
MASKALVLLGLFAVLLVVSEVAAASSATVNSESKETVKPDQRGYGDNGGNYNNGGGYQGGGGNYQGGGGNYQGGGGNYQGGGGRYQGGGGRYQGGGGRYQGGGGRQGGGGSRGSYCRHGCCYRGYNGCSRCCSYAGEAVQTQPGH

SEQ ID NO: 17683 - protein, 489 aa, Cucumis sativus
MLGQKQAEEAIVPTTANEVEHGGGKEEGEEADGGEQPQNSVFQMKNLLWHGGSAWDAWFSCASNQVAQVLLTLPYSFAQFGMLSGIIFQIFYGLIGSWTAYLISVLYIEYRSRKEKENVNFKNHVIQWFEVLDGLLGPHWKALGLAFNCTFLLFGSVIQLIGCASNIYYINDHLDKRTWTYIFGACCATTVFIPSFHNYRIWSFLGLGMTTYTAWYLAARALIHGQTEGVTHSGPTKLVLYFTGATNILYTFGGHAVTVTVEIMQSDVETQKFKYIYLMATLYVFTLTLPSASAVYWAFGDELLNHSNAFSLLPKNRFRDAAVILMLIHQFITFGFACTPLYFVWEKVIGMHDTKSLCLRALVRLPVVVPIWFLAIIFPFLGPINSAVGALLVSFTVYIIPAAAHMLTYRKASAKQNAAEKPPFFLPSWTAMYVLNSFIVVWIFVFGFGFGGWATITNFVRQINSFGLFAKCYQCKPSHPPAPPPTHRH

SEQ ID NO: 17684 - protein, 1230 aa, Cryptococcus neoformans var. neoformans
MSSFTPAFRLHHTHSSSVSPTASNDVAPSSPTPNQPHQLAARSPLYATSPNCASKITKGSSLSSSTAHHGLKYVRPSTSPLLRSPKGESFSAYLGNWGSQELITFLNIHKCGQYLAIFQKNDINGKILLDLDMTALKSMGIGKISERVRLIGGIKDLRRCVADESIRAPFTQRSYPSERTLLPSLPSHSNVLLDKWDCSSSASRLGKRQITLRPPPLDLQGHMPPRLLSHASLGIATIDTHDIHTTNSKIEVYIQQNPPGQPQSMPTKRSDSLTLCAAPSRNVGRRSPSSRHFEGCKSQTDGLTTLNLTLDRQVPSSTMNNVTLREDCHLQREERLPLSHQVPHSRNAFASPHKTSLSGRCPLARGDTTSHQPSGPAIAEQDSPVNYRISNTVTNTKEISQGDLKQPFVMKSLESQSHLLAGVSDMSHDPVTDGFKPKGKASVPLTVMSSSDISAVNANPAALSLADLRRQLVKFINTEDDTIRTVNVMHVTSGVEILERALKKFGKFGTGIHGSPDVYGDEDGDGTLEIDGWEVYTESTPDESSKPLSEFNLLKTCTFHREGTAIQDKGLFLRKKQRMQKRKNIQDFFGETPPPSMSPTSPTLITGPHLSLVQGKSQPTSGSAFSSSSRLSTLTHKGRNRASMISVMSGLGVPIINTLPSPQGNGLRLTGSVHSHEKKSMYNFFGHRPPSELISNHLTDYFPSAKKSDVEKARHSLLRLSGGTVAYKKSGIYEGDSTPDHWSKPGDNQPPSLPPFEPSQDTLSDSLQAFASSTPVHLSRPKHTVALRRRRDSDSSSRSHTSMLMQTRRNRDHSDTTSLLTVDEITAEVENRRVSTIQRGDYIEETEDSSSIEGDTLPQDDESKGVLRAICSDSNKLVDSGKSYQGDSDIDQQHELEDEEEDKLDDDEEEEEEEEEEDNEQGKAFTSTGSKRIIKWIKGALIGAGSFGSVYLGMDAQSGLLMAVKQVELSAGSAKNEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKHPFIGSPRVRTAASNFINGAIASETMEVQVVEES

SEQ ID NO: 17685 - protein, 511 aa, Cryptococcus neoformans var. neoformans
MFARQPLSQNLLRPLSRPSSSFSRTSTIPKLAFLQSARGFASASEPYDVVIIGGGPGGYVAAIKAAQLGFKTACIEKRGALGGTCLNVGCIPSKAMLNNSHIFHQTQHDLKNRGIDVSGIQLNLPKMLAAKEASVKALTGGIETYLFKKNGIDYIKGEASFETANKLNVKLLEGGETQVEAKNVIIATGSEVTPFPGLEIDEERIVSSTGALELKEVPKKMVVIGGGVIGLELGSVWSRLGAEVTVVEYLGAIGAGMDGEIGKQFQKILTKQGFKFKLNTKVISGHREGDIVKLKVDSAKGGKEETIEADVVLVAIGRRPVTTGLNLEAIGVETDKRGRIIIDDEFNTSAKGVKCIGDVTFGPMLAHKAEEEGIAAVEILKTGHGHVNYDAIPSVVYTHPEVAWVGKNEEELKGAGVQYKIGKFPFAANSRAKTNQDSEGFVKFIVEKETDQVLGCHIIGPNAGEMIASATLALEYKASAEDIARTCHAHPTLSEAFKEAALASYDKTINF

SEQ ID NO: 17686 - protein, 467 aa, Emorya suaveolens
  misc_feature (282)..(282): Xaa can be any naturally occurring amino acid
SVGFKAGVKEYKLTYYTPEYETKDTDILAAFRVTPQPGVPPEEAGAAVAAESSTGTWTTVWTDGLTSLDRYKGRCYHIEPVPGETDQYICYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLXHIHRAMHAVIDRQKNHGIHFRVLAKALRMSGGDHIHSGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAAEGNTIIREACKWSPELAAACEVWKEIKFEFAAMDTLD

SEQ ID NO: 17687 - protein, 361 aa, Kluyveromyces marxianus
MLFSNTLLIAAASALLAEASPLEKRDSCTLSGKTAGGGLSNCATVTVNNVEVPSGKTLDLTGLPDGATVNFVGQVTFGYDEWVGPLVSISGKNIKVVGKSGHLLDGDGARWWDGKGDGGKKKPKFMSLRLTGNSDVGGLQIKNTPIQAISVNSCSDTVIHDVTIDNRDGDKDNLGHNTDGFDVGNVNNVTIENSHVYNQDDCIAVNSGTGVYFKNNYCSGGHGASIGSVGLRSNNVVDTVYFENNQIVNSDNGLRIKTIQKATGSVNNVHFLSNTISGIRKFGIVVETDYSNGSTTGTPGSKVPITNFEVDGLTGSVDSSAYRVKIFVAGASKWTWKNVDITGGSSFGSCTGIPSGSGAFC

SEQ ID NO: 17688 - protein, 502 aa, Pseudomonas sp. Y2
MTRSLTMNSSLSAIDGLRLPHQMLIGGQWVSAQSGKTLNVYNPATGDILTEVPDGDVEDVNAAVESAAGTLRSDTWRRMPPSARERILLRLADLLEVHGDELARLETLNNGKLLIYSKLMEVGASAQWLRYMAGWATKLTGSTLDLSLPLPPEVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 17689 - protein, 265 aa, Pinus strobus
RENYTVMHLDLASLESVRQFVDNFRQSGRPMDVLVCNAAVYLPTAKVPTFTAEGFELSVGTNHLGHFLLSRLLLEDLKKSDFKSKRVIIVGSITGNTNTLAGNIPPKANLGDLRGLSARLNGVNSSPMIDGGEFDGAKAYKDSKVCNMLTMQEFHRRYHEETGITFASLYPGCIATTGLFREHVPPFRLLFPPFQKYITKGFVSEEEAGKRLAQVVSDPSLTKSGVYWSWNNDSASFENQLSEEASDPGKARKVWEISEKLVGLA

SEQ ID NO: 17690 - protein, 161 aa, Escherichia coli
TSLLDYIRSTKVASGEAGGITQHIGAYQVETENGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDELLDAILLQAEVLELKAVRKGMA

SEQ ID NO: 17691 - protein, 162 aa, Escherichia coli
KTSLLDYIRSTKVASGEAGGITQHIGAYHVETENGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDELLDAILLQAEVLELKAVRKGMA

SEQ ID NO: 17692 - protein, 157 aa, Lactococcus lactis
MNFYDFSAVKMNGETVSMSDYKGKVVIVVNTASKCGFTPQFEGLEKLYETYKDQGLEILGFPCNQFANQDAGENTEINEFCQLNYGVTFTMFQKIKVNGKEAHPLYQFLKKEAKGALSGTIKWNFTKFLIDRDGQVIERFAPKTEPEEMEEEIKKLL

SEQ ID NO: 17693 - protein, 179 aa, Melilotus alba
AHATFYGGSDASGTMGGACGYGNLYSQGYGVNTAALSTALFNSGLSCGACFELKCSNDPSWCHPGSPSILVTATNFCPPNFAQPSDNGGWCNPPRPHFDLAMPMLLKIAQYRAGIVPVSYRRVPCRKQGGIRFSINGFRYFNLVLITNVAGAGDIVKTSVKGSKTGWMSMSRNWGQNWQ

SEQ ID NO: 17694 - protein, 357 aa, Helianthus tuberosus
MAILSPYSSSFLDTLFCNEQQDHEYHEYEYEDEFTQTTLTDSSDLHLPPLDQLDLSWEHEELVSLFTKEQEQQKQTPCTLSFGKTSPSVFAARKEAVDWILKVKSCYGFTPLTAILAINYLDRFLSSLHFQEDKPWMIQLVAVSCLSLAAKVEETQVPLLLDLQVEDTKYLFEAKNIQKMELLVMSTLKWRMNPVTPISFLDHIVRRLGLTDHVHWDFFKKCEAMILCLVSDSRFVCYKPSVLATATMLHVVDEIDPPNCIDYKSQLLDLLKTTKDDINECYELIVELAYDHHNKRKHDANETTTNPVSPAGVIDFTCDESSNESWELNAHHFREPSFKKTRMDSTIRVRVWFTYKL

SEQ ID NO: 17695 - protein, 294 aa, Helianthus tuberosus
MEQYEKVEKIGEGTYGVVYKARDKVTNETIALKKIRLEQEDEGVPSTAIREISLLKEMQHGNIVRLQDVVHSDKRLYLVFEYLDLDLKKHMDSCPEFSKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRIMGTPNEETWPGVTSLPDFKSAFPKWSSKDLATVVPNLEKAGLDLLCKMLWLDPSKRITARTALEHEYFKDIGFVP

SEQ ID NO: 17696 - protein, 431 aa, Thermus filiformis
MAENAEKFLWGVATSAYQIEGATQEDGRGPSIWDTFARRPGAIRDGSTGEPACDHYHRYEEDIALMQSLGVGVYRFSVAWPRILPEGRGRINPKGLAFYDRLVDRLLAAGITPFLTLYHWDLPQALEDRGGWRSRETAFAFAEYAEAVARALADRVPFFATLNEPWCSAFLGHWTGEHAPGLRNLEAALRAAHHLLLGHGLAVEALRAAGAKRVGIVLNFAPVYGEDPEAVDVADRYHNRYFLDPILGRGYPESPFQDPPPTPNLSRDLELVARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQL

SEQ ID NO: 17697 - protein, 436 aa, Thermus sp. IB-21
MTENAEKFLWGVATSAYQIEGATQEDGRGPSIWDAFARRPGTIRDGSTGEPACDHYHRYEEDIALMQSLGVGAYRFSVAWPRILPEGRGRINPKGLAFYDRLVDRLLAAGITPFLTLYHWDLPQALEDRGGWRSRETAFAFAEYAEAVARALADRVPFFATLNEPWCSAFLGHWTGEHAPGLRNLEAALRAAHHLLLGHGLAVEALRAAGTKRVGIVLNFAPVYGEDPEAVDVADRYHNRYFLDPILGRGYPESPFQDSPPVPILSRDLELVARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQTGGSAR

SEQ ID NO: 17698 - protein, 431 aa, Thermus sp. IB-21
MDDHAEKFLWGVATSAYQIEGATQEDGRGPSIWDAFARRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRYFLDPILGKGYPESPFRDPPPVPILSRDLELVARPLDFLGVNYYAPVRVAPGTGTLPVRYLPPEGPATAMGWEVYPEGLHHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 17699 - protein, 433 aa, Aeromonas hydrophila [sequence omitted]

SEQ ID NO: 17700 - protein, 229 aa, Betula pendula
LEFLMADAVAQGADCVITIGGIQSNHCRATAVTAKYLNLDCYLILRTSKVLVDQDPGLTGNLLVERLVGAHIDLISKEEYAKIGSESLTNLLKEKLLNEGRRPYVIPVGGSNSLGTWGYIEAIREIEQQLQTGTGEIKFDDIVVACGSGGTIAGLSLGSWLSTLKAKVHAFSVCDDPDYFYDFIQGLLNGLEAGVDSRDIVNIHNAKGLGYAINTSEELKFVKEVAAAT

SEQ ID NO: 17701 - protein, 314 aa, Aspergillus parasiticus
METPFAAPWHQFVEDLGQTPCLPGKDLDSILAGWGQLAGTLATRYGFPPPDESVTTEDVQLDGLWLRCYTPPNATGQEPVGLYFHGGGWVMGGVKEEDGFCRVISRQCQMRLVSVEYRKAPQTRYPGALNDGVSAALWVLSRYENQPLVLMGTSAGGNLAFGTALRLIDQDMVDKVSGVVALAPITVHPDAVPEYLKEQYTAYEENAELTVNSRAAMQVFFDCYKAPVDDVYTSCLLHPRLLALPKVYIAELGLDTLRDDARLMKGALDTAKVPVMYDAYPGYPHCLFMFPFKSLGEHQRPFLGGVAKAVRWMS

SEQ ID NO: 17702 - protein, 386 aa, Ipomoea purpurea
MVDGNHPLPAPKVCVTGAAGFIGSWLVKTLLQRGYHVHATVRDPGNTKKVKHLVELPKADTNLTVWKGVMEEEGSFDEAIAGCEGVFHVATPMDFDSKDPENEVIKPTINGVLNIINSCVKAKTVKRLVFTSSAGTLNVQPQQKPVYDETCWSDLDFIYAKKMTGWMYFASKILAEKEAWKATKEKKIDFISIIPPLVVGPFITPTFPPSLITALSLITGNEAHYSIIKQGQYVHLDDLCEAHIFLYEHPKAEGRFICSSHHTTIHGLAEMITQNWPEYYIPSQFKGIEKELAVVYFSSKKLQDMGFQFKYSLEDMYRGAIETLRKKGLLPYSTKEAAAIEEEQETVPLKVEEPTAIEQKQETVPLKLEEEPIAIEKKQEVVPLKA

SEQ ID NO: 17703 - protein, 371 aa, Ipomoea purpurea
MLSTITATVPSRVERLAGSGIQRIPKEYIRPEEERRSIRDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKNASDYIDATREYAKQLRALATKVLAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNREKVRVSWAVFCEPPKDKILLQPLPETVSEAEPPRFPPRTFARHIKHNLFRQSDQEAAHTPKPDNDDDHQSN

SEQ ID NO: 17704 - protein, 279 aa, Solanum tuberosum
MFQTLKNEFQICEEIGRGRFGTVYRCFSPATGESFACKSIDKNLLIDSTDRECLDKEPKILQLLPGNPNILHLYKVYEDDDFLHMVTDFCPNSDLYERVSSGSLSESAAAAILTQLVSAISYCHHMGVAHRDIKPDNVLFDSENRLKLADFGSAEWFAGCEGRMMSGVVGTPYYVAPEVLMGKEYNEKVDVWSAGVILYIMLSGVPPFYGETPTETFQAVLRGNLRFPTRNFRSVSSEAKDLLRKMICKDVSRRFSAEQVLRHPWVINGGETRSMADLN

SEQ ID NO: 17705 - protein, 199 aa, Penicillium marneffei
MASGPATQSLKCVVTGDGAVGKTCLLISYTTNAFPGEYIPTVFDNYSASVMVDGRPISLGLWDTAGQEDYDRLRPLSYPQTDVFLICFSIVSPPSFDNVKAKWFPEIEHHAPGVPIILVGTKLDLREDRATAEALRAKKMEPVSYEQALAVAKEIRAHKYLECSALTQRNLKSVFDEAIRAVLNPRPQPKNKAKRCTIL

SEQ ID NO: 17706 - protein, 220 aa, Gossypium barbadense
MDADTWSVRLSSASKRYQSSLESRSNMLMGFEEIDEEDDIREEFPCPFCSEYFDIVGLCCHIDDEHPVEAKNGVCPVCALRVGVDMVAHITLQHGNIFKMQRKRKSRKGGSHSTLSLLKKELREGNLQTLLGGSSCIVSSSNSAPDPLLSLFILPMVDDFVSDQPPFRTETSRNNKSSDMNKSERTTQSSPLSVKDQEEKAKRCECVQGLLLSTIVDDIL

SEQ ID NO: 17707 - protein, 237 aa, Gossypium barbadense
LTDDHCQYFLYQLMRGLKYIHSANALHRDLKPSNLLLNANCDLKICDFGLARTTSETDFMTEYVVTRWYRAPESLLNCSEYTAAIDIWSVGCILMEIIRREPLFSGKDYVQQLGLITQLLGSPEDSDLGFLRSDNARKYVKQLPHFPKQPFAGKFPDVSPLAIDLAEKMLVFDPSKRITVEEALNHPYLSSLHEINEEPTCPSPFVFDFEQMALNEEDIKELIWRESLNFNQDKMPE

SEQ ID NO: 17708 - protein, 313 aa, Synechococcus sp. WH 8103
WNTGRLEEGGNLAYKIQLKEGYFPVAPNDTAQDIRSEMLLLMGQLGIPTEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLKFRSGDALANPYLAFSAMVMAGLDGIKNQIDPGDGENRDLFELPAEKLAKIATVPPSLNGALEALNADRGFLTAGGVFSDDFIDNWIDFKYEEVQQLRQRPHPHKFAMYYDA

SEQ ID NO: 17709 - protein, 248 aa, Synechococcus sp. WH 5701
PIEKHHHEVAASGQQELGMFAELISAADNVMIYKYVVRNVARKYGRSATFMPKPVFADNGSGMHVHQSLWRDGQPLFFGLGTYADLSQTARWYIGGLLRHAPSFLAFTNPTTNSYKRLVPGFEAPVNLVYSQGNRSAAVRIPLSGENPRAKRLEFRSGDAMANPYLAFSAMLLAGLDGIRQQIDPGDGMDLDLFELPPEDLEQIATLPSSSEGVLAALEADHEYLLAGEVFSEDFISNWIALKSEALQ

SEQ ID NO: 17710 - protein, 341 aa, Fragaria x ananassa
MGLGAESGSVCVTGASGFVGSWLVMRLLEHGYTVRATVRDPANLKKVRHLLELPQAATRLTLWKADLDVEGSFDEAIKGCTGVFHVATPMDFESEDPENEVIKPTINGMLDIMKACLKAKTVRRLVFTSSAGAVAIEEHPKEVYSENNWSDVVFCRKVKMTGWMYFVSKTLAEQAAWKFAKENNIDFITIIPTLVIGPFLAPSMPPSLISGLSPLTGNEAHYGIIKQCQYVHLDDLCQSHIFLYEHAKAEGRYICSSHDATIHDIAKLLNEKYPKYNVPKKFKGIEENLTNIHFSSKKLKEMGFEFKHSLEDMFTGAVDACREKGLLPLPQEEETEKRRAG

SEQ ID NO: 17711 - protein, 364 aa, Streptococcus anginosus
MDKKLQLDTILAHAGIKTDEATGALTTPLHFSTTYQHPEFGKSTGYDYTRTKNPTRSSLEKTLAAIEHADYALATSSGMSAIVLAFSVFPIGSRVIAVRDLYGGSFRWFHQVEQEGRFHFTYANTEEELLAALTEDIDVVYLETPTNPLMLEFDVAFIAEKAHAKGAKVIVDNTFYTPIYQRPLENGADLVLHSATKYLGGHNDVLAGALMTSDKELYENLFYNLNTTGAVLSPFDSYLLLRGLKTLSLRMERSTKNAQAVAAFLKDSPAVKEVLYPGKGGMISFKVKDEAVIPHLLNTLKVFTFAESLGGVESLITYPATQTHADIPAEVRKSYGLTDDLLRLSIGIEDSQDLITDLKFALEV

SEQ ID NO: 17712 - protein, 310 aa, Vitis vinifera
MSFIGEASAYFKVLSDGSIKRVEWESAPASNDSSSNGYKSKDVIINSTKPISARIFLPDVPGSSGRLPVLVYFHGGGFCLGSTTWFGYHTFLGDFAVASQSIVLSVDYRHAPENRLPIAYDDCYSSLEWLSCQVSSEPWLERADLSRVFLSGDSAGGNIVHNVALRTIQEQSCDQVKIKGLLLIHPFFGSEERIEKERAGGEAENLALTDWMWKLSLPEGSNRDHYWCNYEMAELSRAEWCRFPPAVVYVAGLDFLKERGVMYAAFLEKNGVEVKLVEAEGEKHVYHMLHPESEATRLLQKQMSEFIHNF

SEQ ID NO: 17713 - protein, 179 aa, Fritillaria agrestis
MASSATMLSSVATAACVAPAQASMVAPFVGLKSASAFPVTQKTVTGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVEKPE

SEQ ID NO: 17714 - protein, 179 aa, Fritillaria agrestis
MASSATMLSSVATAARAAPAQASMVAPFVGLKSASAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVEKPE

SEQ ID NO: 17715 - protein, 129 aa, Pisum sativum
MDSRKAMLILGLLAMVLLISSEVSARELTEEVVEKSDEVNDAKYGGYGRGGGYHNGGGYHNGGGGYNGGGGYHNGGGGYNGGGGYHNGGGGYHNGGGGYNGGGGYHNGGGGYHGGGGHGGHGGASNNGN

SEQ ID NO: 17716 - protein, 338 aa, Helianthus annuus
MARVPRVKLGSQGLEVSAQGLGCMSMSAFYGPPKPEPDMINLIHHAVNSGVTFVDTSDYYGPKTNEILLGKALKGGMRDKVELATKYGIKLSGSWEVKGDPAYVRAACEASLKRLYVDCIDLYYQHRIDTRVPIEITMGELKELVEEGKIKYVGLSEASASTIRRAHSVHPITAIQLEWSLWSRDVEEDIIPTCRELGIGIVAYSPLGRGFFASGSKMMEKLEDGDYRPNFPRFQPENLEHNKILYERVSEIASKKGCTTSQLALAWVHHQGNDVVPIPGTTKIENLEQNIGALSVKITPEEMAELESTTHLVKGARCNAGTPTYLDSETLPLSSWKS

SEQ ID NO: 17717 - protein, 198 aa, Zinnia elegans
MAAAATRFIKCVTVGDGAVGKTCMLISYTSNTFPTDYVPTVFDNFSANVVVGDSTVNLGLWDTAGQEDYNRLRPLSYRGADVFLLAFSLISRPSYENISKKWISELRHYAPDVPIVLVGTKLDLREDKQYLSDHPNVTAITTSQGEELKKSIGAAVYIECSSKTQQNVKAVFDAAIRVVLQPPKLKKKRSKQRLCVYL

SEQ ID NO: 17718 - protein, 197 aa, Zinnia elegans
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIVLVGTKLDLRDDKQFFVDHPGATPITTAQGEELKKTIGAPEYIECSSKTQLNVKQVFDAAIKVVLAPPKAKKKKGKAQKACSIL

SEQ ID NO: 17719 - protein, 427 aa, Rhizomucor pusillus
MLFSKISSAILLTAASFALTSARPVSKQSDADDKLLALPLTSVNRKYSQTKHGQQAAEKLGGIKAFAEGDGSVDTPGLYDFDLEEYAIPVSIGTPGQDFYLLFDTGSSDTWVPHKGCDNSEGCVGKRFFDPSSSSTFKETDYNLNITYGTGGANGIYFRDSITVGGATVKQQTLAYVDNVSGPTAEQSPDSELFLDGIFGAAYPDNTAMEAEYGDTYNTVHVNLYKQGLISSPVFSVYMNTNDGGGQVVFGGVNNTLLGGDIQYTDVLKSRGGYFFWDAPVTGVKIDGSDAVSFDGAQAFTIDTGTNFFIAPSSFAEKVVKAALPDATESQQGYTVPCSKYQDSKTTFSLVLQKSGSSSDTIDVSVPISKMLLPVDKSGETCMFIVLPDGGNQFIVGNLFLRFFVNVYDFGKNRIGFAPLASGYENN

SEQ ID NO: 17720 - protein, 513 aa, Arabidopsis thaliana
PVRKFPGRPTRPVRRVWVGKNTLLSTPAVSAVIRERSGADGSKATGAFILTASHNPGGPTEDFGIKYNMENGGPAPESITDKIYENTKTIKEYPIAQDLPNVDISAVGVTSFEGPEGKFDVEVFDSADDYVKLMKSIFDFEAIRKLLSSPKFTFCYDALHGVAGAYAHRIFVEELGAQESALLNCTPKEDFGGGHPDPNLTYAKELVARMGLGKSDTGGEPPEFGAAADGDADRNMILGKRFFVTPSDSVAIIAANAIGAIPYFSSGLKGVARSMPTSAALDVVAKSLNLKFFEVPTGWKFFGNLMDAGMCSVCGEESFGTGSDHIREKDGIWAVLAWMSILAHKNKGNIDGNAKLVSVEDIVRQHWATYGRHYYTRYDYENVDAGKAKELMEHLVKLQSSIPEVNKIVKGIRSDVASVASADEFEYKDPVDGSISKHQGIRYLFEDGSRLVFRLSGTGSEGATIRLYIEQYEKDASKTGRESQEALSPLVDLALKLSKMEEFTGRSAPTVIT

SEQ ID NO: 17721 - protein, 207 aa, Nicotiana tabacum
MRRYKSKSKGIGEMTVMEVGKVEEVAVKMTASAEREVLEVADHAKKRKMCDGDLEMLPTVACVRSHSEDILVAQESLVTPTSELSSPKENAALSSDFDDALASCCASNGSSKSLDLEEETVEIATSKSKESIKAELRQMEPTTRAHHPKSRRRLTEEKMPSETDLEEFFAAAEKDILKRFTKKYNFDFVKEEPLEGHYEWVRSTVKP

SEQ ID NO: 17722 - protein, 416 aa, Methanothermobacter thermautotrophicus str. Delta H [sequence omitted]

SEQ ID NO: 17723 - protein, 246 aa, Methanothermobacter thermautotrophicus str. Delta H
MVSLTKRCIAEFIGTFFLVFFGAGAAAITLMIASGGTAPNPFNIGIGLLGGLGDWVAIGLAFGFAIAASIYALGNISGCHINPAVTIGLWSVKKFPGRDVVPYIIAQLLGAAFASFIFLQCAGITAATIGGLGATAPFPGIGYWQAMLAETVGTFLLMITIMGIAVDERAPKGFAGIIIGLTVAGIITTIGNITGSSLNPARTFGPYLNDMVFAGTNLWNYFPIYVIGPVVGAVLAALTYQYLTSE

SEQ ID NO: 17724 - protein, 484 aa, Methanothermobacter thermautotrophicus str. Delta H
MYRKKLTEAETGYTFDDFLLLPQASYVEPRDVETAGRVSRNIELKIPVISSAMDTVTEYDMAIAMAQEGGMGVIHRNMSIRDQVEQVKKVKRSGDITIRDVITISPDSTLREAHEIMDQEEISGLPVVEDGVLIGIISRRDIEPIFNSDADKKVDQVMTRDVVTVDESITPNEALDIAYENKVERLPVVKDGRIVGMLTMKDILERKRYPNASRDSEGYLRVAAATGPFDLERARALDEAGADVLAIDSAHGHNMNLVKSAGAMKKEIEADLIVGNIATREAAEDLIAQDVDGLKVGIGPGSMCTTRIIAGVGVPQLTAIAEVADVAAEYGVPVIADGGIRYSGDIAKAIAVGADCVMLGNLLAGTYEAPGDVVVMNGRKYKQYRGMGSLGAMTGGIGAGTDRYFQEPRGHMKHTKVVPEGVEGVVPYRGTVSEVLFQLIGGLRASMGYCGAANLSEMKERAKLVRITSSGYQGEPPPRPPHNQ

SEQ ID NO: 17725 - protein, 420 aa, Methanothermobacter thermautotrophicus str. Delta H
MKSEELFRRASNVLPGGVSSPVRRFDPHPFFAAGGSGCLLESVDGESYIDYCLAYGPLILGHAHPRVVEAVNEQIKRGTTYGVPTEGEIELAEAIIERVPCAEMVRFTNSGTEATMAAVRLARAFTGRDRIVKFEGSYHGAHDYVLVRPGSGAATAPDSPGIPVDTVRNTLTVPFNHEEAMAELIEGAGEDIACILVEPVMGNIGCIEPENGYLQFLRDITRENDIILIFDEVITGFRLAPGGAQEYYRVEPDLVTLGKIVGGGFPMGALAGRREIMENISPAGNVYQAGTFNGNPVSVTAGRETLRLLDGRMYSDLERKGSTLRAGLRDLLSDLDLEYQVTGPASMFQLYFTGEEVRNYGDAKKSDTVLFMEYFHGLLERGVFIPPSQFECCFISAAHESEHIEATLEAAEEVLSGLKN

SEQ ID NO: 17726 - protein, 138 aa, Methanothermobacter thermautotrophicus str. Delta H
MIKSKGDVNILLNFRHNINGEDLIIAVAQDHETGEVLMVAYMNREALRRTLETGTAHYWSTSRGKLWLKGESSGHVQRVKDVLVDCDGDAVVLKVEQEGGACHTGYRSCFYRSIDGDELKVREDAVKVFDPEEIYGDG

SEQ ID NO: 17727 - protein, 413 aa, Methanothermobacter thermautotrophicus str. Delta H
MQILRGIGAGAGRSSGRVRIIRNLEDARNLEWGEVAVFRKISRDMLPEIRRAGAVIANYGGLTSHAAITLRELGIPCVLGTEVATEVLREGMIVTVDGKTGGIYRGVMDWVKAEDTPGFHETATDVMVNLNFPWLAPKVAEFADGVGSVRIENMVIETGKHPHLLLKEGKLAGVLEKGLREILEAFHPKPVIFRTFDIPVDELTNLRGSFEASERNPFLGMRAITRDLMEPEILMAEFEALGNLLDSGYRNLQLKFPFLRDVDEYVTAVELLEESGITPHRDIVVGASVETPSVALQIDELLAAGADFISLGMSDLTMCSLAVDRRSTRVAGLFNLSHHAVLGLVEDVIGACHEGGVNVYAAGYAATSYMLVRRLVEMGVDGISTSPDKILRMKYFIARIERSLMLRGAGRVE

SEQ ID NO: 17728 - protein, 424 aa, Methanothermobacter thermautotrophicus str. Delta H
MKPNLRRELGLFDAVNLVVGTIVGADIYIVAAYGAGSLGPASILAWLLAGLMALIIALVFSEASAMLPRTGGPYVYAGEALGRFTGFITGWSLWVSSWVAIAVFPLAFIYYLEYFIPLDPPAEAVIKVLFILSLTIINIAGVGRAGKVNDILTILKVAPVLLFAVLGAIHLALNPGLLVSNYTPAAPMGLGALGTVTVLVFWAYVGFELVTVPADEVRDPERTIPLSITLGMIFVTLFYILTNAVILGLVPWRVLASSTAPLTVAGYSLMGGIGALILTAGAVFSIAGSEEAGMLTTARLLFAMSEDGFLPGFLSRVHRRFGTPHMSILVQNLTALLAALTGTVSGLIELSVVTLLLPYAVTCISLAILRRRDGSGIPLKSVLGVLVCIYLLMNTTPSTTAWGLLLILSGAPLYLIFGFKRLRR

SEQ ID NO: 17729 - protein, 425 aa, Methanothermobacter thermautotrophicus str. Delta H
MTALINEFVNRVEFDSYEDFRDNFRINVPENFNFAYDVVDRYAEIEPDKVALVWCNDHGEEKRITFGELRDLSSRAANFFTKEGIQKGDTVMLTLKARYDFWYALLGLHRIGAIAIPATHMLKEKDIVYRIREADIKMVVCIAEDGVPEVFEGAIAELGSDTRRVLVGDTDRDGWINLRKEIMKLPADFERPEACAGGDDTLIVYFSSGTTGMPKMIEHDHTYPLGHIITAKYWQNVREDGLHYTVADTGWAKAMWGQIYGQWIAGSAVFVYDYDRFDPEKMLEKLEKYEITTFCAPPTIYRFLIKEDLSRYDLSGIEYAVTAGEPLNPEVFERFREHTGLQLMEGFGQTECVVCIANFPWMEPKPGSMGKPSPGYPVELVDRNGDPVDVGEEGEIVIRTAEGKPLGLFNGYYRNPEKTSEVWHD

SEQ ID NO: 17730 - protein, 273 aa, Methanothermobacter thermautotrophicus str. Delta H
MIRVAVTGACGRMGSGIIRRVLEEEDMELVAAIEAPGTPLRGRDIGEFTGRGSVGVEVTDASNLADTLAETEPDVLVDFTVASAAVETIKTSTEAGVNLVVGTTGFSEEEMQTVRDCIERSGVRAVIAPNMAVGVNVFFKVLRDLAPILSDYDVEIIEAHHRHKKDAPSGTAVRALEVISEATGRRASEVAVHGRSGLTGERSRDEIGVHAVRGGDIVGDHIVLFAGDGERLEIVHRAHSRDAFIGGVIRAIRFIEDAEPGRIMDMGDVLGIN

SEQ ID NO: 17731 - protein, 334 aa, Methanothermobacter thermautotrophicus str. Delta H
MKYGMFNELMEQPESLRRTLKSEGDRMARISNEILECRRIYLVGCGSSLSTCYSARDAIAMNYEVNMDVMTGYEFYYHRQIDYSDSAVIFTSQSGETADTLAALRRANELGLRTVTITNEPGSTMASESMETIVTRCGREEAILGTKTYMTQLLALYRILFGMYSDEKSDEIMGELEKLPGEVEDLLRRTEVECRDLAEEYSGEDIFYCMGSGPNYGLAYKLAMTMLMEGALKHSCPLYSGEFRHGLIERVEEGVPVIFLESGLPGDELTERALRFCEKLGAENLVFRMSDYSDLNGLMSPFVLAVPLEWFVYYLAHFNGEDPGSTRHIGKVRY

SEQ ID NO: 17732 - protein, 286 aa, Methanothermobacter thermautotrophicus str. Delta H
MLIHTHEPLKFAFSTTDHERIPELSFGIMGVPFDSTTSYVPGARFGPMAVREASYSFEAYNLRFSENVKVKSFDFGDLEVSPGNFMKTAGFIGDSVSEVLDMGLKPLIIGGEHTVTLPVIENLPEHDSLTVVHLDAHMDLADTYAGERYSHATVMRRVHELGAEIIQIGIRSASSEEAEFAGEEGVRFCMAHEVMGDPAGAIELIDGIRGPVYISVDMDVLDPAYAPSVGNPAPAGLTPHIMEELVLALSGKDVVGLDVVEVASGGMADPTSVNAAKIIYDILTLL

SEQ ID NO: 17733 - protein, 455 aa, Methanothermobacter thermautotrophicus str. Delta H
MEMIIDGEGVSGEKIFTVRNPFNGDEVDRVPLAGRSDVERAIRAAHRARDAMADLSARKISEKLYDVADELKTELDEFARLITLESGKPIRFSRDEVKRSVETARLSAEEAGRLYGESIPMDAGIGGKGLTGFTVRIPLGVVAAITPFNYPLNLAIHKVGPALAAGNTTILKPSLEAPLSALKLAWILSEHFPAGAVNAVTGRGSEVGDVIIDSPLVDKITFTGSVEVGRYISARASMKKITLELGGNDPLIVMDDADIDSAVEAAVRGSYLYSGQVCIAVKRMIVHEDVADEFADKLVNITGSLRAGDPMDVRTDVGPLINEDAAIEVERVIGAAVEDGAELLCGGSRRGNFVEPTVLDHVVPGMEVIERETFGPVSPIIRFNGADEAIRIANGTCYALQAGVFTENIRTALRMAREIEAGTVLVNKQSTFRVDHMPFGDSGAVEWVRRVSSTP

SEQ ID NO: 17734 - protein, 411 aa, Methanothermobacter thermautotrophicus str. Delta H
MMVIPVSFKFKTMDDIEVTGKTVLVRVDINSPVDPNDGTILDDTRMRLHAETIRELSDRGARTVVMAHQSRPGKNDFTTLEQHARALSGILRRPVKYVEDIFGSAARENISGLGDGEIILLENVRFYSEEVLKRDPEEQAETHLVRKLAPLLDYFINDAFAAAHRSQPSLVGFALRVPSAAGRVMERELRTLQGALENVERPCVYVLGGVKVDDSIMVMKNVLENGSADLVLTTGLVANIFLAGCGVKIGKVNMDFIKSRGYCDFIKVAKKLKKRFPERIVVPVDVAVCRDGKRVDVPVKKIPNHPIQDIGMETIKLYARRIREARTLFANGPAGVFENPDFSIGTEDILNAISSSEGFSIIGGGHLAAAAVKMGFEDSINHISSGGGASISLLAGEELPAVRVLEESRHP

SEQ ID NO: 17735 - protein, 331 aa, Methanothermobacter thermautotrophicus str. Delta H
MVIIHSPSYDLHNHEGHVENSGRTRAILRAIESSDLSPRFVEPGMAGIDDILMVHSSTHVEYLEVFAGRGGGWLDYDTYMTPESFSVARLSAGGAMLAAEEALRDGWSYSLGRPPGHHATYDRSMGFCIFNNIAIAIEHARRNLGVSRPLVLDFDVHHGNGTSSIFYRDRDVMYISIHQDPRTLFPGTGFIDETGSGEGEGFNLNIPMPRGSGNREYLWILGMILPAVLEGFRPDMIFVSAGFDAHRRDPLAEIMVDEEFFSWIGWFIHQTGLPCTAVLEGGYDPEALGRSNIAFMRGLDGEEYEPETAAPGGVSEIFSQLSDRFSAYFNF

SEQ ID NO: 17736 - protein, 370 aa, Methanothermobacter thermautotrophicus str. Delta H
MKCYLTGCIAGPLAFSEDLELIDYEPFPVDEIPGRLAESQMGGVSPEERIMLERLTPEYDEVVVEASPSPEYAGFRNLRFEVPSRAGIHLRENLEDILAEILDMPAGDFIHDALMSVARERLRESLRETDRFIIQSINALDELDEETGKLIERLREWYSLHFPELDGIKSHEQYVELIAEYGDRDQILKNFRMDVDESLGSDITSEDLHILRGLAESIRGLQRLREETERYIDIKMEKLAPNLRALAGSNVGARLIAHAGGLRELAMLPSSTIQVLGAEKALFRHLKSGAKPPKHGVIFQHPSIRSSPWWIRGKVARLLAGKIAIAVRKDVFSREFDPGIVESFNERFEAIKSNNPKPPARKKGFRKKRK

SEQ ID NO: 17737 - protein, 224 aa, Methanothermobacter thermautotrophicus str. Delta H
MYAVKEVKGMDGVFIMNNSLLTINPNPGVKVYGERIIDWGGREYRVWDPRRSKLAAAILNGLRGFSLNSDSRVLYLGASAGTTASHISDIVTDGRVYCIEFSPRMMRELLGVCESRKNMAPLLEDASRPLSYLRMVEAADLVYCDVAQPDQTRLFIENMDCFLKRDGYGLIMIKARSIDVTRSPRKIFREEVGKLESSGFRIIDQVGLNPYEKDHMAVLVKRDV

SEQ ID NO: 17738 - protein, 237 aa, Methanothermobacter thermautotrophicus str. Delta H
MLGAVATGVASRGVVPIENSIEGPVGVTLDLLAWEYDLCIEGEIILRVRHNLLVNRGVSLNEIREVYSHPQSLAQCRGFLEKLGVSTHSTPSTAAAARTIMGRRECAAIGTRRAADIYGLEVIAENIQDFDPNFTRFIVLSEGDHEPTGRDKTSIVFSLSEDKPGGLHEILGFFADAGVNLTKIESRPSKRGLGKYIFFVDFQGHRKDPHVMDILRSISDRTPFFKILGSYPEMTDY

SEQ ID NO: 17739 - protein, 376 aa, Methanothermobacter thermautotrophicus str. Delta H
MAKRDYYEILGVDRGADKKEIKKAYRRLARKYHPDVSDDPDAAEKFKEISEAYAVLSDDEKRARYDRFGHAGMDGFSQEDIFNNINFEDIFSGLGFDIGNIFDMFGFGGGRRHGPQRGADISYTLDISLEDAYNGLETDIRVPHTKKCPVCHGSRAEPGTGTRTCQTCGGSGQVRQVRNTILGQMMNITTCPDCQGEGTVVEKPCSNCNGKGVVRKTSTIHVKVPAGVETGSRLRVPGEGEMGLRGGEPGDLYVVIKVKPHSIFRREGANLYTEKPISFVQAALGDTVEVPTLDRPVKLRIPAGTQSGTTFRVKGHGMPHLKWNGYGNLYVKVKVVTPRKLSPRQKELLREFASISGDEIHEDKGFFDKVKDAIIH

SEQ ID NO: 17740 - protein, 390 aa, Methanothermobacter thermautotrophicus str. Delta H
MDSEEIIELERKFIMQTYTRQPIVLSHGKGATVWDIEGNSYIDCFAGVAVNSIGHAHPKVALAICHQAQRLIHSSNIYYTREQVELAKLLTAISPHDRVFFANSGAEANEGAIKLARKFTGKSEIIAAENSFHGRTLATVTATGQKKYSEPFRPLPEGFKHVPYGDIGAMADAVGDETAAIILEPVQGEGGVIIPPEGYLKDVQELARQNDVLLILDEVQTGFGRTGAMFASQLFGVEPDITTVAKAMGGGYPIGAVLANERVAMAFEPGDHGSTFGGNPWGCAAAIATIEVLMDEKLPERAAKMGSYFLGRLRQVLHGCDAVRDIRGVGLMIGIEIDGECAGVVDAAREMGVLINCTAGKVIRIVPPLVIKKEEIDAAVDVLGHVISDL

SEQ ID NO: 17741 - protein, 450 aa, Methanothermobacter thermautotrophicus str. Delta H
MRVVIVGGGAGGLSTASNIRKHDKDADIKVITRDKHVAYSPCAIPYVMCGEVECFDDIVMHRPEDYRERNIDILTETEVEAIDPQKKTVTYRGKDGLREIPYDVLVLATGGSPFIPPVEGTDLEGVFTIRTLTDGERITEWASKSKRAVVVGAGLIGLEIAYGLLRMGLEVTVTEMLPQIVPRSLDPDMAAIVQGYLEEKGIRVILGKALDRIVGDERVEGVVVGDECLEADLVVLATGVRPETKLARMAGCEIGQWAVKVNDRMQTSVPDIYAVGDCVEVYDAVTGFRTQSPLGSTAVRQARVAAKNIVGMDARFRPVLNAMVSKIGELEFGAVGLTEVMALQNGIKVVSGKKRALTKARYYPGAERIDVKMICDLRGRIIGCQMVAKERVAERVDTMSLAISQGLTCSELSETEFSYAPPVSMVIDPIILAAEDACEKLKRVNGRPQD

SEQ ID NO: 17742 - protein, 442 aa, Methanothermobacter thermautotrophicus str. Delta H
MSDKIGRIIAKMDECGVKFVRLQFVDIHGKPKNMAIPLVRPDQIEDIIKDGLLFDGSSVEGFVDINESDLVLKPDPDTFSTLPWRPEEKGVCRFICDIYWPDGKPFEGDPRYVLKRALDKYAHLGYEYNVGPEPEFFILDQDEDGNIIPHDCGAYFDVEPVDQGTDFRRKLVMDLEALNFDVEVSHHEVAPGQHEIDFKFDKALKTADAVITFKQAIKAIVDKIGYMVTFMPKPFFGENGSGMHCHQSLFKDGENVFYDPDTETQLSEEALYFIGGLLKHAPALTAVCAPTVNSYKRLVPGYEAPVYIAYGLKNRSTLIRIPASRGKGTRVELRMPDPSCNPYLAFAAMLEAGMNGIQNKIDPGEPTEIDVYEKSMSELREMGIETLPSSLWEAYHALEEDDVIKGALGGHVYEKFMEIKHREWDDYRVRVFKYELERYLDI

SEQ ID NO: 17743 - protein, 249 aa, Methanothermobacter thermautotrophicus str. Delta H
MWYYRTVGGGRCPIMDTWWQTETGMHIITPLPVTPLKPGSAGKPFPTVIADVVDDEGRSLRGSGGHLVIKTPWPAMFRTLFREPERYVDAYWSTFPGIYLSGDVARIDEDGYFWIQGREDDVLNVAGHRISTAEVESALVSHPDVVEAAVVGKPDILRGEEIAAFVTLRDKVEPTPRLKGVLREHVRREIGPIASPSYIEFVEDLPKTRSGKIMRRVIKAIVRGEDVGDVSTLSNPESVSMLEDRVRTF

SEQ ID NO: 17744 - protein, 431 aa, Methanothermobacter thermautotrophicus str. Delta H
MVSDMRCVVIGGGPAGRAAAMELAALDMDVILVEKKLIGGTCLNEGCMVVCGLNDVARFLDDARQLSDLGVLDVECSADYRRIAGGVKRTLERIRHVTERETLDAGIEIVYGVAEFEDDRLLVEGEEMDYDRLIIATGASPLIPPIEGASKAITYRDILDLDGIPDKLVIIGGGVIAAEFAGIFSSFGSEVTVVSRSGFLSKLDPLIRDYVSEKVLSDVRILEDTSTTEIDGSGVQTSGGYIEGLPMLATGLRPNSDFLKGFLELGPRGGVKVNDRMETSRQNVYAAGDVTGGHGTTPVARMEGVVAGLNAAGIERRVDYRYLPYSISLRYDVGFVDIPGEGGREAVIPGLAGPGSFWGVNNGKTGISKVRILDDGTPSGIYSVAPGARLIMPYLSLLMRLGVSMYEFEGFVETHPSTDSIYKLMRFLSRY

SEQ ID NO: 17745 - protein, 273 aa, Methanothermobacter thermautotrophicus str. Delta H
MIVMSGAKSMSYAEMFRRADGCAFVPFVVAGDPDMETSLEIIRTLVDAGADALEVGFPFSDPIADGTSVQGADLRALRAGMTTEKCFQLIERVREFTSIPIGLLVYYNLIYRMGVDEFYRRAAEAGVTGILAADLPPEEASDALRAAEKYDIDQIFIVAPTTGSERLKRISEVSSGFHYLVSVMGVTGARSRVEDATIELIKRVKAEGSLPVMVGFGVSRPEHVRMLRDAGADGVIVGSAIIDVISGNLGDRELMLQRIHEMAGTLKAAGGSG

SEQ ID NO: 17746 - protein, 264 aa, Methanothermobacter thermautotrophicus str. Delta H
MPDYLFDFLDELKFLRNGRKTAIITDIDGTISEIAPTPEEAVVDDEMRDVLRDLASRYRVLAFISGRPVREALRMVGVPGAVYVGNHGLEYIINGNYQRFSEVEEYIPLIKKCALELRDKIDEENVIFEDKGICYSIHYRQCTDPELSRKRILKNLQEIPESKGLKVDHGRMLVELKPPLHYNKGFIVRKILEDSDVSSAVYLGDDITDADAFREIRKLESERGMKNVPILVLSKEIPPEVKNSARFFVYGISEVLRFFRWLLK

SEQ ID NO: 17747 - protein, 290 aa, Medicago sativa
MEAKEQDVSLGANKFPERQPIGIAAQSHDDGKDYKEPPPAPLFEPSELTSWSFYRAGIAEFVATFLFLYITLLTVMGVNRSESKCKTVGIQGIAWSFGGMIFALVYCTAGISGGHINPAVTFGLFLARKLSLTRALFYMVMQTLGAICGAGVVKGFEGKTFYTNKNGGANFVAPGYTKGDGLGAEIVGTFVLVYTVFSATDAKRSARDSHVPILAPLPIGFAVFLVHLATIPITGTGINPARSLGAAIIFNKDLGWNDHWIFWVGPFIGAALAALYHTVVIRAIPFKSSN

SEQ ID NO: 17748 - protein, 165 aa, Fischerella sp. PCC 7605
MQRLFALILAIFLWFHFAPPAQALGADLVPCSESPAFQQRAQVARNTTADPESGKKRFERYSQALCGPEGLPHLIVDGRLDHAGDFLIPSILFLYIAGWIGWVGRAYLQTIKKQGSNVEQKEIQIELPIALPIMLSGFAWPAAAIKEFLSGELTAKDEEITISPR

SEQ ID NO: 17749 - protein, 302 aa, Apium graveolens
MAAVEDPIVPMEGVEEEVPVTVTEAPEEAAPPAEDPAPKKGKELKPKKAAAPRKPRSAPAHPPYLEMITDAITSLKERTGSSQQAIQKFLEAKHKDLPAVFRKMLSNNLKKLVAAGKLVKVKASYKLPSAKSSAPAKKKPAAAPAKKKAAAAPAKKKTAAAPKKKAAAAPKKKAPVAKAKPAAKPKAKAVVKPKAKAAVKPKAKPAAKPAAKAKPAAKAKPAAKPKAKAKPAKVARTSTRTTPGKKAPAKPAAAPVKKATPVKKATATPVKKAAPVKKAAPAKGKSVKTPVKRTSARKAGKK

SEQ ID NO: 17750 - protein, 371 aa, Agrobacterium tumefaciens
MTSLFEPAQAGDIALANRIVMAPLTRNRSPGAIPNNLNATYYEQRATAGLIVTEGTPISQQGQGYADVPGLYKREAIEGWKKITDGVHSAGGKIVAQIWHVGRISHTSLQPHGGQPVAPSAITAKSKTYIINDDGTGAFAETSEPRALTIDDIGLILEDYRSGARAALEAGFDGVEIHAANGYLIEQFLKSSTNQRTDDYGGSIENRARFLLEVVDAVAEEIGAGRTGIRLSPVTPANDIFEADPQPLYNYVVEQLGKRNLAFIHVVEGATGGPRDFKQGDKPFDYASFKAAYRNAGGKGLWIANNGYDRQSAIEAVESGKVDAVAFGKAFIANPDLVRRLKNDAPLNAPNQPTFYGGGAEGYTDYPALAQ

SEQ ID NO: 17751 - protein, 259 aa, Helianthus annuus
ANYGGDKQYGRETRHTGDYESPIHSTGGQYEQEVLQTDEYGNPVRRTGQTDEYGNPVRRTDEYGNPVHSTTGGTMGDYGSTGLGQGTGTGGIGTGGYGTTGHHGLGTGVGHTTGGTGTDYTSGGRSTGQTGYQGLGTESDFGGKTGTFQNQPSATPVGGVGLNSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 17752 - protein, 403 aa, Lactobacillus delbrueckii
MAKLIVSDVDVKDKKVLVRVDFNVPIKDGVIGDDNRIVAALPTIKYIIENGGKAILLSHLGRIKSDEDKKSLSLAPVAKRLGELLEKPVTFVPSNEGKEVEDAINNMKDGDVVVLENTRFQDIDNDFGKRESKNDPKLGEYWASLGDVFVNDAFGTAHRSHASNVGIATAMKAAGKPAAAGFLLEKEIKFLGNAVANPVHPFVTILGGAKVSDKIGVITNLIPKADHIIIGGGMAYTFLKAQGHNIGKSLVEDDKVEFAKELLEKAGDKLVLPIDNVAATEFNNDAASEVVGQDIPDNEMGLDIGPKTIELFKKTLEGAKTVVWNGPMGVFEMPNFAKGTLEVGRALADLPDATTIVGGGDSTAAAKQLGIAPKLTHISTGGGASLEYLEGKELPGIACVSDK

SEQ ID NO: 17753 - protein, 252 aa, Lactobacillus delbrueckii
MSRTPIIAGNWKLNMNPKETVEFVNAVKDQLPDPSKVESVICAPAVDLDALLKAAEGSNLHVGAENCYWENSGAFTGETSPAVLKEMGVQYVIIGHSERRDYFHETDEDINKKAKAIFANGLTPILCCGESLETREAGKENEWVVSQIKAGLEGLTSEQVSKLVIAYEPIWAIGTGKTASSDQAEEMCKTIRETVKDLYNEETAENVRIQYGGSVKPANVKELMAKPNIDGGLVGGASLVPDSYLALVNYQD

SEQ ID NO: 17754 - protein, 355 aa, Phaseolus vulgaris
FTVYGEHWRTMRTIMNLPFFTKKGVHNYSTMWEEEMELVVRDLKVNEHVRSEGIVIRKRLQLMLYNIMYRMMFDAKFESQEDPLFIQATRFNSERSRLAQSFEYNYGDFIPLLRPFLRGYLNKCKDLQSRRLAFFNTHYVQKRRQIMAANGEKHKISCAIDHIIDAQMKGEISEENVIYIVENINVAAIETTLWSMEWAIAELVNHPSVQSKIRDEISEVLKGEPVTESNLHELPYLQATVKETLRLHTPILLLVPHMNLEEAKLGGYTVPKESKVVVNAWWLANNPSWWKNPEEFRPERFLEEECATDAVAGGKVDFRFVPFGVGRRSCPGIILALPILGLVIAKMVSNFELSA

SEQ ID NO: 17755 - protein, 462 aa, Erwinia pyrifoliae
  misc_feature (354)..(354): Xaa can be any naturally occurring amino acid
  misc_feature (381)..(381): Xaa can be any naturally occurring amino acid
MMKNVSSAVAVSRNPATGEVFARYPFATIAEVDSALALTNGAFQYWRHSAMSDRVQLLCNVADALRQQARELAEMMTSEMGKPVDQGLAEVEKSARLCEWYAGHGPAFLQREPTLVEGNKAFVDYLPLGPVLSVMPWNFPVWQVLRGAVPILLAGNSYLLKPAPNVMGCALLLQQILTRVGVPEGLFAVVNADNDGVAQAINDRRIAAVTVTGSVRAGAAIAALSGAAIKKCVLELGGSDAFIVLADADIDAAVKGAIAGRFMNNGQLCISAKRIIVEAPVFDAFRDKFVSAVKEMKIGDPRESGTWIGPMARYDLRDELDSQVQATLKEGATLLLGGHVLPGEGNYYAPTVLXDVKPGMTSFAQELFGPVASLIQADNAXHAVAMANDSEFGLGGSMWSRDLAVAQKLASRIETGGVFINSPSFSDPRVPIGGVKKSGFGRELSHFGLREFTNTQTVWMEE

SEQ ID NO: 17756 - protein, 195 aa, Cicer pinnatifidum
MSQYNQGQYVDQTRTVDEYGNPIVQVDQYGNPINQSGVGMTGEAGRTFENPGLTGHDNSKSHTTSYGTHTGSGGGTGDGYGTYNTRGGGDGGTYNTRGGSGMTGEVGKIFGTTDDTGNHHGVDQTTTDYGTHNTGSYGTHTGGYGNTNTGSGYGNTKVGQEFGREEPRHHGGEQQHGEKKGIMDKIKEKLPGTGH

SEQ ID NO: 17757 - protein, 376 aa, Escherichia coli CFT073
MAKQDYYEILGVSKTAEEREIKKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETPVGLNEKQKQLLQELQESFGGPTGEHNSPRSKSFFDGVKKFFDDLTR

SEQ ID NO: 17758 - protein, 443 aa, Escherichia coli CFT073
MQPSRNFDDLKFSSIHRRILLWGSGGPFLDGYVLVMIGVALEQLTPALKLDADWIGLLGAGTLAGLFVGTSLFGYISDKVGRRKMFLIDIIAIGVISVATMFVSSPVELLVMRVLIGIVIGADYPIATSMITEFSSTRQRAFSISFIAAMWYVGATCADLVGYWLYDVEGGWRWMLGSAAIPCLLILIGRFELPESPRWLLRKGRVKECEEMMIKLFGEPVAFEEEQPQQTRFRDLFNRRHFPFVLFVAAIWTCQVIPMFAIYTFGPQIVGLLGLGVGKNAALGNVVISLFFMLGCIPPMLWLNTAGRRPLLIGSFAMMTLALAVLGLIPDMGIWLVVMAFAVYAFFSGGPGNLQWLYPNELFPTDIRASAVGVIMSLSRIGTIVSTWALPIFINNYGISNTMLMGAGISLFGLLISVAFAPETRGMSLAQTSNMTIRGQRMG

SEQ ID NO: 17759 - protein, 347 aa, Escherichia coli CFT073
MRIEEDLKLGFKDVLIRPKRSTLKSRSDVELERQFTFKHSGQSWSGVPIIAANMDTVGTFSMASALASFDILTAVHKHYSVEEWQAFINNSSADVLKHVMVSTGTSDADFEKTKQILDLNPALNFVCIDVANGYSEHFVQFVAKAREAWPTKTICAGNVVTGEMCEELILSGADIVKVGIGPGSVCTTRVKTGVGYPQLSAVIECADAAHGLGGMIVSDGGCTTPGDVAKAFGGGADFVMLGGMLAGHEESGGRIVEENGEKFMLFYGMSSESAMKRHVGGVAEYRAAEGKTVKLPLRGPVENTARDILGGLRSACTYVGASRLKELTKRTTFIRVQEQENRIFNNL

SEQ ID NO: 17760 - protein, 456 aa, Escherichia coli CFT073
MEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGAWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 17761 - protein, 495 aa, Escherichia coli CFT073
MDNGRHKKNVRPAGDKYIEVMMSTEIKTQVVVLGAGPAGYSAAFRCADLGLETVIVERYNTLGGVCLNVGCIPSKALLHVAKVIEEAKALAEHGIVFGEPKTDIDKIRTWKEKVINQLTGGLAGMAKGRKVKVVNGLGKFTGANTLEVEGENGKTVINFDNAIIAAGSRPIQLPFIPHEDPRIWDSTDALELKEVPERLLVMGGGIIGLEMGTVYHALGSQIDVVEMFDQVIPAADKDIVKVFTKRISKKFNLMLETKVTAVEAKEDGIYVTMEGKKAPAEPQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEVFEGSITDLPNPKAKKK

SEQ ID NO: 17762 - protein, 288 aa, Escherichia coli CFT073
MAEKKQWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVESITMVEIDAGVVSFCRQYLPNHNAGSYDDPRFKLVIDDGVNFVNQTSQTFDVIISDCTDPIGPGESLFTSAFYEGCKRCLNPGGIFVAQNGVCFLQQEEAIDSHRKLSHYFSDVGFYQAAIPTYYGGIMTFAWATDNDALRHLSTEIIQARFLASGLKCRYYNPAVHTAAFALPQYLQDALASQPS

SEQ ID NO: 17763 - protein, 191 aa, Escherichia coli CFT073
MRSDLFLNHMVIDMKHTVEVMIPEAEIKARIAELGRQITERYKDSGSDMVLVGLLRGSFMFMADLCREVQVSHEVDFMTASSYGSGMSTTRDVKILKDLDEDIRGKDVLIVEDIIDSGNTLSKVREILSLREPKSLAICTLLDKPSRREVNVPVEFIGFSIPDEFVVGYGIDYAQRYRHLPYIGKVILLDE

SEQ ID NO: 17764 - protein, 426 aa, Escherichia coli CFT073
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKHTLTCTYNDLASVRAAFEQYPQEIACIIVEPVAGNMNCVPPLPEFLPGLRALCDEFGALLIIDEVMTGFRVALAGAQDYYGVEPDLTCLGKIIGGGMPVGAFGGRRDVMDALAPTGPVYQAGTLSGNPIAMAAGFACLNEVAQPGVHETLDELTTRLAEGLREAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 17765 - protein, 329 aa, Escherichia coli CFT073
  misc_feature (271)..(271): Xaa can be any naturally occurring amino acid
  misc_feature (277)..(277): Xaa can be any naturally occurring amino acid
  misc_feature (296)..(296): Xaa can be any naturally occurring amino acid
  misc_feature (302)..(302): Xaa can be any naturally occurring amino acid
  misc_feature (308)..(308): Xaa can be any naturally occurring amino acid
  misc_feature (315)..(315): Xaa can be any naturally occurring amino acid
  misc_feature (318)..(318): Xaa can be any naturally occurring amino acid
  misc_feature (325)..(325): Xaa can be any naturally occurring amino acid
  misc_feature (327)..(327): Xaa can be any naturally occurring amino acid
MTNKHPSLFSPFMLTEKIKLRNRIVMAPMTTWSANPDGTISEQELEFYKRRSQNVGLVITGCTYVTPSGIGFTHEFAAYDDRFINSLEKLAAAAKSGGAPAILQIFHAGNKAIPELVPNNDVISASASSVKSGDFMKRVVQSREMTENEIQETIRAFGDVTKRAIKAGFDGVELHGAHGFLLQNFFSPLFNQRNDRWGGDLEGRMRFPLAVLQEVKNVVYEYATKPFAIGYRISPEESVTGGLRIEDTYKLLDRLISSGISYIHTSLVSIXIATLLXLPNGPRTIELILNHIAGRXTGNRRXKIHTPXQAQEAIXRWXATCCDPXKXWR

SEQ ID NO: 17766 - protein, 329 aa, Escherichia coli CFT073
MQKRYLGKSGLEVSALGLGCMGLSHGYGPATDTRQAIELIRAAVERGVTFFDTAEVYGPYLNEEVVGEALKPFRDRVVIATKFGFTFGNDNKQQILNSRPEHIREAVEGSLRRLKTDVIDLLYQHRVDPDVPIEDVAGTVKDLIAEGKVKHFGLSEAGAQTIRRAHAVQPVTALQSEYSMWWREPEQEILPLLEELGIGFVPFSPLGKGFLTGAIKPGTTFGKDDYRSTVPRFAAQAIEANEKLVTLLGELAAEKGVTSAQIALAWLLAQKPWIVPIPGTTKLHRLEENLAAADIVLSQKDTQQISEALETIKIVGERYSPEHQARVGR

SEQ ID NO: 17767 - protein, 450 aa, Escherichia coli CFT073
MNAFRQEIIMNKYQAVIIGFGKAGKTLAVTLAKAGWRVALIEQSNAMYGGTCINIGCIPTKTLVHDAQQHTDFVRAIQRKNEVVNFLRNKNFHNLADMPNIDVIDGQAEFINNHSLRVHRPGRNLEIHGEKIFINTGAQAVVPPIPGITTTPGVYDSTGLLNLKELPGHLGILGGGYIGVEFASMFANFGSKVTILEAASLFLPREDRDIADNIATILRDQGVDIILNAHVERISHHENQVQVHSEHAQLAVDALLIASGRQPATASLHPENAGIAVNERGAIVVDKQLHTTANNIWAMGDVTGGLQFTYISLDDYRIVRDELLGEGRRSTDDRKNVPYSVFMTPPLSRVGMTEEQARESGADIQVVTLPVAAIPRARVMNDTRGVLKAIVDNKTQRILGASLLCVDSHEMINIVKMVMDAGLPYSILRDQIFTHPSMSESLNDLFSLVK

SEQ ID NO: 17768 - protein, 491 aa, Escherichia coli CFT073
MMSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTDHPGIAKVSFTGGVASGKKVMANSAASSLKEVTMELGGKSPLIVFDDADLDLAADIAMMANFFSSGQVCTNGTRVFVPTKCKAAFEQKVLARVERIRAGDVFDPQTNFGPLVSFPHRDNVLRYIAKGKEEGARVLCGGNVLKGDSFDNGAWVAPTVFTDCSDDMTIVREEIFGPVMSILTYESEDEVIRRANDTDYGLAAGIVTADLNRAHRVIHQLEAGICWINTWGESPAEIPVGGYKHSGIGRENGVMTLQSYTQVKSIQVEMAKFQSIF

SEQ ID NO: 17769 - protein, 349 aa, Escherichia coli CFT073
MKIKAVGAYSAKQPLESMDITRREPGPHDVKIEIAYCGVCHSDIHQVRSEWAGTVYPCVPGHEIVGRVVAVGDQVEKHAPGDLVGVGCIVDSCKHCEECEDGLENYCDHMTGTYNSPTPDEPGHTLGGYSQQIVVHERYVLRIRHPQEQLAAVAPLLCAGITTYSPLRHWLAGPGKKVGVVGIGGLGHMGIKLAHAMGAHVVAFTTSESKREAAKALGADEVVNSRNADEMVAHVKSFDFILNTVAAPHNLDDFTTLLKRDGTITLVGAPATPHKSPEVFNLIMKRRAIAGSMIGGIPETQEMLDFCAEHGIVADIEMIRADQINEAYERMLRGDVKYRFVIDNRTLTD

SEQ ID NO: 17770 - protein, 369 aa, Escherichia coli CFT073
  misc_feature (91)..(91): Xaa can be any naturally occurring amino acid
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTEXCGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFELARRFGATDCINPNDYDKPIKDVLLDINKWGIDHTFECIGNVNVMRAALESAHRGWGQSVIIGVAGSGQEISTRPFQLVTGRVWKGSAFGGVKGRSQLPGMVEDAMKGDIDLEPFVTHTMSLDEINDAFDLMHEGKSIRTVIRY

SEQ ID NO: 17771 - protein, 458 aa, Escherichia coli CFT073
MMESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVWFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 17772 - protein, 234 aa, Escherichia coli CFT073
MVVSFIAFSKNSTHFKGIFAMRIILLGAPGAGKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAGNTKYAKVDGTKPVAEVRAALEKILG

SEQ ID NO: 17773 - protein, 319 aa, Escherichia coli CFT073
MKPENKLPVLDLISAEMKTVVNTLQPDLPPWPATGTIAEQRQYYTLERRFWNVGAPEMATRAYRVPTKYGQVKTRIFYPQPDRPATLFYLHGGGFILGNLDTHDRIMRLLASYSQCTVIGIDYTLSPEARFPQAIEEIVAACCYFHQQAEDYQINMSRIGFAGDSAGAMLALASALWLRDKQIDCGKVAGVLLWYGLYGLRDSVTRRLLGGVWDGLTQQDLQMYEEAYLSNDADRESPYYCLFNNDLTREVPPCFIAGAEFDPLLDDSRLLYQTLAAHQQPCEFKLYPGTLHAFLHYSRMMKTADEALRDGAQFFTAQL

SEQ ID NO: 17774 - protein, 310 aa, Escherichia coli CFT073
MLDANKLQQAVDQAYTQFHSLNGGQNADYIPFLANVPGQLAAVAIVTSDGNVYSAGDSDYRFALESISKVCTLALALEDVGPQAVQDKVGADPTGLPFNSVIALELHGGKPLSPLVNAGAIATTSLINAENTEQRWQRILHIQQQLAGEQVALSDEVNQSEQTTNFHNRAIAWLLYSAGYLYCDAMEACDVYTRQCSTLINTIELATLGATLAAGGVNPLTHKRVLQADNVPYILAEMMMEGLYGRSGDWAYRVGLPGKSGVGGGILAVVPGVMGIAAFSPPLDEEGNSVRGQKMVASVAKQLGYNVFKG

SEQ ID NO: 17775 - protein, 292 aa, Escherichia coli CFT073
MKLGFIGLGIMGTPMAINLARAGHQLHVTTIGPVADELLSLGAVSVETARQVTDASDIIFIMVPDTPQVEDVLFGENGCTKVSLKGKTIVDMSSISPIETKRFARQVNELGGDYLDAPVSGGEIGAREGTLSIMVGGDEAVFERVKPLFELLGKNITLVGGNGDGQTCKVANQIIVALNIEAVSEALLFASKAGADPVRVRQALMGGFASSRILEVHGERMIKRTFNPGFKIALHQKDLNLALQSAKALALNLPNTATCQELFNTCAANGGSQLDHSALVQALELMANHKLA

SEQ ID NO: 17776 - protein, 164 aa, Escherichia coli CFT073
MVTFHTNHGDIVIKTFDDKAPETVKNFLDYCREGFYNNTIFHRVINGFMIQGGGFEPGMKQKATKEPIKNEANNGLKNTRGTLAMARTQAPHSATAQFFINVVDNDFLNFSGESLQGWGYCVFAEVVEGMDVVDKIKGVATGRSGMHQDVPKEDVIIESVTVSE

SEQ ID NO: 17777 - protein, 472 aa, Escherichia coli CFT073
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASINNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRKVN

SEQ ID NO: 17778 - protein, 241 aa, Escherichia coli CFT073
MITLKNVSKWYGHFQVLTDCSTEVKKGEVVVVCGPSGSGKSTLIKTVNGLEPVQQGEITVDGIVVNDKKTDLAKLRSRVGMVFQHFELFPHLSIIENLTLAQVKVLKRNKAPAREKALKLLERVGLSAHANKFPAQLSGGQQQRVAIARALCMDPIAMLFDEPTSALDPEMINEVLDVMVELANEGMTMMVVTHEMGFARKVANRVIFMDEGKIIEDSPKGAFFDNPKSDRAKDFLAKILH

SEQ ID NO: 17779 - protein, 255 aa, Escherichia coli CFT073
MRSKYMAVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 17780 - protein, 240 aa, Escherichia coli CFT073
MIEFKNVSKHFGPTQVLHNIDLNIAQGEVVVIIGPSGSGKSTLLRCINKLEEITSGDLIVDGLKVNDPKVDERLIRQEAGMVFQQFYLFPHLTALENVMFGPLRVRGANKEEAEKLARELLAKVGLAERAHHYPSELSGGQQQRVAIARALAVKPKMMLFDEPTSALDPELRHEVLKVMQDLAEEGMTMVIVTHEIGFAEKVASRLIFIDKGRIAEDGDPQVLIKNPPSQRLQEFLQHVS

SEQ ID NO: 17781 - protein, 233 aa, Escherichia coli CFT073
MDMFRKLAAECFGTFWLVFGGCGSAVLAAGFPELGIGFAGVALAFGLTVLTMAFAVGHISGGHFNPAVTIGLWAGGRFPAKEVVGYVIAQVVGGIVAAALLYLIASGKTGFDAAASGFASNGYGEHSPGGYSMLSALVVELVLSAGFLLVIHGATDKFAPAGFAPIAIGLALTLIHLISIPVTNTSVNPARSTAVAIFQGGWALEQLWFFWVVPIVGGIIGGLIYRTLLEKRD

SEQ ID NO: 17782 - protein, 1342 aa, Escherichia coli CFT073
MQHHRYFTITLSCTFQNNRSNGMGTTTMGVKLDDATRERIKSAATRIDRTPHWLIKQAIFSYLEQLENSDTLPELPALLSGAANESDEAPTPAEEPHQPFLDFAEQILPQSVSRAAITAAYRRPETEAVSMLLEQARLPQPVAEQAHKLAYQLADKLRNQKNASGRAGMVQGLLQEFSLSSQEGVALMCLAEALLRIPDKATRDALIRDKISNGNWQSHIGRSPSLFVNAATWGLLFTGKLVSTHNEASLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEEADRLEISLDLLEKLCFEPELAGWNGIGFVIQAYQKRCPLVIDYLIDLATRSRRRLMIRLVKGAYWDSEIKRAQMDGLEGYPVYTRKVYTDVSYLACAKKLLAVPNLIYPQFATHNAHTLAAIYQLAGQNYYPGQYEFQCLHGMGEPLYEQVTGKVADGKLNRPCRIYAPVGTHETLLAYLVRRLLENGANTSFVNRIADTSLPLDELVADPVTAVEKLAQQEGQTGLPHPKIPLPRDLYGHGRDNSAGLDLANEHRLASLSSALLNSALQKWQSLPMLEQPVAAGEMSPVINPAEPKDIVGYVREATPREVEQALESAVNNAPIWFATPPAERAAILHRAAVLMESQMQQLIGILVREAGKTFSNAIAEVREAVDFLHYYAGQVRDDFANETHRPLGPVVCISPWNFPLAIFTGQIAAALAAGNSVLAKPAEQTPLIAAQGIAILLEAGVPPGVVQLLPGRGETVGAQLTGDDRVRGVMFTGSTEVATLLQRNIASRLDAQGRPIPLIAETGGMNAMIVDSSALTEQVVIDVLASAFDSAGQRCSALRVLCLQDEIADHTLKMLRGAMAECRMGNPGRLTTDIGPVIDSEAKANIERHIQTMRSKGRQVFQAVRENSEDAREWQSGTFVAPTLIELDDFAELQKEVFGPVLHVVRYNRNQLPELIEQINASGYGLTLGVHTRIDETIAQVTGSAQVGNLYVNRNMVGAVVGVQPFGGEGLSGTGPKAGGPLYLYRLLANRPESALAVTLARQDAEYPVDAQLKAALTQPLNALREWAANRPELQALCTQYGELAQAGTQRLLPGPTGERNTWTLLPRERVLCIADDEQDALTQLAAVLAVGSQMLWPDDALHRQLVKALPSAVSERIQLAKAENITAQPFDAVIFHGDSDQLRALCEAVAARDGAIVSVQGFARGESNILLERLYIERSLSVNTAAAGGNASLMTIG

SEQ ID NO: 17783 - protein, 482 aa, Neisseria meningitidis
GSADAEYDVVVLGGGPGGYSAAFAAADEGLKVAIVERYKTLGGVCLNVGCIPSKALLHNAAVIDEVRHLAANGIKYPEPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASARKITKANFPWAASGRAIANGCDKPFTKLIFDAETGRIIGGGIVGPNGGDMIGEVCLAIEMGCDAADIGKTIHPHPTLGESIGMAAEVALGTCTDLPPQKK

SEQ ID NO: 17784 - protein, 268 aa, Escherichia coli CFT073
MERYESLFAQLKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKMLAALKAFVQPMKAATRS

SEQ ID NO: 17785 - protein, 479 aa, Escherichia coli CFT073
MSVPVQHPMYIDGQFVTWRGDAWIDVVNPATEAVISRIPDGQAEDARKAIDAAERAQPEWEALPAIERASWLRKISAGIRERATEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKSIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEEAISMANDSDYGLTSSIYTQNLNVAMKAIKGLKFGETYINRENFEAMQGFHAGWRKSGIGGADGKHGLHEYLQTQVVYLQS

SEQ ID NO: 17786 - protein, 474 aa, Escherichia coli CFT073
MQHKLLINGELVSGEGEKQPVYNPATGDVLLEIAEASAEQVNAAVRAADAAFAEWGQTTPKARAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINVLFGRGKTVGDPLTGHPKVRMVSLTGSIATGEHIISHTAPSIKRTHMELGGKAPVIVFDDADIEAVVEGVRTFGYYNAGQDCTAACRIYAQKGIYDTLVEKLGAAVATLKSGSPDDESTELGPLSSLAHLERVSKAVEEAKATGHIKVITGGEKRKGNGYYYAPTLLAGALQDDAIVQKEVFGPVVSVTLFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 17787 - protein, 1015 aa, Escherichia coli CFT073
  misc_feature (196)..(196): Xaa can be any naturally occurring amino acid
MDVSRRQFFKICAGGMAGTTVAALGFAPKQALAQARNYKLLRAKEIRNTCTYCSVGCGLLMYSLGDGAKNAREAIYHIEGDPDHPVSRGALCPKGAGLLDYVNSENRLRYPEYRAPGSDKWQRISWEEAFSRIAKLMKADRDANFIEKNEQGVTVNRWLSTGMLCASGASNETGMLTQKFARSLGMLAVDNQARVXHGPTVASLAPTFGRGAMTNHWVDIKNANVVMVMGGNAAEAHPVGFRWAMEAKNNNDATLIVVDPRFTRTASVADIYAPIRSGTDITFLSGVLRYLIENNKINAEYVKHYTNASLLVRDDFAFEDGLFSGYDAEKRQYDKSSWNYQFDENGYAKRDDTLTHPRCVWNLLKAHVSRYTPDVVENICGTPKADFLKVCEVLASTSAPDRTTTFLYALGWTQHTVGAQNIRTMAMIQLLLGNMGMAGGGVNALRGHSNIQGLTDLGLLSTSLPGYLTLPSEKQVDLQSYLEANTPKATLADQVNYWSNYPKFFVSLMKSFYGDAAQKENNWGYDWLPKWDQTYDVIKYFNMMDEGKVTGYFCQGFNPVASFPDKNKVVSCLSKLKYMVVIDPLVTETSTFWQNHGESNDVDPASIQTEVFRLPSTCFAEEDGSIANSGRWLQWHWKGQDAPGEARNDGEILAGIYHHLRELYQAEGGKGVEPLIKMSWNYKQPHEPQSDEVAKENNGYALEDLYDANGVLIAKKGQLLSSFAHLRDDGTTASSCWIYTGSWTEQGNQMANRDNSDPSGLGNTLGWAWAWPLNRRVLYNRASADINGKPWDPKRMLIQWNGSKWTGNDIPDFGNAAPGTPTGPFIMQPEGMGRLFAINKMAEGPFPEHYEPIETPLGTNPLHPNVVSNPVVRLYEQDALRMGKKEQFPYVGTTYRLTEHFHTWTKHALLNAIAQPEQFVEISETLAAAKGINNGDRVTVSSKRGFIRAVAVVTRRLKPLNVNGQQVETVGIPIHWGFEGVARKGYIANTLTPNVGDANSQTPEYKAFLVNIEKA

SEQ ID NO: 17788 - protein, 308 aa, Escherichia coli CFT073
MAVAMDNAILENILRQVRPLIGQGKVADYIPALATVDGSRLGIAICTVDGQLFQAGDAQERFSIQSISKVLSLVVAMRHYSEEEIWQRVGKDPSGSPFNSLVQLEMEQGIPRNPFINAGALVVCDMLQGRLSAPRQRMLEVVRGLSGVSDISYDTVVARSEFEHSARNAAIAWLMKSFGNFHHDVTTVLQNYFHYCALKMSCVELARTFVFLANQGKAIHIDEPVVTPMQARQINALMATSGMYQNAGEFAWRVGLPAKSGVGGGIVAIVPHEMAIAVWSPELDDAGNSLAGIAVLEQLTKQLGRSVY

SEQ ID NO: 17789 - protein, 470 aa, Escherichia coli CFT073
MTHKGDTPMTITPATHAISINPATGEQLSVLPWAGVDDIENALQLAAAGFRDWREANIDYRAEKLRDIGKALRARSEEMAQMITREMGKPINQARAEVAKSANLCDWYAEHGPAMLKAEPTLVENQQAVIEYRPLGTILAIMPWNFPLWQVMRGAVPIILAGNGYLLKHAPNVMGCAQLIAQVFKDAGIPQGVYGWLNADNDGVSLMIKDSRIAAVTVTGSVRAGAAIGAQAGAALKKCVLELGGSDPFIVLNDADLELAVKAAVAGRYQNTGQVCAAAKRFIIEEGIASAFTERFVAAAAALKMGDPRDEENALGPMARFDLRDELHHQVEKTLAQGARLLLGGEKMAGAGNYYPPTVLANVTPEMTAFREEMFGPVAAITIAKDAEHALELANDSEFGLSATIFTTDETQARQMAARLECGGVFINGYCASDARVAFGGVKKSGFGRELSHFGLHEFCNIQTVWKDRI

SEQ ID NO: 17790 - protein, 481 aa, Escherichia coli CFT073
MCMSGFKKDFLWGGAVAAHQLEGGWNEGGKGISIADVMTAGAHGVPREVTEGVIDGLNYPNHEAIDFYHRYKTDIQLFAGMGFKCFRTSIAWTRIFPQGDEQEPNEEGLQFYDDLFDECLKQGMEPVVTLSHFEMPYHLVTKYGGWRNRKLIDFFIHFASTVFTRYKEKVKYWMTFNEINNQVNFSESLCPFTNSGILYSPEEDLNEREQIMYQAVHYELVASALAVQTGKLINPEFNIGCMIAMCPIYPLTCAPNDMMMATKAMHRRYWFTDVHARGYYPQHMLNYFARKGFNLDITPDDNAILARGCVDFIGFSYYMSFTTQFSPDNPQLDYVEPRDLVSNPYIDTSEWGWQIDPAGLRYSLNWFWDHFQLPLFIVENGFGAVDQRQADGTVNDHYRIDYFSSHIREMKKAVVEDGVDLIGYTPWGCIDLVSAGTGEMKKRYGMIYVDKDNEGKGTLERIRKASFYWYRDLIANNGENI

SEQ ID NO: 17791 - protein, 365 aa, Escherichia coli CFT073
MSSEKLYSPLKVGAITAANRIFMAPLTRLRSIEPGDIPTPLMAEYYRQRASAGLIISEATQISAQAKGYAGAPGIHSQEQIAAWKKITAGVHAENGHMAVQLWHTGRISHASLQPGGQAPVAPSALSAGTRTSLRDENGQAIRVETSMPRALELGEIPGIVNDFRQAIANAREAGFDLVELHSAHGYLLHQFLSPSSNHRTDQYGGSVENRARLVLEVVDAGIEEWGADRIGIRISPIGTFQNTDNGPNEEADALYLIEQLGKRGIAYLHMSEPDWAGGEPYTDAFREKVRARFHGPIIGAGAYTVEKAETLIGKGLIDAVAFGRDWIANPDLVARLQRKAELNPQRAESFYGGGAEGYTDYPTL

SEQ ID NO: 17792 - protein, 457 aa, Escherichia coli CFT073
MQKYISEARLLLALAIPVILAQIAQTAMGFVDTVMAGGYSATDMAAVAIGTSIWLPAILFGHGLLLALTPVIAQLNGSGRRERIAHQVRQGFWLAGFVSVLIMLVLWNAGYIIRSMQNIDPALADKAVGYLRALLWGAPGYLFFQVARNQCEGLAKTKPGMVMGFIGLLVNIPVNYIFIYGHFGMPELGGVGCGVATAAVYWVMFLAMVSYIKRARSMRDIRNEKGTAKPDPAVMKRLIQLGLPIALALFFEVTLFAVVALLVSPLGIVDVAGHQIALNFSSLMFVLPMSLAAAVTIRVGYRLGQGSTLDAQTAARTGLMVGVCMATLTAIFTVSLREQIALLYNDNPEVVTLAAHLMLLAAVYQISDSIQVIGSGILRGYKDTRSIFYITFTAYWVLGLPSGYILALTDLVVEPMGPAGFWIGFIIGLTSAAIMMMLRMRFLQRLPSAIILQRAAR

SEQ ID NO: 17793 - protein, 401 aa, Escherichia coli CFT073
MRRWVLSCLKRLINRSIMMDFSLTEEQELLLASIRELITTNFPEEYFRTCDQNGTYPREFMRALADNGISMLGVPEEFGGIPADYVTQMLALMEVSKCGAPAFLITNGQCIHSMRRFGSAEQLRKTAESTLETGDPAYALALTEPGAGSDNNSATTTYTRKNGKVYINGQKTFITGAKEYPYMLVLARDPQPKDPKKAFTLWWVDSSKPGIKINPLHKIGWHMLSTCEVYLDNVEVEESDMVGEEGMGFLNVMYNFEMERLINAARSTGFAECAFEDAARYANQRIAFGKPIGHNQMIQEKLALMAIKIDNMRNMVLKVAWQADQHQSLRTSAALAKLYCARTAMEVIDDAIQIMGGLGYTDEARVSRFWRDVRCERIGGGTDEIMIYVAGRQILKDYQNK

SEQ ID NO: 17794 - protein, 183 aa, Escherichia coli CFT073
MQDSILTTVVKDIDGEVTTLEKYAGNVLLIVNVASKCGLTPQYEQLENIQKAWADRGFVVLGFPCNQFLEQEPGSDEEIKTYCTTTWGVTFPMFSKIEVNGEGRHPLYQKLIAAAPTAVAPEESGFYARMVSKGRAPLYPDDILWNFEKFLVGRDGKVIQRFSPDMTPEDPIVMESIKLALAK

SEQ ID NO: 17795 - protein, 406 aa, Escherichia coli CFT073
MSQPITRENFDEWMIPVYAPAPFIPVRGEGSRLWDQQGKEYIDFAGGIAVNALGHAHPELREALNEQASKFWHTGNGYTNEPVLRLAKKLIDATFADRVFFCNSGAEANEAALKLARKFAHDRYGSHKSGIVAFKNAFHGRTLFTVSAGGQPAYSQDFAPLPPDIRHAAYNDINSASALIDDATCAVIVEPIQGEGGVVPASNAFLQGLRELCDRHNALLIFDEVQTGVGRTGELYACMHYGVTPDLLTTAKALGGGFPVGALLATEECASVMTVGTHGTTYGGNPLASAVAGKVLDLINTPEMLNGVKQRHDWFVERLNSINHHYSLFSEVRGLGLLIGCVLNADYAGQAKQISQEAVKAGVMVLIAGGNVVRFAPALNVSEEEVTTGLDRFAAACEHFVSRGSS

SEQ ID NO: 17796 - protein, 326 aa, Escherichia coli CFT073
MKKIPLGTTDITLSRMGLGTWAIGGGPAWNGDLDRQICIDTILEAHRCGINLIDTAPGYNFGNSEVIVGQALKKLPREQVVVETKCGIVWERKGSLFNKVGDRQLYKNLSPESIREEVEASLQRLGIDYIDIYMTHWQSVPPFFTPIAETVAVLNALKAEGKIRAIGAANVDADHIREYLQHGELDIIQAKYSILDRAMENELLPLCRDNGIVVQVYSPLEQGLLTGTITRDYVPGGARANKVWFQRENMLKVIDMLEQWQPLCARYQCTIPTLALAWILKQSDLISILSGATAPEQVRENVAALNINLSDADATLMREMAEALER

SEQ ID NO: 17797 - protein, 459 aa, Escherichia coli CFT073
MEQITKPHCGARLDRLPDCRWHSSMFAIVAFGLLVCWSNAVGGLILAQLKALGWTDNSTTATFSAITTAGMFLGALVGGIIGDKTGRRNAFILYEAIHIASMVVGAFSPNMDFLIACRFVMGVGLGALLVTLFAGFTEYMPGRNRGTWSSRVSFIGNWSYPLCSLIAMGLTPLISAEWNWRVQLLIPAILSLIATALAWRYFPESPRWLESRGRYQEAEKVMRSIEEGVIRQTGKPLPPVVIADDGKAPQAVPYSALLTGVLLKRVILGSCVLIAMNVVQYTLINWLPTIFMTQGINLKDSIVLNTMSMFGAPFGIFIAMLVMDKIPRKTMGMGLLILIAVLGYIYSLQTSMLLITLIGFFLITFVYMYVCYASAVYVPEIWPTEAKLRGSGLANAVGRISGIAAPYAVAVLLSSYGVTGVFILLGAVSIIVAIAIATIGIETKGVSVESLSIDAVANK

SEQ ID NO: 17798 - protein, 285 aa, Escherichia coli CFT073
MSVKRVLRNTIRKEKEENRVTEPLTETPELSAKYAWFFDLDGTLAEIKPHPDQVVVPDTILQGLQLLATASDGALALISGRSMVELDALAKPYRFPLAGVHGAERRDINGKTHIVHLPDAIARDISVQLHTVIAQYPGAELEAKGMAFALHYRQAPQHEDALMTLAQRITQIWPQMALQQGKCVVEIKPKGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 17799 - protein, 250 aa, Escherichia coli CFT073
MSAIEVKNLVKKFHGQTVLHGIDLEVKPGEVVAIIGPSGSGKTTLLRSINLLEQPEAGTITVGDITIDTARSLSQQKSLIRQLRQHVGFVFQNFNLFPHRTVLENIIEGPVIVKGEPKEEATARARELLAKVGLAGKETSYPRRLSGGQQQRVAIARALAMRPEVILFDEPTSALDPELVGEVLNTIRQLAQEKRTMVIVTHEMSFARDVADRAIFMDQGRIVEQGVAKALFADPQQPRTRQFLEKFLLQ

SEQ ID NO: 17800 - protein, 328 aa, Escherichia coli CFT073
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEVLATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 17801 - protein, 342 aa, Escherichia coli CFT073
MPDIISCVAQAGYLGASIPQKYGGRGYDSYQLCALHEVMAGVHGSLENLITVTGMVSTLLQRVGSAAQKAHYLPKLATGELIGAIALTEPNIGSDLVNVETELQQDGDGWRLNGKKKWITLGQIADFFIVLIHCGNQLATVLIDRNTDGFTITPLNDMLGLRGNMLAELHFNDCRLKEDALLGPLTPGVPLAVNFALNEGRFTTACGSLGLCQAAVDVATRYIRQRKQFKRRLFSHGIVQHLFATMLTQTRSAQLMCFSAAEYRETLHPAMINQILMAKYVASKAAVDVAGKAVQLLGANGCHADYAVERYYRDAKIMEIIEGTSQIHEIQIAMNYMMGSEA

SEQ ID NO: 17802 - protein, 1352 aa, Escherichia coli CFT073
MRRNCWYNPRCLSNVGPGNTLSTFIQGHNQYSDQPTLLTLRKANAAIDDEHMLHRTLAALWVRGENIDWRRFNQTALGKHIPLPDYPFEQTYYYRYGAALSGYRQYPNPLRRPQDEWLQRVLWRMHDTSLREAFYAPGELIIIISADGDKLQQTLMSSGVDSITMPLPISSEDDVWDNDRILTHFHDICALLAHKTYRQLHCLYAPGAEAGSSLTQSLSGLYRVARWCMHSTTPLASLTVLTHGAFRVQEEDNPEPTLAALSGAVNVFAQELHPTEVRLIDIDAQSSDENLNLLTQRLAPKQETVMALRQGMLYLRRFIPTRLLAHLPPQTGCIPGNVLWIIGGEKGIGRMIGEALAQREGVRVVLSSRTGYHHEAVQQDALDVIHCDVTQAEAVRACLATLLERYGRLDGVIFAADATTTLTLHQLSESALRDTLTVKERGTANVLHALAQRNLLDERLLLLFCNSLAAVNAEIGQTGYATASAYLDALAQQLRTRYKVNALSIGLDALREQGMLLDAINGSEYDVLRGLRPLMTGTLLQAYKQQGADTSYYARLSPESDWLLDEHRISGIATLPGTGYLALAYEALRHYFVQDQICIDELVFLAPLTVMDNCSVDVFVDISPNGQGVSVEVKSMTERFSGTLTTHARGRATRLMVDDNVVCDLTGLMREMHTITPPTKELSSTHFHYGPRWHSVQQLYGNTAQTQVFATLALPTVAANDTIALHPALLDIASSVVEQLPGFHTDSVPFLYQDLRLYRPLPNTLHVALTVNRHDEEGDSYAFTLYDMAGEMVARCAAMVKRKVQLHIQDVDDDTRLRVPSADNYQLRLAAEGEGAGKLALCPTPRLALGDSQVEIEVLATGLNFKDVLFTTGLLRQQPGEAPLQLGLECAGRITRVGKNVTEFAPGEDVMAVLNGGFVQYARVESDCVVRKPAHCRIEQAAALPIAYLTAYYALVVRANLQPGERVLIHSAAGGVGLAALHIAKRCGAQIFATAGSEQKRDYLLSLGVHAVADSHDEQFAATLLTASDGQGMDVILNSLTGRLLDASLALLAPLGRFLELGSKDIVEDKALPMRFFAQGGTFIPINFHAAHGAFSRYLQQIVAWIDDNTLPLLPCKSVPLPEVARAFATLTTPQHIGKVVVTHRTAAGMDRLNAMIAERRLGGYALSMSNAEVMRQLWPILNTRSPWAQLLLSPRAIDRLARGNRVDRGVPSAANDTITQQTVKKRPRPEIGVPYSPATREVERVLCQILEEYLGLDRVGIDDNYAELGATSLDMVQLSGQMARHYPQVSVVSLYNHATVRQLATFCQPPEGESNAPSPQPAVQTNTRANQIAKRALQIAKNTARSHTSLH

SEQ ID NO: 17803 - protein, 203 aa, Escherichia coli CFT073
MLTEQQRRELDWEKTDGLMPVIVQHAVSGEVLMLGYMNPEALDRTIESGKVTFFSRTKQRLWTKGETSGNFLNVVSIAPDCDNDTLLVLANPIGPTCHKGTSSCFGDTAHQWLFLYQLEQLLAERKSADPETSYTAKLYASGSKRIAQKVGEEGVETALAATVHDRFELTNEASDLMYHLLVLLQDQDLDLTTVIENLRKRHQ

SEQ ID NO: 17804 - protein, 483 aa, Escherichia coli CFT073
MRNYMNNNKIITPIIMAGGSGSRLWPLSRILYPKQFLSLIGSHTMLQTTANRLDGLDCTNPYVICNEQYRFIVAEQLRKIDRLTSKNIILEPVGRNTAPAIALAALLMSKSDKSADDLMLVLAADHVIHDEEKFCNAVRSAIPYAADGKLVTFGIIPDKAETGYGYIHRGQYINQEDSDAFIVSSFVEKPNHETATKYLASGEYYWNSGMFLFSANRYIEELKQFRPDILSACEKAIASANFDLDFVRLDESSFSKCPEESIDYAVMEKTKDAIVIPMDAGWSDVGSWSSLWEINDKDSDGNVIVGDIFSHETKNSFIYAESGIVATVGVENLVVVQTKDAVLVSERNKVQDVKKIVEQIKNSGRSEHYVHREVYRPWGKYDSIDTGERYQVKRITVNPGEGLSLQMHHHRAEHWIIVSGTARVTIGSETKILSENESVYIPLGVIHCLENPGKIPLDLIEVRSGSYLEEDDVIRFQDRYGRS

SEQ ID NO: 17805 - protein, 478 aa, Escherichia coli CFT073
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPENDPLMLVLAADHVIADEDAFRAAVRNAMPYAEAGKLVTFGIVPDLPETGYGYIRRGEVSAGEQDTVAFEVAQFVEKPNLETAQAYVASGEYYWNSGMFLFRAGRYLEELKKYRPDILDACEKAMSAVDPDLDFIRVDEEAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 17806 - protein, 412 aa, Escherichia coli CFT073
MPQQNYLDELTPAFTPLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIHEKEAQPGGWLRNGIPQFRLPQSVLDAEIARIEKMGVTIKCNNEIGKTLTLEQLKAENRAVLVTVGLSSGSGLSLFEHSDVEIAVDFLQRARQAQGDISIPQSALIIGGGDVAMDVASTLKVLGCQAVTCVAREELDEFPASEKEFTSARELGVSIIDGFTPVAVEGNKVTFKHVRLPGELTIAADKIILAVGQHAELAVFSALEPQRNTIETQHYQTRDPQVFAAGDIVEGDKTVVYAVKTGKEAAGAIHHYLEGACSC

SEQ ID NO: 17807 - protein, 220 aa, Escherichia coli CFT073
MKTKLMTLQDATGFFRDGMTIMVGGFMGIGTPSRLVEALLESGVRDLTLIANDTAFVDTGIGPLIVNGRVRKVIASHIGTNPETGRRMISGEMDVVLVPQGTLIEQIRCGGAGLGGFLTPTGVGTVVEEGKQTLTLDGKTWLLERPLRADLALIRAHRCDTLGNLTYHLSARNFNPLIALAADITLVEPDELVETGELQPDHIVTPGAVIDHIIVSQESK

SEQ ID NO: 17808 - protein, 452 aa, Escherichia coli CFT073
MLSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFLYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHEQLLQKRNGG

SEQ ID NO: 17809 - protein, 332 aa, Escherichia coli CFT073
MVCWGQKWHYASPKIKLASNQVQTERSLMSWIERIKSNITPTRKASIPEGVWTKCDSCGQVLYRAELERNLEVCPKCDHHMRMTARNRLHSLLDEGSLVELGSELEPKDVLKFRDSKKYKDRLASAQKETDEKDALVVMKGTLYGMPVVAAAFEFAFMGGSMGSVVGARFVRAVEQALEDNCPLICFSASGGARMQEALMSLMQMAKTSAALAKMQERGLPYISVLTDPTMGGVSASFAMLGDLNIAEPKALIGFAGPRVIEQTVREKLPPGFQRSEFLIEKGAIDMIVRRPEMRLKLASILAKLMNLPAPNPEAPREGVVVPPVPDQEPEA

SEQ ID NO: 17810 - protein, 412 aa, Escherichia coli CFT073
MADTRPERRFTRIDRLPPYVFNITAELKMAARRRGENIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDMAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 17811 - protein, 327 aa, Escherichia coli CFT073
  misc_feature (296)..(296): Xaa can be any naturally occurring amino acid
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQALAGEEIKPGPHKIQGIGAGFIPANLDLKLVDKVIGITNEEAISTARRLMEEEGILAGISSGAAVAAALKLQEDESFTNKNIXVILPSSGERYLSTALFADLFTEKELQQNASL

SEQ ID NO: 17812 - protein, 303 aa, Escherichia coli CFT073
MSTLEQTIGNTPLVKLQRMAPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPAEYLPGIFNASLVDEVLDIHQRDAENTMRELAVREGIFCGVSSGGAVAGALRVAKANPGAVVVAIICDRGDRYLSTGVFGEEHFSQGAGI

SEQ ID NO: 17813 - protein, 365 aa, Escherichia coli CFT073
MSIEIANIKKSFGRTQVLNDISLDIPSGQMVALLGPSGSGKTTLLRIIAGLEHQTSGHIRFHGTDVSRLHARDRKVGFVFQHYALFRHMTVFDNIAFGLTVLPRRERPNAAAIKAKVTKLLEMVQLAHLADRYPAQLSGGQKQRVALARALAVEPQILLLDEPFGALDAQVRKELRRWLRQLHEELKFTSVFVTHDQEEATEVADRVVVMSQGNIEQADAPDQVWREPATRFVLEFMGEVNRLQGTIRGGQFHVGAHRWPLGYTPAYQGPVDLFLRPWEVDISRRTSLDSPLPVQVLEASPKGHYTQLVVQPLGWYNEPLTVVMHGDDAPQRGDRLYVGLQHARLYNGDERIETRDEELALAQSA

SEQ ID NO: 17814 - protein, 511 aa, Escherichia coli CFT073
MQSVTLCIMPRQYLLTTLVEILPMLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLSQPVSVYMTPKERLVTVREGEAREVVLAKMHEKRVEKALVVDDEFHLIGMITVKDFQKAERKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 17815 - protein, 386 aa, Escherichia coli CFT073
MTSENPLLALREKISALDEKLLALLAERRELAVEVGKAKLLSHRPVRDIDRERDLLERLITLGKAHHLDAHYITRLFQLIIEDSVLTQQALLQQHLNKINPHSARIAFLGPKGSYSHLAARQYAARHFEQFIESGCAKFADIFNQVETGQADYAVVPIENTSSGAINDVYDLLQHTSLSIVGEMTLTIDHCLLVSGTTDLSAINTVYSHPQPFQQCSKFLNRYPHWKIEYTESTSAAMEKVAQAKSPHVAALGSEAGGTLYGLQVLERIEANQRQNFTRFVVLARKAINVSDQVPAKTTLLMATGQQAGALVEALLVLRNHSLIMTRLESRPIHGNPWEEMFYLDIQANLESAEMQKALKELGEITRSMKVLGCYPSENVVPVDPT

SEQ ID NO: 17816 - protein, 482 aa, Escherichia coli CFT073
MKLNDSNLFRQQALINGEWLDANNGEVIDVTNPANGDKLGSVPKMGADETRAAIDAANRALPVWRALTAKERANILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQNGVYDRFAEKLQQAVSKLHIGNGLEKGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIIGINTGIISNEVAPFGGIKASGLGREGSKYGIEDYLEIKYMCIGL

SEQ ID NO: 17817 - protein, 428 aa, Escherichia coli CFT073
MRMSSNKELMQRRSQAIPRGVGQIHPIFADRAENCRVWDVEGREYLDFAGGIAVLNTGHLHPKVVAAVEAQLKKLSHTCFQVLAYEPYLELCEIMNQKVPGDFAKKTLLVTTGSEAVENAVKIARAATKRSGTIAFSGAYHGRTHYTLALTGKVNPYSAGMGLMPGHVYRALYPCPLHGISEDDAIASIHRIFKNDAAPEDIAAIVIEPVQGEGGFYAATPAFMQRLRALCDEHGIMLIADEVQSGAGRTGTLFAMEQMGVAPDLTTFAKSIAGGFPLAGVTGRAEVMDAVAPGGLGGTYAGNPIACVAALEVLKVFEQENLLQKANVLGQKLKDGLLAIAEKHPEIGDVRGLGAMIAIELFEDGEHSKPDVKLTAEIVARARDKGLILLSCGPYYNVLRILVPLTIEDAQIRQGLEIISQCFAEAKQ

SEQ ID NO: 17818 - protein, 487 aa, Escherichia coli CFT073
MTRRGKCRGALPSDTLSRGFRMGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRIRKILRAEGSEIRLRMWLYPWLTWLVIGFITFVLVVMLFRPAQQLEVISTGLLAIGIICTVPIMARWKKLIMWQKTPIHNTR

SEQ ID NO: 17819 - protein, 469 aa, Escherichia coli CFT073
MTGRCLFGFSGEKPFLLPDNEGVKMNTSPVRMDDLPLNRFHCRIAALTFGAHLTDGYVLGVIGYAIIQLTPAMQLTPFMAGMIGGSALLGLFLGSLVLGWISDHIGRQKIFTFSFMLITLASFLQFFATTPEHLIGLRILIGIGLGGDYSVGHTLLAEFSPRRHRGILLGAFSVVWTVGYVLASIAGHHFISESPEAWRWLLASAALPALLITLLRWGTPESPRWLLRQGRFAEAHAIVHRYFGPHVLLGDEVATATHKHIKTLFSSRYWRRTAFNSVFFVCLVIPWFVIYTWLPTIAQTIGLEDALTASLMLNALLIVGALLGLVLTHLLAHRRFLLGSFLLLTATLVVMACLPSGSSLTLLLFVLFSTTISAVSNLVGILPAESFPTDIRSLGVGFATAMSRLGAAVSTGLLPWVLAQWGMQATLLLLAAVLLVGFVVTWLWAPETKALPLVAAGNVGGANEHSVSV

SEQ ID NO: 17820 - protein, 1032 aa, Escherichia coli CFT073
MGDIMRPIPFEELLTRIFDEYQQQRSIFGIPEQQFYSPVKGKTVSVFGETCATPVGPAAGPHTQLAQNIVTSWLTGGRFIELKTVQILDRLELEKPCIDAEDECFNTEWSTEFTLLKAWDEYLKAWFALHLLEAMFQPSDSGKSFIFNMSVGYNLEGIKQPPMQQFIDNMMDASDHPKFAQYRDALNKLLQNEAFLARHGLQEKRESLQALPARIPTSMVQGVTLSTMHGCPPHEIEAICRYMLEEKGLNTFVKLNPTLLGYARVREILDVCGFGYIGLKEESFDHDLKLTQALEMLERLMALAKEKSLGFGVKLTNTLGTINNKGALPGEEMYMSGRALFPLSINVAAVLSRAFDGKLPISYSGGASQLTIRDIFDTGIRPITMATDLLKPGGYLRLSACMRELEGSDAWGLDHVDVERLNRLAADALTMEYTQKHWKPEERIEVAEDLPLTDCYVAPCVTACAIKQDIPEYIRLLGEHRYADALELIYQRNALPAITGHICDHQCQYNCTRLDYDSALNIRELKKVALEKGWEEYKQRWHKPAGSGSRHPVAVIGAGPAGLAAGYFLARAGHPVTLFEREANAGGVVKNIIPQFRIPAELIQHDIDFVADHGVKFEYGCSPDLTVEQLKNQGFHYVLIATGTDKNSGVKLAGDNQNVWKSLPFLREYNKGTTLKLGKHVVVVGAGNTAMDCARAALRVPGVEKATVVYRRSLQEMPAWREEYEEALHDGVEFRFLNNPERFDADGTLTLRVMSLGEPDEKGRRRPVETNETVTLHVDSLITAIGEQQDTEALNAMGVPLDKNGWPDVDHNGETRLSDVFMIGDVQRGPSSIVAAVGTARRATDAILSRENIRSHQNDKYWNNVNPAEIYQRKGDISVTLVNSDDRDAFVAQEAARCLECNYVCSKCVDVCPNRANVSITVPGFQNRFQTLHLDAYCNECGNCAQFCPWNGKPYKDKITVFSLSQDFDNSSNPGFLVEDCRVRVRLNNQSWVLNIDSEGQFNNVPPELNDMCRIISHVHQHHHYLLGRVEV

SEQ ID NO: 17821 - protein, 455 aa, Escherichia coli CFT073
MSGDILQTPDAPKPQGALDNYFKITARGSTVRQEVLAGLTTFLAMVYSVIVVPGMLGKAGFPPAAVFVATCLVAGFGSLLMGLWANLPMAIGCAISLTAFTAFSLVLGQQISVPVALGAVFLMGVIFTAISVTGVRTWILRNLPMGIAHGTGIGIGLFLLLIAANGVGMVIKNPIEGLPVALGAFTSFPVMMSLLGLAVIFGLEKCRVPGGILLVIIAISIIGLIFDPAVKYHGLVAMPSLTGEDGKSLIFSLDIMGALQPTVLPSVLALVMTAVFDATGTIRAVAGQANLLDKDNQIINGGKALTSDSVSSIFSGLVGAAPAAVYIESAAGTAAGGKTGLTATVVGVLFLMILFLSPLSFLIPGYATAPALMYVGLLMLSNVSKLDFNDFIDAMAGLVCAVFIVLTCNIVTGIMLGFVTLVVGRVFAREWQKLNIGTVIITAALVAFYAGGWAI

SEQ ID NO: 17822 - protein, 485 aa, Escherichia coli CFT073
MTHLEPMIVKKLTLPKDFLWGGAVAAHQVEGGWNKGGKGPSICDVLTGGAHGVPREITKEVVPGKYYPNHEAVDFYGHYKEDIKLFAEMGFKCFRTSIAWTRIFPKGDEAQPNEEGLKFYDDMIDELLKYNIEPVITLSHFEMPLHLVQQYGSWTNRKVVDFFVRFAEVVFERYKHKVKYWMTFNEINNQRNWRAPLFGYCCSGVVYTEHENPEETMYQVLHHQFVASALAVKAAHRINPEMKVGCMLAMVPLYPYSCNPDDVMFAQESMRERYVFTDVQLRGYYPSYVLNEWERRGFNIKMEDGDLDVLREGTCDYLGFSYYMTNAVKAEGGTGDAISGFEGSVPNPYVKASDWGWQIDPVGLRYALCELYERYQKPLFIVENGFGAYDKVEDDGSINDDYRIDYLRAHIEEMKKAVTYDGVDLMGYTPWGCIDCVSFTTGQYSKRYGFIYVNKHDDGTGDMSRSRKKSFNWYKEVIASNGENL

SEQ ID NO: 17823 - protein, 408 aa, Escherichia coli CFT073
MLSGKTQAASAKLLESTRGFTMSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDETLSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 17824 - protein, 306 aa, Escherichia coli CFT073
MSTLGHQYDNSLVSNAFGFLRLPMNFQPYDSDADWVITGVPFDMATSGRAGGRHGPAAIRQVSTNLAWEHNRFPWNFDMRERLNVVDCGDLVYAFGDAREMSEKLQAHAEKLLAAGKRMLSFGGDHFVTLPLLRAHAKHFGKMALVHFDAHTDTYANGCEFDHGTMFYTAPKEGLIDPNHSVQIGIRTEFDKDNGFTVLDACQVNDRSVDDIIAQVKQIVGDMPVYLTFDIDCLDPAFAPGTGTPVIGGLTSDRAIKLVRGLKDLNIVGMDVVEVAPAYDQSEITALAAATLALEMLYIQAAKKGE

SEQ ID NO: 17825 - protein, 468 aa, Escherichia coli CFT073
MEGIMPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 17826 - protein, 2723 aa, Streptomyces hygroscopicus
MLRRELIRPLPELLKAHAARRGSQTAFADSRRGVSYAQLEARTRRLAGHLAQLRLLPGDRAAIYLGNCVETIESYLAIARASAIGVPINPHSSTAELAYLLDDSAARVIVTDHTRLPQVRRLQAERPHLTVVVTGDEESGAVPFDALAETEPQQPARDDLGLDDIAWMLYTSGTTGRPKGVLSTQRSCLWSVAASSAGVLGLSETDRVLWPVPLFHSLAHIYCVLSVTAVGATARITEAFDAEELLHTLRAEEFTFLAGVPTMYHYLLDAARDGDLSLPNLRVCLSAGAISTATLRAEFQETFGVPLLDCYGSTETCGLITANWPNGTQAEGSCGLPVPGLTVRIVDPETHESVETGEEGEIWVGGPSLMVGYHNQPEATEAALPRGWYRTGDLGRRDDLGYHTITGRLSELIIRSGENIHPTEVEQVLLRVPGVTDAAVVGSAHPTLGEVPVAFLVPAADGFDPDEVFAACREHLAYFKVPEELYEIGSIPRTGSGKIKRHALAQSPARLRAVSSGSFESLFRLEWTAPVPEAGPVDGDQATSAHRAGGSVTAGLEAPGSAVVDCPRGSLDEVLRAVRTGLTDRSGRVAVLTHGADHDPAQAAVWGLVESMRADAPHDAPVLVDADGGEATAALSAVLASGQPRALVRGGEVLVPRLARAGSGQRVSRPDPDGTVLVFGADQEQAAELAGHLVAAYGIRHVRLLARTAVPDLVARLTELGASVTQTVRAPGDRASLAEAFQTAGPPVTAVLQVAGPETLPTTLTGEVELGPLQDALALDELTREAHPALFVLSAPIDNGPAHAVFQAVANRRHAAGLPALALSWGPREELTSRERLALFDAATTVDDASVLAIRHELAASAVDTGAAGRLARLPAAERGRALLDLVLSEVGVITGGRPVHDRQSFRDIGMTSTSAVELRGRLAAATGLALPATLAFDYPNPDALAAYLGGRLFGDTSAAGPDTEPTDPAAPSGEPIAIVGMACRLPGGVTSPEELWELLSSGGDGISGFPTDRGWDLEHLYHPDPDHPGTSYVREGGFLHDAGDFDAALFGISPREALAMDPQQRLLLETTWEVLERAGIDPTSLRGSRTGVFAGVMYHDYISRLRTVPPELEGYLSSGGSGSVVSGRVSYTFGFEGPAVSVDTACSSSLVALHLAVQALRTGECTLAVAGGVTVMASPSSYIEFSRQRGLSPDGRCKSFAADADGAAWSEGAATLLVERLSDAQRLGHPVLGVVRGTAVNQDGASNGLTAPNGPSQQRVIRDALTNAQLTATDIDLIEAHGTGTKLGDPIEAQAVLAMYGQDRDLPVWLGSLKSNIGHTQAAAGVAGVMKAVLSMRHGVMPKSLHIDEPTPEVDWSAGTVELLAEARDWPGADERPRRAGVSSFGVSGTNAHVILEQAPPAPEPTESAEPVEPSEAAGPSGPVGLELGPSGPVPWVLSAQNETALKDLARQLVTETEGTVHQIAHSLITQRSTTLPHRAVLVGSTREEFATALEQITRHTPDGGKTVLVFPGQGSQWVGMGQRLWETSPLYRDTIHEIDTALSEYIDWSVTDILTSQPGAPTWDRVDVIQPVLFTTMTALATLWQHHGLTPDAIIGHSQGEIAAAYTAGALTLQDAARITTLRSKALLPLTGHGTMISVLAPPEKIQEIADPDHWNTRIWIAAHNAPNTTTITGDTQAITHLTQQLSHHRIMRWQLPGVDFAGHSGHIDQLHNQLQKILAPITPQKPTIPFYSTTDNTWITDTTLDADYWYRNLRQPVLFQPAINHLTNNGYTTYIETSPHPTLTPSIQETNPNTTTIHTLHNNQNDTHALLTALGHAHTHGHPITWHTLIPPTKTTPLPTYPFQHTRYWLNDKPTVDTQDATQLGLIPTPHPLVPATTTLAETGATILTGHINPAHHPWTTDHAVNGTPLLPGTALVDMALHAGDHTDHTTLDELIIHTPITLTHPTTIQLTISPPDNTNTHTLTVHTRNSPDGPWTAHATGTLTQHQHTPDPPQTTWPPTDAEPIPLDGTYQRLATTGLEYGPTFQGLDALWRRDSRLFADVRLPNTDHTDSADGYGIHPALLDAALHALVAVSDGDEIRLPFAWTGVTLHATGATKLRVELEWDASGSASLRAFDPSGQPVVTVESLASRVISPEQLRSASARSGPLYRPEWIAWSGAGTPGGAVEFERYEVPTVGDDVLADTHRRSTETLTRIQQHLAADTTTPLVVEATHDDLAGAAVWGLIRTAQTEHPGRIILIDTDNHPTSRKALPTLIASGEPQARIRDGAITLPRLTVVAPTEPAGVGEGTVLITGGTGSLGSLIARHLVTEHGVRDLVLVSRQGPDAPGATELIAELQQLGAQVRVRSCDTTDRAALAALVDEVGPFAGVVHTAGALADATVDNLDADALATTIAAKAHAAWWLHEHTQDHGLTLFMVFSSLASVLGSAGQANYAAANSFLDALATHRRTLGLPGTSLAWGSWERTSGMSAHLTRADHDRLARAGLRPLTDEQGLEFFDGALAVDLGQVVTATFDLPAIGRSGAVPVLLRGLVRAPRRAAVGADSGGAEPWTERIATLAPDARERSVLTSVIEQVAQALGHPDPGAIEPDQAFKSLGFDSLTAVEFRNRLSAMTGLQLPATLVFDYPAAGAVTRYLLDQVSPAPAAAGPDDDPDERELRRVLERVPVARFREAGVLEALLKLAGPDPARTPDAAEPDEDGLIDAMDTEALIRHVMDGTGA

SEQ ID NO: 17827 - protein, 440 aa, Escherichia coli CFT073
MRLRSKKVTSTPFAKIFCFMPILQDAPANIHASLDIQTYKNRNPDMVDKKLDTQLVNAGRSKKYTLGAVNSVIQRASSLVFDSVEAKKHATRNRANGELFYGRRGTLTHFSLQQAMCELEGGAGCVLFPCGAAAVANSILAFVEQGDHVLMTNTAYEPSQDFCSKILSKLGVTTSWFDPLIGADIVKHLQPNTKIVFLESPGSITMEVHDVPAIVAAVRSVVPDAIIMIDNTWAAGVLFKALDFGIDVSIQAATKYLVGHSDAMIGTAVCNARCWEQLRENAYLMGQMVDADTAYITSRGLRTLGVRLRQHHESSLKVAEWLAEHPQVARVNHPALPGSKGHEFWKRDFTGSSGLFSFVLKKKLNDEELANYLDNFSLFSMAYSWGGYESLILANQPEHIAAIRPQGKIDFSGTLIRLHIGLEDVDDLIADLDAGFARIV

SEQ ID NO: 17828 - protein, 496 aa, Escherichia coli CFT073
MITTFVFIPIFAIAAGVAQSLQYLNRYHVIREPPEHILNRLPSSASALACSAHALNLIEKRTLDHEEMKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMLTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 17829 - protein, 299 aa, Escherichia coli CFT073
MIDMTMKVGFIGLGIMGKPMSKNLLKAGYSLVVADRNPEAIADVIAAGAETASTAKAIAEQCDVIITMLPNSPHVKEVALGENGIIEGAKPGTVLIDMSSIAPLASREISEALKAKGIDMLDAPVSGGEPKAIDGTLSVMVGGDKAIFDKYYDLMKAMAGSVVHTGEIGAGNVTKLANQVIVALNIAAMSEALTLATKAGVNPDLVYQAIRGGLAGSTVLDAKAPMVMDRNFKPGFRIDLHIKDLANALDTSHGVGAQLPLTAAVMEMMQALRADGLGTADHSALACYYEKLAKVEVTR

SEQ ID NO: 17830 - protein, 445 aa, Escherichia coli CFT073
MSNRKYFGTDGIRGRVGDAPITPDFVLKLGWAAGKVLARHGSRKIIIGKDTRISGYMLESALEAGLAAAGLSALFTGPMPTPAVAYLTRTFRAEAGIVISASHNPFYDNGIKFFSIDGTKLPDAVEEAIEAEMEKEISCVDSAELGKASRIVDAAGRYIEFCKATFPNELSLSELKIVVDCANGATYHIAPNVLRELGANVIAIGCEPNGVNINAEVGATDVRALQARVLAEKADLGIAFDGDGDRVIMVDHEGNKVDGDQIMYIIAREGLRQGQLRGGAVGTLMSNMGLELALKQLGIPFARAKVGDRYVLEKMQEKGWRIGAENSGHVILLDKTTTGDGIVAGLQVLAAMARNHMSLHDLCSGMKMFPQILVNVRYTAGSGDPLEHESVKAVTAEVEAALGSRGRVLLRKSGTEPLIRVMVEGEDEAQVTEFAHRIADAVKAV

SEQ ID NO: 17831 - protein, 269 aa, Escherichia coli CFT073
MEQSVANLVDMRDVSFTRGNRCIFDNISLTVPRGKITAIMGPSGIGKTTLLRLIGGQIAPDHGEILFDGENIPAMSRSRLYTVRKRMSMLFQSGALFTDMNVFDNVAYPLREHTQLPAPLLHSTVMMKLEAVGLRGAAKLMPSELSGGMARRAALARAIALEPDLIMFDEPFVGQDPITMGVLVKLISELNSALGVTCVVVSHDVPEVLSIADHAWILADKKIVAHGSAQALQANPDPRVRQFLDGIADGPVPFRYPAGDYHADLLPGS

SEQ ID NO: 17832 - protein, 472 aa, Escherichia coli CFT073
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDMSGVKQTGKKVAIIGAGPAGLACADVLTRNGVKAIVFDRHPEIGGLLTFGIPAFKLEKEVMTRRREIFTGMGIEFKLNTEVGRDVQLDDLLSDYDAVFLGVGTYQSMHGGLENEDADGVYAALPFLIANTKQLMGFGETRDEPFVSMEGKRVVVLGGGDTAMDCVRTSVRQGAKHVTCAYRRDEENMPGSRREVKNAREEGVEFKFNVQPLGIEVNGNGKVSGVKMVRTEMGEPDAKGRRRAEIVAGSEHIVPADAVIMAFGFRPHNMEWLAKHSVELDSQGRIIAPEDNDNAFQTSNPKIFAGGDIVRGSDLVVTAIAEGRKAADGIMNWLEV

SEQ ID NO: 17833 - protein, 320 aa, Escherichia coli CFT073
MSKVFTIGEILVEIMASKIGQPFDQPGIWNGPYPSGAPAIFIDQVTRLGVPCGIISCVGNDGFGDINIHRLAADGVDIRGISVLPLEATGSAFVTYHNSGDRDFIFNIKNAACGKLSAQHVDENILKDCTHFHIMGSSLFSFHMVDAVKKAVTIVKANGGVISFDPNIRKEMLDIPEMRDALHFVLELTDIYMPSEGEVLLLSPHSTPERAIAGFLEEGVKEVIVKRGNQGASYYSANEQFHVESYPVEEVDPTGAGDCFGGAWIACRQLGFDAHRALQYANACGALAVTRRGPMEGTSRLMEIETFIQRHDMSIREAAQ

SEQ ID NO: 17834 - protein, 252 aa, Escherichia coli CFT073
MSQILLQPANAMITLENVNKWYGQFHVLKNINLTVQPGERIVLCGPSGSGKSTTIRCINHLEEHQQGRIVVDGIELNEDIRNIERVRQEVGMVFQHFNLFPHLTVLQNCTLAPIWVRKMPKKEAEALAMHYLERVRIAEHAQKFPGQISGGQQQRVAIARSLCMKPKIMLFDEPTSALDPEMVKEVLDTMIGLAQSGMTMLCVTHEMGFARTVADRVIFMDRGEIVEQAAPNEFFAHPKSERTRAFLSQVIH

SEQ ID NO: 17835 - protein, 270 aa, Escherichia coli CFT073
MKSLFKVTLLATTMAVALHAPITFAAEAAKPATTADSKAAFKNDDQKSAYALGASLGRYMENSLKEQEKLGIKLDKDQLIAGVQDAFADKSKLSDQEIEQTLQAFEARVKSSAQAKMEKDAADNEAKGKEYREKFAKEKGVKTSSTGLVYQVVEAGKGEAPKDSDTVVVNYKGTLIDGKEFDNSYTRGEPLSFRLDGVIPGWTEGLKNIKKGGKIKLVIPPELAYGKAGVPGIPPNSTLVFDVELLDVKPAPKADAKPEADAKAADSAKK

SEQ ID NO: 17836 - protein, 406 aa, Escherichia coli CFT073
MAIEQTAITRATFDEVILPIYAPAEFIPVKGQGSRIWDQQGKEYVDFAGGIAVTALGHCHPALVNALKTQGETLWHISNVFTNEPALRLGRKLIEATFAERVVFMNSGTEANETAFKLARHYACVRHSPFKTKIIAFHNAFHGRSLFTVSVGGQPKYSDGFGPKPADIIHVPFNDLHAVKAVMDDHTCAVVVEPIQGEGGVTAATPEFLQGLRELCDQHQALLVFDEVQCGMGRTGDLFAYMHYGVTPDILTSAKALGGGFPVSAMLTTAEIASAFHPGSHGSTYGGNPLACAVAGAAFDIINTPEVLEGIQAKRQHFVDHLQKIDQQYDVFSDIRGMGLLIGAELKPQYKGRARDFLYAGAEEGVMVLNAGPDVMRFAPSLVVEDADIDEGMHRFAHAVAKVVGA

SEQ ID NO: 17837 - protein, 450 aa, Escherichia coli CFT073
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTIEVNGETITADHILIATGGRPSHPDIPGVEYGIDSDGFFALPALPERVAVVGAGYIAVELAGVINGLGAKTHLFVRKHAPLRSFDPMISETLVEVMNAEGPQLHTNAIPKAVVKNADGSLTLELEDGRSETVDCLIWAIGREPANDNINLEAAGVKTNEKGYIVVDKYQNTNVEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGPEEKIVGIHGIGFGMDEMLQGFAVALKMGATKKDFDNTVAIHPTAAEEFVTMR

SEQ ID NO: 17838 - protein, 470 aa, Escherichia coli CFT073
MIIITEPLLSFVLQKQGIKSPPMDKKMNNDNTDYVSNESGTLSRLFKLPQHGTTVRTELIAGMTTFLTMVYIVFVNPQILGAAQMDPKVVFVTTCLIAGIGSIAMGIFANLPVALAPAMGLNAFFAFVVVGAMGISWQTGMGAIFWGAVGLFLLTLFRIRYWMISNIPLSLRIGITSGIGLFIALMGLKNTGVIVANKDTLVMIGDLSSHGVLLGILGFFIITVLSSRHFHAAVLVSIVVTSCCGLFFGDVHFSGVYSIPPDISGVIGEVDLSGALSLELAGIIFSFMLINLFDSSGTLIGVTDKAGLIDSNGKFPNMNKALYVDSVSSVAGAFIGTSSVTAYIESTSGVAVGGRTGLTAVVVGVMFLLVMFFSPLVAMVPPYATAGALIFVGVLMTSSLARVNWDDFTESVPAFITTVMMPFTFSITEGIALGFMSYCIMKVCTGRWRDLNLCVVVVAALFALKIILVD

SEQ ID NO: 17839 - protein, 463 aa, Escherichia coli CFT073
MLAFLNQVRKPTLDLPLEVRRKMWFKPFMQSYLVVFIGYLTMYLIRKNFNIAQNDMISTYGLSMTQLGMIGLGFSITYGVGKTLVSYYADGKNTKQFLPFMLILSAICMLGFSASMGSGSVSLFLMIAFYALSGFFQSTGGSCSYSTITKWTPRRKRGTFLGFWNISHNLGGAGAAGVALFGANYLFDGHVIGMFIFPSIIALIVGFIGLRYGSDSPESYGLGKAEELFGEEISEEDKETESTDMTKWQIFVEYVLKNKVIWLLCFANIFLYVVRIGIDQWSTVYAFQELKLSKALAIQGFTLFEAGALVGTLLWGWLSDLANGRRGLVACIALALIIATLGVYQHASNEYIYLASLFALGFLVFGPQLLIGVAAVGFVPKKAIGAADGIKGTFAYLIGDSFAKLGLGMIADGTPVFGLTGWAGTFAALDIAAIGCICLMAIVAVMEERKIRREKKIQQLTVA

SEQ ID NO: 17840 - protein, 440 aa, Escherichia coli CFT073
MMLPFLKAPADAPLMTDKHEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMAASALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVIAIAAGISALLLLPFLNAQTPREA

SEQ ID NO: 17841 - protein, 445 aa, Escherichia coli CFT073
MSQQHTTQASGQGMLERVFKLREHGTTARTEVIAGFTTFLTMVYIVFVNPQILGVAGMDTSAVFVTTCLIAAFGSIMMGLFANLPVALAPAMGLNAFFAFVVVQAMGLPWQVGMGAIFWGAIGLLLLTIFRVRYWMIANIPVSLRVGITSGIGLFIGMMGLKNAGVIVANPETLVSIGNLTSHSVLLGILGFFIIAILASRNIHAAVLVSIVVTTLLGWMLGDVHYNGIVSAPPSVMSVVGHVDLAGSFNLGLAGVIFSFMLVNLFDSSGTLIGVTDKAGLADEKGKFPRMKQALYVDSISSVTGSFIGTSSVTAYIESSSGVSVGGRTGLTAVVVGLLFLLVIFLSPLAGMVPGYAAAGALIYVGVLMTSSLARVNWQDLTESVPAFITAVMMPFSFSITEGIALGFISYCVMKIGTGRLRDLSPCVIIVALLFILKIVFIDAH

SEQ ID NO: 17842 - protein, 464 aa, Escherichia coli CFT073
MKAFPETFLWGGATAANQVEGAWQEDGKGITTSDLQPHGVMGKMEPRILGKENIKDVAIDFYHRYPEDIALFAEMGFTCLRISIAWARIFPQGDEAEPNEAGLAFYERLFDEMAQAGIKPLVTLSHYEMPYGLVKNYGGWANRAVIDHFEHYARTVFTRYQHKVALWLTFNEINMSLHAPFTGVGLAEESGEAEVYQAIHHQLVASARAVKACHSLIPEAKIGNMLLGGLVYPLTCQPQDMLQAMEENRRWMFFGDVQARGQYPGYMQRFFRDHNITIEMTESDAEDLKHTVDFISFSYYMTGCVSHDESINKNAQGNILNMIPNPHLKSSEWGWQIDPVGLRVLLNKLWDRYQKPLFIVENGLGAKDSVEADGSIQDDYRIAYLNDHLVQVNEAIADGVDIMGYTSWGPIDLVSASHSQMSKRYGFIYVDRDDNGEGSLTRTRKKSFGWYAEVIKTRGLSLKK

SEQ ID NO: 17843 - protein, 461 aa, Escherichia coli CFT073
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLVVTAIYKVFGLNRHGKAHKLEE

SEQ ID NO: 17844 - protein, 359 aa, Escherichia coli CFT073
MIPTHAILVIFVLSCLILSSLVNLNDTNDQISDACRVFEHKLQICSKTDENEFSIVIILSMSDRRVFMATIAFLGLGQMGSPMANNLLQKGHSLQVFDVNTQAVDALVTQGATAAQTPAEAAASAEFIITMLPNGDIVRQVLLGEKGVCETVSSDALVIDMSTIHPLQTDALIRELQEKGINMMDAPVGRTSVNAIDGTLLILAGGTDEQIARARPILMCMGNELVEAGGPGMGIRVKLINNYMSIALNALSSEAAVLCESLGLNLDVAIKVMSGTAAGKGHFTTTWPGKVLKGDLSPAFMVDLALKDLRIAVDVARKTGAPLNMGIAAESYYAAASQDGKGRQDWSALLNQVRQQAGL

SEQ ID NO: 17845 - protein, 306 aa, Escherichia coli CFT073
MSSTMALEKGIAELVEEFIAAGRPSSRQQSITQRREGYIASAVLAGETETRVDIQTIELEGMTLRIVSPLNAPTLLPTIIYYYGGCFVSGGFATHDNQLRQLAYYGQCRIIAVQYRLAPEHTFPAAHDDAQRGAELVRQHAERLGVDKQRITLAGDSAGGHLALVTALRLKRAGEWQPAQLILIYPMLDATGHFESYIRNGHDYIITRDTLLSGFEMYLPGIERRHPEASPIWRNDFNGLPPVHIITAEYDPLCDEGEALYHRMTGQGVQCTCQRYLGVIHGFFQLGGISEAARSALRDVAWRAGR

SEQ ID NO: 17846 - protein, 1016 aa, Escherichia coli CFT073
  misc_feature (196)..(196): Xaa can be any naturally occurring amino acid
MQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGATVNRWLSTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNREYTEAYTNASLIVREDYGFEDGLFTGYDAEKRKYDKSTWTYELDENGFAKRDTTLQHPRCVWNLLKQHVSRYTPDVVENICGTPKDAFLKVCEYIAETSAHDKTASFLYALGWTQHSIGAQNIRTMAMIQLLLGNMGMAGGGVNALRGHSNIQGLTDLGLLSQSLPGYMTLPSEKQTDLQTYLTANTPKPLLEGQVNYWGNYPKFFVSMMKAFFGDKATAENSWGFDWLPKWDKGYDVLQYFEMMKEGKVNGYICQGFNPVASFPNKNKVIGCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPSSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 17847 - protein, 424 aa, Escherichia coli CFT073
MLNLYAKKFRCPDVLTSINTMFTLVPDISPTKPRELHHMTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLAKRGCYRVLFVDQSDEQALRAALAENPKLVLVESPSNPLLRVVDIAKICHLAREVGAVSVVDNTFLSPALQNPLALGADLVLHSCTKYLNGHSDVVAGVVIAKDPDVVTELAWWANNIGVTGGAFDSYLLLRGLRTLVPRMELAQRNAQAIVKYLQTQPLVKKLYHPSLPENQGHEIAARQQKGFGAMLSFELDGDEQTLRRFLGGLSLFTLAESLGGVESLISHAATMTHAGMAPEARAAAGISETLLRISTGIEDGEDLIADLENGFRAANKG

SEQ ID NO: 17848 - protein, 466 aa, Escherichia coli CFT073
MPHSYDYDAIVIGSGPGGEGAAMGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIEGCDDGVIMHLKSGKKLKADCLLYANGRTGNTDSLALQNIGLETDSRGQLKVNSMYQTAQPHVYAVGDVIGYPSLASAAYDQGRIAAQALVKGEANAHLIEDIPTGIYTIPEISSVGKTEQQLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 17849 - protein, 327 aa, Escherichia coli CFT073
MATRIEFHKHGGPEVLQAVEFTPADPAENEIQVENKAIGINFIDTYIRSGLYPPPSLPSGLGTEAAGIVSKVGSGVKHIKAGDRVVYAQSALGAYSSVHNINADKAAILPAAISFEQAAASFLKGLTVYYLLRKTYEIKPDEQFLFHAAAGGVGLIACQWAKALGAKLIGTVGTAQKAQSALKAGAWQVINYREENLVERLKEITGGKKVRVVYDSVGRDTWERSLDCLQRRGLMVSFGNSSGAVTGVNLGILNQKGSLYVTRPSLQGYITTREELTEASNELFSLIASGVIKVDVAEQQKYPLKDARRAHEILESRATQGSSLLIP

SEQ ID NO: 17850 - protein, 472 aa, Escherichia coli CFT073
MSTIFDVAVMGGGPGGYVAALRAAQNGLSVVCIDDGVNAQGEPSPGGTCLNVGCIPSKSLLQSSELYAQVQHEASIHGVNVDGVSFNAAAMIQRKDAIVSRLTMGIGLLFKKNKVKYLCGLATLEHARDEIWQLRVNDQQIRARNVVIATGSQPRQLPGVTIDNQQILDNRGALALTAVPPRLGVIGAGVIGLELGSVWNRVGSDVTLLEMAPTFLPALEARLSNEVRKAMIASGMKMQLAVEIEAIEQRDDGVHVRWRQGEKREESRFDKLILAIGRVPRLSGVDLVQLGLEADNRGGIAVDNLCRTGKAGLWAIGDVVRGPMLAHKAMAEGVVVADQIAGLAVEPINFALIPSVIYTQPEVAWVGENEASLKAAGRVFNKGNSLFAGNGRALALGQEGGRCTLYSDKHTDRVLGGAIVGPQASELINEIALAMTFSASGEDIACAIHAHPTLSEVIHEAAMALNNKALHG

SEQ ID NO: 17851 - protein, 449 aa, Escherichia coli CFT073
MSTPSARTGGSLDAWFKISQRGSTVRQEVVAGLTTFLAMVYSVIVVPGMLGKAGFPPAAVFVATCLVAGLGSIVMGLWANLPLAIGCAISLTAFTAFSLVLGQHISVPVALGAVFLMGVLFTVISATGIRSWILRNLPHGVAHGTGIGIGLFLLLIAANGVGLVIKNPLDGLPVALGDFTTFPVMMSLVGLAVIIGLEKLKVPGGILLTIIGISIVGLIFDPNVHFSGVFAMPSLSDENGNSLIGSLDIMGALNPVVLPSVLALVMTAVFDATGTIRAVAGQANLLDKDGQIIDGGKALTTDSMSSVFSGLVGAAPAAVYIESAAGTAAGGKTGLTAITVGVLFLLILFLSPLSYLVPGYATAPALMYVGLLMLSNVAKIDFADFVDAMAGLVTAVFIVLTCNIVTGIMIGFATLVIGRLVSGEWRKLNIGTVVIAVALVTFYAGGWAI

SEQ ID NO: 17852 - protein, 233 aa, Escherichia coli CFT073
MNMKISPSLMCMDLLKFKEQIEFIDSHADYFHIDIMDGHFVPNLTLSPFFVSQVKKLASKPLDCHLMVTRPQDYIAQLARAGADFITLHPETINGQAFRLIDEIRRHGMKVGLILNPETPVEAMKYYIHKADKITVMTVDPGFAGQPFIPEMLDKVAELKAWREREGLEYEIEVDGSCNQATYEKLMAAGADVFIVGTSGLFNHAENIDEAWRIMTAQILAAKSEVQPHAKTA

SEQ ID NO: 17853 - protein, 454 aa, Escherichia coli CFT073
MLSIFKTGQAADSVPAEKIQVTYRRYRMQALLSVFLGYLAYYIVRNNFTLSTPYLKEQLDLSATQIGVLSSCMLIAYGISKGVMSSLADKASPKVFMACGLVLCAIVNVGLGFSTAFWIFAALVILNGLFQGMGVGPSFITIANWFPRRERGRVGAFWNISHNIGGGIVAPIVGAAFALLGSEHWQSASYIVPACVAIVFAVIVLILGKGSPHQEGLPSLEEMMPEEKVVLNTRQTVKAPENMSAFQIFCTYVLRNKNAWYVSLVDVFVYMVRFGMISWLPIYLLTVKHFSKEQMSVAFLFFEWAAIPSTLLAGWLSDKLFKGRRMPLAMICMALIFICLIGYWKSESLFMVTIFAAIVGCLIYVPQFLASVQTMEIVPSFAVGSAVGLRGFMSYIFGASLGTSLFGIMVDHIGWHGGFYLLGCGIICCIIFCWLSHRGAIELERHRAAYIKEH

SEQ ID NO: 17854 - protein, 513 aa, Escherichia coli CFT073
MRKLSTAETLAAQIQDGATIAISGNGGGMVEADHILAAIEARFLQTGHPRDLTLIHSLGIGDRDSKGTNRFAHAEMLKRIIAGHFTWSPKMQELVKSNAIEAYCFPGGVIQALLREIGAGRPGLFTHVGLGSFVDPRNGGGKSNECTTDDLVELIEIDGETKLRYRPFKVDYAILRGTYADPRGNVSLEEEAIDMDSYSMALAAHNSGGKVFVQVRDVLEAGTIEPRRVKLPGILVDGIVEHREQPQTYLGGYDLTISGQHRRLSSNDAIELVSHPVRRLIARRAARELVAGASTNFGFGIPGGIPGVALREGVPYQSLWLSVEQGVHNGMMLDDALFGCARNADAIIPSLDQFEFYSGGGIDITFLGMGEMDQYGNVNVSHLNGNLIGPGGFLEIAQNARKVVFCGTFDAKGSKIDVTPDGLHIAQSGQIPKLVTLVEKITFSAAYAQQSGQEVLYITERAVFQLTAEGVELIEIAPGVEIERDILPFMAFRPIIKHPRLMESSLFTPMEDA

SEQ ID NO: 17855 - protein, 259 aa, Escherichia coli CFT073
MMSVVNPPLLYSYGILLLFLFPRDLSSFPRQSFTQRSVADMLPATLYPKKGNTMTTPTFDTIEAQASYGIGLQVGQQLSESGLEGLLPEALVAGIADALEGKHPAVPVDVVHRALREIHERADAVRRQRFQTMAAEGVKYLEENAKKEGVNSTESGLQFRVINQGEGAIPARTDRVRVHYTGKLIDGTVFDSSVARGEPAEFPVNGVIPGWIEALTLMPVGSKWELTIPQELAYGERGAGASIPPFSTLVFEVELLEIL

SEQ ID NO: 17856 - protein, 470 aa, Escherichia coli CFT073
MVDQVKVVADDQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLSVIILLLVLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFSLIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVLVLLTLEDDTRQALLVTPLWFIALGLGWLFIGKKRAAELRK

SEQ ID NO: 17857 - protein, 353 aa, Escherichia coli CFT073
MLYTSQTTPEKDQKMSMIKSYAAKEAGGELEVYEYDPGELKPQDVEVQVDYCGICHSDLSMIDNEWGFSQYPLVAGHEVIGRVVALGSAAQNKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALAGQFDLIINTVNVSLDWQPYFEALTYGGNFHTVGAVLTPLPVPAFTLIAGDRSVSGSATGTPYELRKLMRFAARSKVAPTTELFPMSKTNDAIQHVRDGKARYRVVLKADF

SEQ ID NO: 17858 - protein, 476 aa, Escherichia coli CFT073
MPARHPAGGTALTRYTVAKAPKRAFVCNECGADYPRWQGQCSACHAWNTITEVRLAASPTVARNERLSGYAGSAGVAKVQKLSDISLEELPRFSTGFKEFDRVLGGGVVPGSAILIGGNPGAGKSTLLLQTLCKLAQQMKTLYVTGEESLQQVAMRAHRLGLPTDNLNMLSETSIEQICLIAEEEQPKLMVIDSIQVMHMADVQSSPGSVAQVRETAAYLTRFAKTRGVAIVMVGHVTKDGSLAGPKVLEHCIDCSVLLDGDADSRFRTLRSHKNRFGAVNELGVFAMTEQGLREVSNPSAIFLSRGDEVTSGSSVMVVWEGTRPLLVEIQALVDHSMMANPRRVAVGLEQNRLAILLAVLHRHGGLQMADQDVFVNVVGGVKVTETSADLALLLAMVSSLRDRPLPQDLVVFGEVGLAGEIRPVPSGQERISEAAKHGFRRAIVPAANVPKKAPEGMQIFGVKKLSDALSVFDDL

SEQ ID NO: 17859 - protein, 1619 aa, Magnaporthe grisea
MSQPVEDPSHDQARNDNAQTTTDTGNASMPKTNGHDQESSATGISSSPADTLMDKEKQAAPTPEPSTEKAAVPDPAASVASDTAEDEFFDDNDSEQRRRNEMVQQLARTYTSRSNASAAADEYGNANPFLIASEDPDSPLNPSGNNFKAYAWAKAIAGMVAAEGGSFRTIGICFQNMNVFGFGAATDFQKTVSNVWLEAANMLRTAVGMGKTTRIDILRGFNGVVRNGEMLVVLGPPGSGCSTFLKTIAGETNGLNVDQSAYFNYQGLSAEEMHKRHRGEAIYTAEVDVHFPQLSVGDTLTFAANARAPRRAPPGVSKTLFANHIRDVVMAIFGISHTINTRVGNEYIRGVSGGERKRVTIAEAALSGAPLQCWDNSTRGLDSANAIEFCKTLRVCTRLFQTTACVSIYQAPQSAYDMFDKAVVLYEGYQIYFGPADEAKQYFVNLGFECPARTTPDFLTSMTAPHERIVRPGFEGKAPRTPEEFAIAWENSAEYTALQADIEEYKSSHPINGPDAEAFRKSRAAQQGRGQRPNSPYTLSFYQQTKLCLWRGWKRLLGDPTLTVGALFANTLMALVISSIFFNLQMTTSSFFQRGALLFFACLLNGFAAALEILILFAQRPIVEKHDRYALYHPSAEAVASMLCDMPYKVFNAIVFNLVLYFMANLRREPGAFFFYLLISFATVLAMSMMFRTIASMSRSLSQAMVPAAAIILILIIFTGFVIPLDYMLPWCRWLNYIDILAYSFESLLINEFAGQRYTCTEFVPRAEFPGYGDLSGTNRVCQAVGSVAGQPFVKGEDYLYSSFRYESANKWRNFGILIAFMIFFCSRTWLRPRMCERKKSKGEVLVFRRGQRPAAIKDAKTDPEAGPPKVGGAVVAANMTGENAGFIQRQTSTFGWRDVCYEVQIKKETRRILDHVDGWVKPGTLTALMGVSGAGKTTLLDCLADRTSMGVITGEMLVDGHQRDASFQRKTGYVQQQDLHLQTTTVREALNFSALLRQPAHVPRAEKLAYVDEVIRLLDMQEYADAVVGVPGEGLNVEQRKRLTIGVELAAKPPLLLFVDEPTSGLDSQTSWAILDLLEKLTKSGQAILCTIHQPSAMLFQRFDRLLFLAKGGKTVYFGDIGENSKIMTDYFERNGGFPCPHDANPAEWMLEVIGASPGTTSDIDWHQAWRESPECADVHAELDRLKEQVPNTPPPTEDKASYREFAAPFHQQIYAVTHRVFQQYWRTPSYIYAKAALCAVTALFIGFVFYDAPNTQQGLQNQMFAIFNILTVFGQLVQQTMPHFVIQRDLYEVRERPSKVYSWKVFMLSQIIVEIPWNSLMAVIMFFCWYYPVGLERNAILADQVTERGALAFLYLWGFLIFTSTFTDLMIAGFETAEAGGNIANLFFSLCLIFCGVLANPDTMPRFWIFMYRVSPFTYIVSGLLSVAVANSEVRCASNEFLHFDPLNGTCAEFMRNYINGTTIPGLGRIPGAGGYLRPDTESSRSNCAFCPIKDTNIFLQGAHANYNDRWRNFGLIFVYIIFNIIAALFVYWAVRVPKKKLGGKDAAAGVGAGAGAARASASNEKGKMQREKGEVEGLTTAVLGTSVAGSDAPMTTTTEGEGERAKRRTSGDEVVR

SEQ ID NO: 17860 - protein, 486 aa, Acinetobacter sp. YAA
MKDIKHYINGQYVGSASGKLFDNVNPANGKLISKVHEAGREEVDAAVNAAKAALRGPWGKMTLEERTSILHKVADGINARFDEFLKAECLDTGKPKSMASHIDIPRGAAHFKVFADMIKNVPTESFEMPTPDGTGALNYAVRRPKGVIGVISPWNLPLLLMTWKVGPALACANTVVVKPSEETPTTTALLGEVMKEAGIPTGVYNVVHGFGGDSAGAFLTEHPQVDGFTFTGETVPGEVIMKAAAKGIRDISLELGGKNAALVFADCDMDKAIEGTMRSAFANCGQVCLGTERVYVERSIFDEFVGRLKEAAEGLKIGPPDDAEANLGPLVSLKHREKVLSYYQKAVDDGATVVTGGGVPEMPEELAGGAWVQPTIWTGLPKDSAVITDEIFGPCVHVCPFDTEEEAIELANSLPYGLASAIWSENITRAHRVAGQIEAGIIWVNSWFLRDLRTPFGGSKQSGIGREGGVHSLEFYTEMKNICVKL

SEQ ID NO: 17861 - protein, 236 aa, Pisum sativum
MASMAFSTTFFTPLRDFNQPRTNSTPSTSLPFTKSSIASSKSPFFQLGFSQQASSNFPIVPSKTRSFSVNAKAIKDKTIYDFTVKDIDKKDVSLSKFKGKVLLIVNVASRCGLTSSNYTELSHLYENFKNKGLEVLAFPCNQFGMQEPGSNEEIKQFACTKFKAEFPIFDKVDVNGPFTAPVYQFLKSSSGGFFGDIVKWNFEKFLVDKNGKVVERYPPTTSPFQIEKDIQKLLAA

SEQ ID NO: 17862 - protein, 134 aa, Aspergillus niger
MTGGKSGGKASGSKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTPKSGKGPGSQEL

SEQ ID NO: 17863 - protein, 440 aa, Sorghum bicolor
MSTTKVKRRVGKYELGRTIGEGTFAKVRFARDTVTGEAVAIKILDKDKVLKHKMVEQIKREISTMKLIKHPNVVRIYEVMGSKTKIYIVLEFATGGELFQRIVNHGRMREDEARRYFQQLINAVDYCHSRGVYHRDLKPENLLLDSYGNLKVSDFGLSALSQQMKDDGLLHTTCGTPNYVAPEVLEDQGYDGAMADLWSCGVILFVLLAGYLPFEDSNLMTLYKKISNAEFTFPPWTSFPAKRLLTRILDPNPMTRITIPEILEDEWFKKGYKRPEFDEKYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKAKGDTLEFHKFYKNLSKTLKDVVWKSDDTQMLHAA

SEQ ID NO: 17864 - protein, 440 aa, Sorghum bicolor
MSATKVKRRVGKYELGRTIGEGTFAKVRFAKNTETGEPVAIKILDKEKVLRHKMVEQIKREISTMKLIKHPNVVRIYEVMGSKTKIYIVLEYVTGGELFDTIANHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEYTFPPWTSFPAKRLLTRFLDPNPMTRITIPEILEDEWFKKGYKRPEFDEKYDTPLDDVDAVFNDSEEHHVTEKKEEEPVVLNAFELISRSAGLNLGNLFDSEQEFKRETRFTSKCPPKEIVRKIEEAAKPLGFGVQKKNYKLRLEKVKAGRKGNLNVATEILQVAPSLHMVEVRKAKGDTLEFQKFYKNLSKTLKDVVWKSEDLQMQPAS

SEQ ID NO: 17865 - protein, 179 aa, Fritillaria agrestis
MAASSTMLSSVATAACAAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVERPE

SEQ ID NO: 17866 - protein, 179 aa, Fritillaria agrestis
MASSATMLSSVATAACAAPAQASMVAPFVGLKSASAFPVTQKTATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTGAAQVVKEAAECKKEYPAAFIRVIGFDNVRQVQCVSFIVEKPE

SEQ ID NO: 17867 - protein, 236 aa, Fritillaria agrestis
MSAAVAIETPAFAPVPVARDEPVAKPGKVTKAKAPKEKKASVAKKPALHPTYLEMISEAIASLKERTGSSQYAIAKFVEDKHKSHLPANFKKLLLVQLQKLTAAGKLTKVKNSYKISAKPTPAAKPKSAAVKPKSAATKLKSAAKKVKKAAVKPKPKSAAVKPKAPAVNMKSKPAALKPNTVTKSKTVALKGKTAGRPAKAAKTSVKAAPGKKAAPVALKKAKAGKKVTTPKKAKK

SEQ ID NO: 17868 - protein, 330 aa, Pyrus communis
DVDFWDAKGQTPLFPRIFGHEASGIVESVGEGVEGLEVGDHVLPVFTGECGDCAHCKFEESNMCDLLRINTDRGVMLSDGKTRFSINGTPINHFLGTSTFSEYTVIHSGCLAKTNPLAPLDIVCILSCGISTGLGATLNVAKPKKGSSVAIFGLGAVGLAAAEGARICGASRIIGVDRNPKRFEEAKKFGVNEFVNPKDHDKPVQEVIAEMTNGGADRSIECTGYINAMISAFECVHDGWGVAVLVGVPNKDAVFMTKPINVLNERTLKGTFFGNYKPRTDLPLVVEMYMSKKLEVEKFITHRVPFSEINKAFDYMTKGEGLRCIVSMEE

SEQ ID NO: 17869 - protein, 330 aa, Pyrus communis
DVYFWEAKGQNPLFPRIYGHEAGGIVESIGEGVTDLKAGDHVLPVFTGECKDCAHCKSEESNMCDLLRINTDRGVMLSDGKSRFSIKDKPIYHFVGTSTFSEYTVVHVGCLAKINPLAPLDKVCLLSCGISTGLGATLNVAKPKKGSTVAVFGLGAVGLAAAEGARFSGASRIIGVDLHSGRFEEAKKFGVTEFVNPKEHKKPVQEVIAELTNGGVDRSIECTGSVEFMISAFECVHDGWGVAVLVGVPHKEAVFKTHPLNFLNERTLKGTFFGNYKPRTDIPSVVEKYMNKELQLEKFITHKVPFSEINKAFEYMLKGEGLRCIIHMED

SEQ ID NO: 17870 - protein, 364 aa, Bartonella vinsonii subsp. berkhoffii
MLAVFLLKHCYMLRKCLLKRNMAFETLGISIAKSKLNLDQMMAHKKAVVTANTSGVSFLMKKNKVDTFFGTAKILAAGQIEVVARDGNKQTIATKNIIIATGSESSSIPGVNVEIDEKVVVSSTGALALEKVPTRMIIVGAGIIGSELSSVWSRLGAKVTIIEYLNKVLGSMDGEVSRQFQKIMEKQGIEYKTGVKVTAITQSGSGAQVSFEAVKGGESETLEADVVLIATGRSPYTEGLGLVETGVKVDERGFIDIDAYWQTNIPGIYAIGDVVKGPMLAHKAEEEGVAVAEILAGQKGHVNFDVIPSVVYTQPEIASVGKTEEELKAAGIDYNVGKFPFMANGRARAMQKSDGFVKILADKK

SEQ ID NO: 17871 - protein, 207 aa, Campylobacter fetus
MVIVKKISAIEVLDSRGNPTIKTKVELCDGSIGEAIVPSGASTGKRERLELRDGGEAFGGKGVLKAIKNVNSMIAEEICGKDAYNQKAIDDAMLALDGTDNYSRIGANAVLGVSMAVARAAANSLNIPLYRYLGGANACTLPVPMFNIINGGAHANNSVDFQEFMIMPFGFSKFSNALRAATEVYQTLKKILNDLGHSTAVGDEGGF

SEQ ID NO: 17872 - protein, 467 aa, Pseudomonas putida
MQQAQGLKRGLNARHIRFMALGSAIGTGLFYGSASAIQMAGPAVLLAYLIGGAAVFMVMRALGEMAVHNPVAGSFGHYASTYLGPMAGFILGWTYAFEMVIVAIADVTAFGIYMGFWFPEVARWIWVLGIVFLIGGLNLCNVKVFGEMEFWLSLLKVGAIVAMILAGLGIMAFGFSQVGTGHAVGVSNLFDHGGFMPNGVGGLIASFAVVMFAFGGIEIIGVTAGEAKDPQRVIPKAINAVPLRILLFYVLTLFVLMCLYPWPQIGSEGSPFVQIFSNLGIGSAAAVLNVVVISAAISAINSDIFGAGRMMYGLAHQGHAPRSFGKLSKHGVPWMTVVVMGAALLIGVLLNYLIPENVFLLIASIATFATVWVWLMILLTQVAMRRSMSREEVAQLKFPVPFWPYGPAMAIAFMVFIFGVLGYFPDTQAALIVGVIWVVFLVASYLLWCKPRAGQGQPVAEPVELHR

SEQ ID NO: 17873 - protein, 484 aa, Sphingomonas chungbukensis
MTILNFIDGSYREGSEGKSFSNVNPATGAEIGVVHEASQAEVEDAVEAAKAALTGPWGKMTTARTGQADHRVATEIERRADDFLAAEVADTVKPRHVVSHIDIPRGAANFRMFADVVSTMPGESFNTPTPDGGQAFIYTVSKPKGVDAAVCPRNFPLLLMIWKVGPELACGNTAVVKPSEEIARTAALLGDVIDAGVNHHGVFNVAQRFGPASAGEFLTSNPDVDAITFTGETGTGQAIMQKAATGVRDISFELGGKNPAIVFADADLDKAVEGLSRSVFLNTGQVCLGTERVYVERPIFDAFVARMAAAAQDFKPGVTGDRAYLGPLISAEHREKVLAYYPRAVEDGPTVFTGGGVPEISGAETGGFFVEPTLWIDVAHGDTVMREEIFGPCCDILPFDSEDEVIALANDTVYGLCASVWTENLSRGHRVAAAMEVGVCWVNSWFLRDLRTAFGGSGHSGIGREGGVHSLEFYTEITNICVKL

SEQ ID NO: 17874 - protein, 1078 aa, Arabidopsis thaliana
MELSVSPQTQKMNLQTPRKSSLSGSRKDLWFAIREGSLVDVDSALSILKKTGGNINLRNAYGLTPLHIAVWRNHIPIVRRLLAAGADPDARDGESGWSSLHRALHFGHLAVASVLIDSGASFTLEDIKLRTPVDLVSGPVAQVIGEQQSSEVFSWGNGANYQLGTGNQHVQKVPGRVDSLHGCFIKLVSAAKFHSVAISTHGEVYTWGFGRGGRLGHPEFDIHSGQAAVITPRQVISGLGSRRVKAVAAAKHHTVIATEGGDVYTWGSNREGQLGYTSVDTQATPRKVTSLKAKIVAVSAANKHTAVVSDCGEVFTWGCNKEGQLGYGTSNSASNYSPRLVDYLKGKVFTAIASSKYHTLVLRNDGEVYTWGHRLVTPRRVIISRNLKKAGNTLLNFHRRRPLRLTAIAAGMVHSLALAEDGAFFYWVSSDSNLRCQQLHSLHGKTVVSISAGKYWASAVTSTGEVYMWDGKNGKDIAPSLSRLHNLKRATTVAVGETHLLVVGSLYHPAYAPIVLKKSQTLQADKCREEENEELDEGFMFDDVESVNVLQSVQYDNPKERIVPSLKSLCEKVAAECIVEPRNAIQLLEIADSLGAEDLKKYCEDIVIRNLDFILTFSPQSIANTSPDVLANLEKLLDDRSSETWSSRPLPTPTATFPVVIDSEEEESESDILRTRDSHVKHFSSIGGTRMDSFLQPEDELTQHNSKEVRALRKKLQQIEILEAKQSRGQLLDGQQIAKLQKKLDIESSLVELGIPVEEFPEAKATTALPLEGKANKKGKKKKKGNQRFVQVETFPEFGEVKVGIDTMQDKEIEEICEAIKPKGGKTMLDTTMISGFPKESDFVSLSQKKDNPPDSPRSKKLATAANKKKNRKGGLSMFLTGALDDVPKPVVAPPPRPKIEGPVWGGAKISKGLSSLRDIQDEQSKTRSHEPVRTTKNQSGDDSPGKSEGKILLSSFLTSKPIPMEPAKSLQQSDVEKGTPPWASSETPRKLSRPSLRDIQMQEVKKQQSLSHSPKTKTSGFTVATGQGSPSDSPGTNRWFKPEIDAPSAIRSIQIEEKAMKDLRRFYSSVKVVRNQP

SEQ ID NO: 17875 - protein, 418 aa, Arabidopsis thaliana
MNISSRGAAAIDESLVFGSSGVVYAPYGDYLKFVKKIIATKLLRPQVLERSRGLRAEELQRLYNRILDKAKMNENVEIGKEATMLMNNIFCRMSMGRSFSEENGEAERVRGLVAESYALAKKIFFASVLRRLLKKLRIPLFKKDIMDVSNRFNELLEKILVEHNEKLDEEHKDTDMMDVLLAAYADENAEYKITRNHIKSFFVELFVGGTDTSVQTTQWTMAEIINNSDVLERLREEIDSVVGTSRMIQETDIPNLPYLQAVVKEGLRLHPPFPLLTRKFEERCEIKGFYIPEKTFLIINAYAWMRDPDSWEDPNEFKPERFLGSSRLGQVDEREEAQKYIPFGGGRRGCPGANLASIFVGTAIGVMVQCFDWGIKGDKINMEETFEGLTLTMVHPIKCTPIPRTLPFVTSNLQSPSS

SEQ ID NO: 17876 - protein, 130 aa, Arabidopsis thaliana
MNFRRENRASRTSLFDGLDGLEEGRLRASSSYAHDERDNDEALENLQDRVSFLKRVTGDIHEEVENHNRLLDKVGNKMDSARGIMSGTINRFKLVFEKKSNRKSCKLIAYFVLLFLIMYYLIRLLNYIKG

SEQ ID NO: 17877 - protein, 457 aa, Arabidopsis thaliana
MYALIHHGRRLVQLQKLSNFRVSVQNGSALSNSFSFASVADATLIDSLKGNNFTVSYLVDSLGLTTKLAESISKKVSFEERRNPDSVLSLLTSYGFTKSQISSIITIYPRLLALDAEKSIAPKLQSLQSRGASSSELTQIVSTVPKILGKRGHKSITVYYDFVKDIIEADKSSSYEKLCHSFPQGNKKNKIRNISVLRELGVAQRLLFPLLISDGQPVCGKERFEESLKKVVEMGFDPETTKFVEALRVIYRMSDKTIEEKVNVYKRLGFGVADVWAIFKKWPSFLSYSEKRITHTFETLKSCGLLKHEVLLLLKKHPKCICSSEQKIVNSIETFLGLGFSRDEFAMMVKRYPQCIDYTAETVKKKTEFIVKNMNWPLEALVSIPQVFGYSLEKRTVPRCNVIKTLISKGLMKDGSEAPPMSSVLTSTDQAFLRRYVMKHDKLAPELMAIFTGENGK

SEQ ID NO: 17878 - protein, 441 aa, Arabidopsis thaliana
MERGEEASGPMMEMCTNGGEETSNRRPIISGEPLDIEAYAALYKGRTKIMRLLFIANHCGGNHALQFDALRMAYDEIKKGENTQLFREVVNKIGNRLGEKYGMDLAWCEAVDRRAEQKKVKLENELSSYRTNFIKESIRMGYNDFGDFYYACGMLGDAFKNYIRTRDYCTTTKHIIHMCMNAILVSIEMGQFTHVTSYVNKAEQNPETLEPMVNAKLRCASGLAHLELKKYKLAARKFLDVNPELGNSYNEVIAPQDIATYGGLCALASFDRSELKQKVIDNINFRNFLELVPDVRELINDFYSSRYASCLEYLASLKSNLLLDIHLHDHVDTLYDQIRKKALIQYTLPFVSVDLSRMADAFKTSVSGLEKELEALITDNQIQARIDSHNKILYARHADQRNATFQKVLQMGNEFDRDVRAMLLRANLLKHEYHARSARKL

SEQ ID NO: 17879 - protein, 194 aa, Arabidopsis thaliana
MATNIGMMDSAYFVGRNEILSWINDRLHLNLSRIEEAASGAVQCQMLDMTFPGVVPMHKVNFEAKNEYEMIQNYKVMQEVFTKLKITKPLEVNRLVKGRPLDNLEFLQWLKRFCDSINGGIMNENYNPVERRSRGGREKSVKGSSKISKSLQTNNMHHPPVATSNKPAGPKQAKSHGIGGGATHQPKCKLCQRR

SEQ ID NO: 17880 - protein, 374 aa, Arabidopsis thaliana
MEMVNAEAKQSVPLLTPYKMGRFNLSHRVVLAPLTRQKSYGSVPQPHAILYYSQRTSPGGFLIAEATGVSDTAQGYPDTPGIWTKEHVEAWKPIVDAVHAKGGIFFCQIWHVGRVSNRGFQPRRQAPISCTGKPIMPQMRANGIDEARFTPPRRLSIEEIPGIVNDFRLAARNTMEAGFDGVEIHGAHGYLIDQFMKDKVNDRTDEYGGSLQNRCKFALEVVDAVAKEIGPDRVGIRLSPFADYMESGDTNPEALGLYMVESLNKYGILYCHMIEPRMKTVGEIAACSHTLMPMREAFKGTFISAGGFTREDGNEAVAKGRTDLVAYGRWFLANPDLPKRFQLDAPLNKYNRSTFYTSDPVVGYTDYPSLESTA

SEQ ID NO: 17881 - protein, 397 aa, Arabidopsis thaliana
MDFNAGVPMSSLSPLMNQDAMWQMNLSSDETMETGSYPERPGEPDCSYYIRTGLCRFGSTCRFNHPRDRELVIATARMRGEYPERIGQPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPQGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLPLRPGEPLCVFYTRYGICKFGPSCKFDHPMRVFTYDNTASETDEVVETSTGKSRRLSVSETRQAATTSSGKDTTIDNTQQ

SEQ ID NO: 17882 - protein, 378 aa, Arabidopsis thaliana
MKKLLVTKLLGPQALERSRGIRADELERFHSSLLDKAVKKEIVEIGKEATKLSNNSLWRMSIGRSFSEKNGEAERVRGLVTELDGLTKKVLFATLLHRPLEKLGISLFKKEIMCVSDSFDEVLERVLVEHEQKLDDHQDRDMMDVLLAAYGDENAGHKISRNHIKAFFVELFFAGTDTSAQSIQWTMAEIINNPNILKRLREEIDSVVGKTRLIQETDLPKLPYLQAVVKEGLRLHPPLPLFVRTFQEGCKIGGFYVPEKTTLIGNAYVMMRDPSVWEDPEEFKPERFLSSSRSTQEEERREQALKYIPFGSGRRGCPGSSLGYIFVGTAVGMMVQCFDWSIKGDKVQMDEAGGLNLSMAHSLKCTPVPRNRPLLADQ

SEQ ID NO: 17883 - protein, 502 aa, Arabidopsis thaliana
MAMIIGLLEIFIAFIFFFVYQCFSLHKKTPKHMVMNWPVLGMLPGVLFQIPRIYDFVTEALEAENMTGCFIGPWLSGTDILLTVDPVNIQYILSSNFVNYPKGKKFNKIFEFLGDGIFNVDSGLWEDMRNSSHAIFSHQDFQSFSVSTSVSKLSQGLVPILDNAVEKHILVDLQDLFQRFLFDTSSTLMAGYDPKSLSVEMPKVEFADAMDGVADAMFYRHLKPAFLWSIQSWIGVGIEKKMRRGLDVFDQMLGKIISAKREEIKNHGIHDSKGEAMDVLTYYMTIDTTKYKHLKPSNDKFIRDTILGLVIAARDTTSSALTWFFWLLSKNPEAMTKIRQEINKKMPKFDPADLDKLVYLDGAVCETLRLYPSVPFNHKSPAKPDVLPSGHKVDKNWRVVIPIYSLGRMKSVWGDDAEDFRPERWISDSGMLRQESPYKFLAFNAGPRTCLGKRLTFLQMKTVAVEIIRNYDIKVVEGHKPKPVPSVLLRMQHGLKVSVTKI

SEQ ID NO: 17884 - protein, 320 aa, Arabidopsis thaliana
MATAVGGGSDVEVGFAKLQGEDFEYYMQSYSIILGRNSKKATVDVDLSSLGGGMSISRNHARIFYDFTRRRFSLEVLGKNGCLVEGVLHLPGNPNVKLDSQDLLQIGDKEFYFLLPVRSILGGPLGPRHHVSGQTSVVPYHNYQSGPGSGSGKKGVRSRELYEYDDEDDDDDDDEEDDMRGSGKKTRRDGHEVVYASGEKKREGRSKVDREADDQQFLQLEEKDVVSSVATVLSDLCGPGEWMPMEKLHSVILKEYGNVWHHSRVRRYLSQEDWAIPEAKGKPWYGLLMLLRKYPEHFVINTRSKGRVTLEFVSLVTLLS

SEQ ID NO: 17885 - protein, 419 aa, Arabidopsis thaliana
MDYLPVEVIGNILSRLGGARDVVIASATCRKWREACRKHLQTLSFNSADWPFYRDLTTNRLEILITQTIFQTMGLQGLSIMMDDANKFSAATVIAWLMCTRDTLRRLSYNVRTTPNVNILEICGRQKLEALVLAHNSITGVEPSFQRFPCLKSLSLSYVSISALDLNLLLSACPMIESLELVSLEIAMSDAQVTIELSSPTLKSVYFDGISLDKFILEADSIEFLHMKDCVLELFELIGNGTLKHFKLDDVSVIHLDIMETSESLEVVDVNHFTMVWPKFYQMISRSQKLKKLRLWDVVFDDDDEIIDVESIAAGFSHLTHLSLSYDLKDGAAHYSLQGTTQLENVTVLELGWTVINDVFSIWVEELLRRCPNLKKLIIYGVVSETKTQGDCQILATFTWSIVQLMRKYIHVEVQFEYE

SEQ ID NO: 17886 - protein, 449 aa, Arabidopsis thaliana
MDAKMFDTICSRDAISWLPDEVLGKILSLIPTKQAVSTSLLAKKWRTIFRLVDHLELDDSFSLQAVKDQTPGLRKHVRFVFTEDFKIFVDRTLALQCDYPIKNFSLKCHVSKYDERQKACVGRWISNVVGRGVFELDLRMKDPGIHFLPPHLVASKTLVKLTLGTQLCLGQLPSYVSLPSLKSLFIDTIVFYDIEDLCCVLLAGCPVLEELSVHHHDFIATPHTISSPTLKRLSVDYHCPDDVDSASHMSFDLPKLVYLEYSHCALGEYWQINLESLVEAKLDLGLERKVLRMDVTDLIIGIRNVQSLHLSPDSVHVIYSYCRHGLPVFKNLVNLSFGSKNKRGWRLLANLLKQSTKLETLIVKDLNGYTGDVSMPLNKVTSLHILGYRGTADEVKQLKSFIGEFECLELVQVDVAEAAEDNGKILQSKRDLMMLLGVSLPSKCQFKVT

SEQ ID NO: 17887 - protein, 266 aa, Arabidopsis thaliana
MGHDNITKLGSLLVKLHKGPSSWLCLHPRPDRTSNGGRIKLVRSDGSLQVYDRPVVVSELTKDFPKHKICRSDLLYIGQKTPVLSETETLKLGLNYFLLPSDFFKNDLSFLTIATLKTPQNGGVLVKKTQQQPQPFLIQKGEKGERLRIRVSEEFVSELVMEGKKNRVNEEEEEEEGGGEGEGRVCTTVKLKKDYVQLVGLRRWKPKLETITETKAMKAATMEKTKKKRKRFTVMKKKSQSDSSSKRKLQSKSKSKTKKSIMRKID

SEQ ID NO: 17888 - protein, 389 aa, Arabidopsis thaliana
MGWWRKKKKPKSEIASERGAKLLKDLIECCDGKSNPIKFFSADEIRKATNNFGVSNLVSELSHDFDYKWYSGKNENHDMILVRKAFSQSVYYKDTFFRDIAVSSMVSGHKNFLKLIGYCLEFEEPVMVYHGVKKHYHLESSGQPWKRRMKIAEDIATALAYLHTAFPRPFVYRCLSLTNILLDEDGVAKLMDFSFCVSIPEGETFVQVDYTAGTVDYLKPNYLKHGVVSEETDVFAVGHSMQMLLMGEKIFDRIMRRPFPTSKFMEEPKMDEIADPEMGEISEEELCQMKAFLLLSLRCTGHVGEVPTMVEVAKELKSIQRCLHNDTFSPSVETQFDSHQDISSSVILSNQTKDTRALLRCIACHVFDEMFQWVMMNWFRFFRRNRRIC

SEQ ID NO: 17889 - protein, 484 aa, Arabidopsis thaliana
MDDCSKDIINCLPDNLLCQILSNLSTKEAALTSLLSKRWRYLFALVPNLDFDVLPSLHPEVAMQDQDQTSFIDFVDRVLKLRGKDHINKFSLKCGDGIEDEDVFPWILNTLRHGVSDLSLHVSPSLVYWLPSKVFASKTLVRLKIGPKDGPRVKLRNVCLPKLKTLNLDSVVFEEGKIGFAKLLSGCPVLEELSLLNLAWDRWDSCSVSSKILKRLTLYCAHSSRNPKSVSFDTPNVVYFEYSDNIANKYPKVNFDSLVEASIGIRMTKVQKANARYVSDVDEETEMVGNATDLLMGICNVKTLYLSYDTLETLNLCCQVIPVFNNLTHLTIESHPELGWESLPNLLKSCPNLGTLVFQGLLHKATDRCGDVCMCQGLENSHSCLSSSPVKCLKILKFGETNDDDDMEIEMEQIKNFLEKMPNLEQLIIYYESSIDNDLVRVSSQLQEVPTVASLKCKIQVISDNLSLSSTLPISLSMENGFHL

SEQ ID NO: 17890 - protein, 165 aa, Euphorbia esula
MSADIEYRCFVGGLAWATTDQSLQEAFSPYGEILDSKIINDRETGRSRGFGFVTFNNEKSMRDAIQGMNSQELDGRNTTVNEAQSRGNGRSGGGGGYSRGGGGGGYGSGGGRRERGYGGGGGGYNSISTGGSGGYGGGRDQGYGSGGGGSRYSTGGGESDGNWRN

SEQ ID NO: 17891 - protein, 394 aa, Candida tropicalis
MATIFLFTKNVFIALAFALFAQGLTIPDGIEKRTDKVVSLDFTVIRKPFNATAHRLIQKRSDVPTTLINEGPSYAADIVVGSNQQKQTVVIDTGSSDLWVVDTDAECQVTYSGQTNNFCKQEGTFDPSSSSSAQNLNQDFSIEYGDLTSSQGSFYKDTVGFGGISIKNQQFADVTTTSVDQGIMGIGFTAVEAGYNLYSNVPVTLKKQGIINKNAYSCDLNSEDASTGKIIFGGVDNAKYTGTLTALPVTSSVELRVHLGSINFDGTSVSTNADVVLDSGTTITYFSQSTADKFARIVGATWDSRNEIYRLPSCDLSGDAVVNFDQGVKITVPLSELILKDSDSSICYFGISRNDANILGDNFLRRAYIVYDLDDKTISLAQVKYTSSSDISAL

SEQ ID NO: 17892 - protein, 303 aa, Arabidopsis thaliana
MMMEQICRDDDWIVDESSLTKLSSLGRGNFGYVSLEKDSNSRLYAKKSSPMHLKKILEKELRIMHRFRDHPRIVQASNKLHLQIQPYEYCYIYMEYASKGNLHRFIYGFRRKEEPIPESLVSRTARMILEGLEALHSHGYVYCDLKPSNVLLFPSTTPGEPWDLKLADFGSSKEPDTDHDPTSLGTVEYMPPDSFVPNGLIDPGHIDPALDIYSLGCVVNEMFGAIPIQEYFDEFYVWHLRDVISPQAQDFLRRCDDMRSRRPTATELLKHPFITQGLPSPTTEDNKEISRSLIPSFSKLLLT

SEQ ID NO: 17893 - protein, 295 aa, Arabidopsis thaliana
MEKLGRDDELIVDESSLKSFSLLCQGNFSYVCLMKDSKSRRCAKKSSPMQHKQILEKELRIMHRFRDHHRIVQASNKFHIQIKPSECYIYMEYASEGNLHKFISGLEGKSVPESLVQRTARMILEGLEALHSHGYVHCNLRPSNVLLFPSKTPGEPWDLKLADFGSSKEPDSDYGWMYFGTAPKYMPIESFGPKGVIIDPSLDIYALGCVVYEMLGAIPIQDYFDEYYEWNLRRHISPEARDFLSRCSNMHPHRPTAAYLLNHPFITQILPSPTTEDNKEISRSLIPSFSKLLLA

SEQ ID NO: 17894 - protein, 506 aa, Lithospermum erythrorhizon
MALPAIPLAIIIFLIISYKLYQKLRLKLPPGPRPLPIIGNIYQVKPVKFRCFYNWSKTYGPIFSIYYGSQMNVIVSTTELAKEVLKENDQHLADRFRTRSSASMSRGGKDLIWADYGPHYVKVRKLCNVELFSPKRLEAIRPMREDEYTALVESIYKDCTKPELKGKSLLVREYLSSVAFNNITRLAFGKRFMDSNGVVNEQGQEFKKITHDGIKITAKLSIAEYIPWIRWMFKVEQDALDKFAADRDHLTRVIMEEHIKSGNTKQHFVDALLTLQKQYDISEDTIIGLLWDMIAAGMDTATISTEWAMAELVRNPRVQRKAQEELDRVVGPDRIMTEADVPKLPYLQCIVKESLRLHPPTPLMLPHRASANVKIGGYDIPKGSIVHVNVWAIARDPAYWKNPEEFRPERFMEEDIDMKGTDYRLLPFGAGRRICPGAQLAINLITSSLGHLLHQFTWSPQPGVKPEEIDLSENPGTVTYMRNPVKAVVSPRLSAVHLYKRVESDM

SEQ ID NO: 17895 - protein, 196 aa, Arabidopsis thaliana
MSASRFIKCVTVGDGAVGKTCILISYTSNTFPTDYVPTVFDNFSANVVVDGNTVNLGLWDTAGQEDYNRLRPLSYRGADVFILAFSLISKASYEHVAKKWIPELRHYAPGVPIILVGTKLDLRDDKQFFIDHPGAVPITTNQGEELKKLIGSPIYIECSSKTQQNVKAVFDAAIKVVLQPPKQKKKKKNKNRCVFL

SEQ ID NO: 17896 - protein, 485 aa, Arabidopsis thaliana
MKSFNTEGHNHSTAESGDAYTVSDPTKNVDEDGREKRTGTWLTASAHIITAVIGSGVLSLAWAIAQLGWIAGTSILLIFSFITYFTSTMLADCYRAPDPVTGKRNYTYMDVVRSYLGGRKVQLCGVAQYGNLIGVTVGYTITASISLVAVGKSNCFHDKGHTADCTISNYPYMAVFGIIQVILSQIPNFHKLSFLSIMAAVMSFTYATIGIGLAIATVAGGKVGKTSMTGTAVGVDVTAAQKIWRSFQAVGYIAFAYAYATVLIEIQDTLRSSPAENKAMKRASLVGVSTTTFFYILCGCIGYAAFGNNAPGDFLTDFGFFEPFWLIDFANACIAVHLIGAYQVFAQPIFQFVEKKCNRNYPDNKFITSEYSVNVPFLGKFNISLFRLVWRTAYVVITTVVAMIFPFFNAILGLIGAASFWPLTVYFPVEMHIAQTKIKKYSARWIALKTMCYVCLIVSLLAAAGSIAGLISSVKTYKPFRTMHE

SEQ ID NO: 17897 - protein, 420 aa, Glomerella cingulata
MTTNGSDKPQVQPCRYKVGKTLGAGSYSVVKECVHIDTGRYYAAKVINKRLMAGREHMVRNEIAVLKKVSMGHQNILTLVDYFETMNNLYLVTDLALGGELFDRICRKGSYYESDAADLIRATLSAVAYLHDHGIVHRDLKPENLLFRTPEDNADLLIADFGLSRIMDEEQFHVLTTTCGTPGYMAPEIFKKIGHGKPVDVWALGVITYFLLCGYTPFDRDSDFEEMQAILNADYSFTPFDYWRGVSEHAKDFIRKCLTIDPKKRMTAHEALQHPFVAGYLNGEGEGQNLLPTVKKNFNARRTLHAAIDTVRAINKLREGQQNLMDGAKSREPDRGLKSPPNAKKDDSAISMGNTNHKDSGYGTQPEADNQNDVCHDRCGTTPTSVPASLRVRAVSRTRSLRQAKDCGAVPQCDDSLEAV

SEQ ID NO: 17898 - protein, 241 aa, Enterobacter aerogenes
  misc_feature (8)..(8): Xaa can be any naturally occurring amino acid
VDCCARVXHGPSVAGLHQSVGNGAMSNAITEIDNTDLVFIFGYNPADSHPIVANHVINAKRNGAKIIVCDPRKIETARIADMHIALKNGSNIALLNAIGHVIIEEDLYDKSFVASRSEGFEEYRKIVEGYTPESVEEITGVSAQEIRACARMYASAKSAAILWGMGVTQFYQGVETVRSLTSLAILTGNLGKPSVGVNPVRGQNNVQGACDMGALPDTYPGYQYVKFPENREKFARAWGVD

SEQ ID NO: 17899 - protein, 462 aa, Thymelaea hirsuta
AGVKEYKLTYYTPEYETKDTDILAAFRVTPQPGVPPEEAGAAVAAESSTGTWTTVWTDGLTSLDRYKGRCYHIEPVPGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEIWKEIKFEFQAMDTLD

SEQ ID NO: 17900 - protein, 396 aa, Thiomonas cuprina
MAKSKFERTKPHVNVGTIGHVDHGKTTLTAAITTVLSSKFGGEAKAYDQIDAAPEEKARGITINTAHVEYETANRHYAHVDCPGHADYVKNMITGAAQMDGAILVVSAGDGPMPQTREHILLARQVGVPYIIVFLNKCDMVDDAELLELVEMEVRELLSKYDFPGDDTPIIKGSAKLALEGDKGELGEGAILKLAEALDTYIPTPERAVDGAFLMPVEDVFSISGRGTVVTGRVERGIIKVGEEIEIVGLKPTLKTTCTGVEMFRKLLDQGQAGDNVGILLRGTKREEVERGQVLCKPGSIKPHTHFTAEVYVLSKDEGGRHTPFFNNYRPQFYFRTTDVTGAIELPKDKEMVMPGDNVSITVKLIAPIAMEEGLRFAIREGARTVAGGVVAKIIE

SEQ ID NO: 17901 - protein, 473 aa, Synechococcus elongatus PCC 7942
MPETAQEVLQLIQEKGIQLVDLKFIDMPGIWQHLTLHVSQIDENSFVEGVPFDGSSIRGWKAINESDMTMVPDPTTAWIDPFMKEPTLSMICTIYEPRTNTPYERCPRAIAQKAVDCLKASGIGDTAYFGPEAEFFIFDDVRFDQAENKSYYYVDSIEGRWNSGREEEGGNLGYKPRYKEGYFPVAPTDTSQDMRSEMLLTMADCGVPIEKHHHEVATGGQCELGFRFGKLIEAADWLMTYKYVIKNVGRRYGKTITFMPKLLFNDNGSGMHTHQSIWNDGQPLFAGDQYAGLSQMALWYIGGILKHAPALLALTNPTTNSYKRLVPGFEAPVNLAYSQGNRSASVRIPLSGTNPKAKRLEFRCPDATSNPYLAFAAMLCAGIDGIKNQIDLGEPLDVDIYDLSPEELAKIPSTPGSLKDALKALEADHDFLTVGGVFTEDFIQNWIEYKLDNEVIPISLRPHPYEFALYYDC

SEQ ID NO: 17902 - protein, 496 aa, Pseudomonas sp. VLB120
MNSSLSAIDGLRLPHQMLIGGQWVSAQSGKTLNVYNPATGDILTEVPDGDVEDVNAAVESAAATLRSDTWRPCLPVLASVFCCAWRISSEVHGDELARLETLNNGKLLIYSKLMEVGASAQWLRYMAGWATKLTGSTLDLSLPLPPEVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 17903 - protein, 498 aa, Mycoplasma penetrans HF-2
MKMIKKTKITATLGPSITGKIFTLADFNKPENKGVIETAKKNLAALFDAGVNVVRFNFSHGDYEEQTIRLNLVREVAKEKGVNISTMLDTKGPEIRVYKTSEKEVEIKSDSKVRIYTTKKEIGTSEKFSVLDSTGTYNMAKDVQPGNTIFVDDGKLKLEVISSNVEEGIIETIARNTWILRENKRINLPDSNYSIPFMSDKDRNDIIFAIKNKFDYIAASFVNTGDNVREIKKILKEHGGEHIQIISKIETMTGIKSLDDIIDESDSIMVARGDLGLEVPYYDVPTYEKYIIKDCRHKGKTVIVATQMLDSLETKIQPTRAEVTDVFFAVERGTDCTMLSGETANGMYPINAVEVMAKIDVSSENFFDYGRAIDVYFKETPFMKEKVGTLATTIATLVAPKRVIDNHGFDYSSIVVFGNDTRLIQALSNIRCAAPIFFVTDKKEYATRFGLNYGVFVKVVDNVEHAIANKTEIIDAINSQLPEVKKTVVVINDSIYKH

SEQ ID NO: 17904 - protein, 454 aa, Mycoplasma penetrans HF-2
MKVVVVGINHAGTSAIRTLLSINPNAEVVAFDRNNNISFLGCGIALTVGGVVKNTDDLFYSNPEELKSMGAKVFMNTDVVEVNHEQKYVKVVDLETNEERTESYDKLIYAAGSWPVDLHFKNQDLKNVEICKLYQHALKLIEKANDDDIKKVAVVGAGYIGVELAEAYAEKGKEVALIDFLPRVLGNYYDESFTNKLEESMVQNGVSLHLGQKVSEFVSNSEGAVKQVITDKETIDADLVILCTGFKPNTELLPGLKKIQNGALVVNRKAQTSDPNIYAIGDCAAIFDAATKQYRHVALATNAVKLGIVAASQISGLENVIIPNIVGTNAICVFGLKYASTGVTEEVGARFGLKNLKTCEYFDNDRPEWMNTVEKVKVKLVYEEDTLRLVGAQILSFGESNHTEWIFALALAIQLGLNLFQIAFTDVYFLPHLNKPFNFVLSAILKSLGMKYIK

SEQ ID NO: 17905 - protein, 327 aa, Mycoplasma penetrans HF-2
MKVICFGVREVEKPIFEKYNKYNYQLTLTSSSLSSSNLNLVDGHDAIIVRASDKVDKAVLDYVKQKNIKYVLTRTVGFDHMDIAYGNSIGIKMARVPSYSPTAIAEVAVTMAVMLSRKIAHFSFNAYNKNFVIDSFGFAKELKNSTVGIIGTGKIGLATARMFKGLGSKVIGYDVYQSEEAKQVLNYESLDNLLKESDIISFHIPYIKGENDNFINKDFINKMKDNSILINCARGQIQDEKAILDAILSNKLLGAGLDVLNNEKNYFNKKLDKFEDETINKLISLYPRVLIAPHIGSYTDEAVANMVEFSFDNLNEYVTTNSCKNKI

SEQ ID NO: 17906 - protein, 216 aa, Mycoplasma penetrans HF-2
MEKIIELSVLALDQKDENKFKEQLESCLKNNIKDIHYDIMDNKFVPNTSFNNLEFLDYLIEKGCNVSAHLMVENVAHYVDKLITKKVKYITFHCEAQTIEESISIINTIKKHNIKAGIAIKPNSSLKEYESLIKISDKITVMSVEPGFGGQKYIENSEIRIREIKKLSHKNLIVEIDGGINDQTILLCKDDATHFVTGSFLFNNLEKFEELKKLLD

SEQ ID NO: 17907 - protein, 483 aa, Mycoplasma penetrans HF-2
MLFMKEIKRTLTFDDVLLRPQYSEVLPKETDVRTTLSSRFQMKIPIMSASMDTVTEIEMAYNMSLNGGIGVIHKNLSHSQQSNMIKQIKHIKNGLYYNIMAFESSNKISMIKEKVFDEYLDDCIFVTVNGSIVNIVSKEDLENKKIDSNSTLESIGRKKIIFAKDSSSLEEILKIMDENKLDFMPIVSETTNGIIAVAKRKWLVPYLNSDDPLIDSKERPKVCGAIGVTEDSIERAKLLIAAGVDAIIIDCAHGHSKKVIELTREIKKLFPKLFLIVGNVVTANGVNDLYKAGADAVKIGVGPGAICTTRTVSGVGIPQFSAILECYEEAKKLNIPIIADGGIKNSGDMVKALAAGADAVMLGSLLAGCDESPSVKVMHNNKMYKQYRGMGSIAAMKAGSSDRYGQDGIKKLVAEGVEGLMPYIGPVKESLYQLVGGLKSGMGYVGAKTLTDLKNKAEFVEQTGIGLKESSTHSIVLLSEQSK

SEQ ID NO: 17908 - protein, 250 aa, Mycoplasma penetrans HF-2
MKKLIIANWKMFKTLNDIKTFKEEFDKNIKNVKVNADYSVGVPSIYLNQAKEILKGIKVIAQDAHFKNEGAYTGNISWSQLKDCGIDGSIIGHSERRQMFNETDETVNLKTISLVENNMQAVVCVGETLEEYEANKSFDVVWNQTKKALANVSEAQLKNVVIAYEPVWAIGTGKVPTGKEVDDLIQKVRDELSKLYSKQAVESLVVLYGGSVNDKNAEEFFKQKNINGALVGSFCLKAENFVKLIELGGN

SEQ ID NO: 17909 - protein, 506 aa, Mycoplasma penetrans HF-2
METKMKKGPVLLAVLDGYGFSKDTKGNAILNAKTPFMDNLVKEYDHCYIEASGEYVGLPDGQIGNSEVGHLTIGAGRIVYTGLSLINQDIKTKKFDSNKTLLEAINHAKKNNSNIHIMGLLSPGGVHSNEQHIFEMIRIVSENGLKPVIHVFGDGRDVAPQSIISSLERLNDVLKKYPGTIATISGRFYSMDRDKRWERTKQAYDNLLGISNNYFDNPIDYVNKQYSENIFDEFLVPARINDSNVVIKDNDAVIHANFRPDRARQISHLFCGSTVYEEKNDHPLKNLYYAIMMTYEGITPTSILFPTVVVKNTFGEVVANSGLTQLRIAETEKYAHVTFFFDGGVEVDLKNESKILVDSKKVKTYDEVPAMSAVEITDKLIENLDKFDVIVLNFANADMVGHTGKYNEAVLAIEALDSQLARIDQKIKELNGTMFITADHGNAEVMLDDDNNPVTKHTTNPVIFISNNKDVKFNKPGSLGNVAPTILDFMGLEIPADMDKKSLLKK

SEQ ID NO: 17910 - protein, 450 aa, Mycoplasma penetrans HF-2 [sequence omitted]

SEQ ID NO: 17911 - protein, 461 aa, Mycoplasma penetrans HF-2
MSNSLVKTIDVVTKFLKDKKTDISLIDIENRVLILKKIKEWVIKNTNDIVSALKSDLNKSEIESLISEVSVVLKQTNYYIKNLHKFYKNKKAKNIPFLGLKSKGFYTYKPMGTVFMINPFNYPFQLALIPLVTAIASGNFVIMKNSEKANNTSRLILKMIQEININNLVCFLDEKVSKDFIFDVIDSKPDLIFFTGSKSFGYELKKQAIANEIKIILELGSANPVIVDETADIELAARRIVWAKLMNMGQTCVAPNSIFCDEKIHDKLVEAINAELTTQYNTNKFDFVKIVDVQHLVNVANMVKSFTDIDLEKDEENLRIKPTLIQVENNNQILFQEIFAPVLFITSFKNLTDFCADYKDKITDCLALYLFSNNEYNIKNVSNSFSYGGMGVNELLLQVSNIYLPFGGIKTSGIGKYHGNFGLMEFSNLVSVLRGSKKEVNYRYFHKISKYKSLIKFLVKR

SEQ ID NO: 17912 - protein, 462 aa, Mycoplasma penetrans HF-2
MNNLFSIFDLQKNFYMSSNEMSYKNLLSKLIHFNEVFKKYEKELYKVIGESYDQPLWDIYHTEIKPVIREVKYFIKRIKIFRKAKLLKNNFIDNLFKQNTTYRQPYGSCLFLLNQSMPISKTFILLIGALVCGNSLFVKLPTFTVDVNRIIKCIFKEVFNDNYIYFIDENISENDLKNVYDFNFDLVYYNGNTANAKTIQRIFAPRLTKIVLDINNKNPVILDETANLELAAKKIIWSKMLLGGQTSHSPDFLIIHESIFQSFIKILKTEYDSQFGKGEKIDKITRIDTNQNYENITSILNKSLSKNRIIFGGLTDNNQRKIELTLVQVDDLKSALLSQDINSPILPVVIFNSFSDINGIVEHSDTPSCIYFFSKNKKRINSLLKQIESRFFCINNISIPWFKGLPFGGIKNSGTHLYSKRDTVKAFTYKKIIIKEFWDSKEKYLNNTEKNNKIKEKIEKMN

SEQ ID NO: 17913 - protein, 308 aa, Mycoplasma penetrans HF-2
MKMNKYKNQIGLIGLNDSSECLLRNLTRNCFSVLTYDLNKSKYEELKKEGFTCFDSLEKFVNYFLGEKIVLLTGNWNRQTNNIFLDLINMLNMDSIIIDLTDSSHDVVVSNYQKAKNKNIEYVDASIIGTLDDITWGFSLAISGKENTVRYLQNVLKNTLSHETNFFFSGAIGSAHFLKMIHDSIQNSYANSILEGLDLMRKSQFDFNFKQVLNFFENGNSLIQSRILSLLNKADVSKEKDNYLLTDDVVNLNSVQNYIKHCMENKIYSQTNSSSNFSILKLKDLDDDFKKMLFKNLVFEIKNVEEDE

SEQ ID NO: 17914 - protein, 476 aa, Mycoplasma penetrans HF-2
MKFKKLEKFPEGFLWGASSSAYQIEGAWDEDGKGMSTQDLPKQNVDGWVDWSKITDFKVASDQYHRYKEDIALMAEMGFKAYRFSIAWTRIIPDGNGAINKKGIQHYHDVIDELLKHGIEPVITMYHFDLPLALEQQGGWTNRDLIVPAFVKYAKVLFKEYGHKVKYWLTINEQNMVAMVGDILGMVSSDPKNRWKHMANLNHNMLLAQSYAFIYLHKMCPNAKIGPAPNICVYYPKSCNPEDFTAAKNAQSLLHWYYLDIAVRGKYNNIVWKFLKDNDALPEIRKDDFKVFKAGKPDFIAFNYYASGTAEKDEGDAVITHGDQHSMFDVPGLYKGAENEYLGKTNYGWAKDPIGFRNTFRELYDRYQLPLLVTENGLGTQDTLTADEKIHDDYRIEYLENHIKEMRNAISDGVEILGYCPWSAVDLVSTHQGITKRYGFVYVNRDEFDLKDLRRIRKDSFYWYQNVIKNNGNNIE

SEQ ID NO: 17915 - protein, 477 aa, Mycoplasma penetrans HF-2
MKIKKLNQFPKNFLWGASSSAFQVEGAWNEDGKGLSIQDVPKKDIAGWIDRSKVSDYKVASDQYHRYKEDFALMAEMGFKAYRFSIAWTRILPDGVGKVNPLGIKHYHDVIDELLKHNIEPIITLFHFDMPYALEQQGGWSNRDLIVDAFVNYAKILFKEYGHKVKYWLTINEQNMLAMVGDLFGLTNSQESSNRWQNISKINHNILIAQAKVINELHLTNKNAKIGPAPNIAIYYPKTCHPEDVLASKNAQALMHWYYLDVAVRGQYNNIVWKFLEQENALPEFRKDDEQIFKNGKPDFIAFNYYTSGTVEKALDVAVTTRGDQQNMFDVPGMYKATSNDFLNKTKFNWTIDPVGLRTTYRELYDRYQLPLLVTENGLGSPDELTKDFKVHDDYRIEYLKAHILETRKAISDGIPIIGYCPWSAIDLVSGYQGVNKRYGFVYVNRDEFDLKDLRRIRKDSFYWYQEVIKNNGNNIE

SEQ ID NO: 17916 - protein, 429 aa, Mycoplasma penetrans HF-2
MIKLNFTNFLEGNKSTEKIFKSYASKIETLNNSIEEKKCKGASMLGWMDYPSKYNKNEIKELINVSQEWYNNKKIKNVVVLGIGGSYIGVRAGIDWVLPEFNREKEIYYVSSMSSSYVYSLIEKLKKEDFYLIVISKSGTTLEIGVAFRLFYSLLFEKFGSEGAKERTVAITDKEKGTLRKIADTQDIQTFSIPDDVGGRFSAITPVGLFAMGVMGLDVNKVLKGCAKAIEDTKEPDIEKNTAYQYAALRHYMYSKKEKYNEVFCVYEDALRFFTEHLKQLFAESEGKEGKGLLPVNCLFTTDLHSVGQFLQEGNQIFFETCISIKNPLNDVVINEFLKDEDGLGFLNGKKLDYINKVAASSTIDAHHIDGKIDIIQINLDNRNEESFGYLYSWFSKVVAMSGLLLKVNPFDQPGVEAYKSRMFTKLKK

SEQ ID NO: 17917 - protein, 478 aa, Mycoplasma penetrans HF-2
MENTFYKGSAYINGKFVDSEKTIPVISTIDGSTIGSVAALSKKDIDMAFEGAHLAFNLWRNLTPEMRIKKIKEFAEYFIAEKEFLATLMSYEIGKSYNDALKEVERSYENIFETIEVYEKEFVNPSVIGPEVNKIKGKTGYFYNVPVGVVLAIAPFNYPINLGLAKIIPTLLVGNTIVFKPATQGSLVSSQLAKYFDQANFIAGVFNLVTGKGSEIGDYILENKRIQGATFTGSSDIGFKLASKLPMKPLVLELGGKDAAIVTNNADVELAAKEIIKGAFGYSGQRCTAIKRVLVTKEIADDLLIHLIKEAQKLKVGNPLNNPDITPLIDRKAVDFNIDLIDDAINHGANLVYGGNIEGYNLLRHTILDNVSTKSKLAWEEPFGPVLPIIRVSTINEAIAIANASEYGLQGSVFTKDLEEARTIAKYLDTGTVNINRGSSRGPDIFPFIGIKKSGFGVQGIRDSLKAMTRVKGIVENE

SEQ ID NO: 17918 - protein, 463 aa, Mycoplasma penetrans HF-2
MKKYDLVIIGSGPGGYVAAEHAAKHGLKTLCVEAKDFGGVCLNKGCIPTKALLNTSKIKQYVLKAEEFGVTGINIDNITLDWPKVIERKNSVVKKLQMGVQGLLKTAKADMLKGEAKIVDQNTISVNEELINFDNLIIATGSSPRKFNLPGFAQGYEEGKILTSDEVLNLPRIPDKFTVIGGGVIGIEFAILFAELGSKVTILQGVDRILEILDKDISAEVTKLLLSKGVTIHTDVQIQKYENGQVYYTKDGTEQSEDFDYCLVSVGRTPSTEIARNLPIEFAPNGSIITNDKMQTSIKHIYAIGDCTSKVMLAHSAYKNAVVAVDTILNKPSKMDLLKIPSCIYTHPQVATVGYTEEQLKEKNIPYYAAKYPFMHLGKALADGKTVGFIKILVSQDCGEILGCHIVGEQASNYISEIALAMENESTIYTLSQTIHPHPTYAEIIWEVARKIIIENFSDKDWG

SEQ ID NO: 17919 - protein, 164 aa, Mycoplasma penetrans HF-2
MFKMSDFYKFKVNKINGKEIELSEYKNKVVLVVNVASKCGFVKQYENLENMYQKYKDQGLVILGFPCNQFFFQEPKTNQEILSFCTTKYNVTFDMFEKINVNGKEANPLYTWLKEQMPWTARAKNVKWNFEKFLLDKNGNVKYRFESKKIPEEFEQEVVNLINE

SEQ ID NO: 17920 - protein, 343 aa, Mycoplasma penetrans HF-2
MEYIKLGNSDLKVSRICLGCMGFGDNKSGVHKWILDYQQTKEIIKLALDKGINFFDTAPVYAEGTSEEFLGRAIQELTKRENVVIATKFFPRSREAYEKGITGQQWVQQNLEQSLKRLNTDYVDLYILHLWDYNTPIEDILEGLNNAVKSKKVRAIGISNCYAWQLQKANDIAKANGWSQFVSIQGHYNLIFREEEREMIPFCEENNVALTPYSVLASGRLVKESNETSARLESDYIAKLKYDSSKEVDEIIINRVKELAKKKGLSNTQIALGWLLNKGVHSPIIGATKIKHIEEAVSAVGIKLSEEEIAYLSDPYVPHKLVGVMGNNKKGQFFDMTLKNNKK

SEQ ID NO: 17921 - protein, 362 aa, Mycoplasma penetrans HF-2
MYFNCLKGICMIDITKRITTKGKALFSKDGKIEDFTFERRALNDDDILIKIKYCGICHSDIHHGRSEWGKANYPTVMGHEIVGEVVATGNKVSKFKVGDNAGIGCMVNSCGNCDSCKVSEEQYCNDMVVTYGGLDKFNNNEMTYGGYSNYYVVKESFAIKVPQNVPLEYIAPLFCAGITTYSPIVFSKVKKGDKVAIAGFGGLGVMAVKYAKFLGADVYVIARNNKKEEEAKKLGVKKLYPSVESVDEKFDLIISTIPTKYEVMDYVNLLKVGGELALLGLPPVEEGWSLYPGNLIFKGHRKVYGSIIGGIKATQEMLDFSIKHNIYPEIEVISADQINEAFEKMTTGKAKFRYVIDMSTLK

SEQ ID NO: 17922 - protein, 183 aa, Mycoplasma penetrans HF-2
MYQDCFAKILFSYEEIKDVIKKLSFELNAYYKSFENSDVVVIPILDSSVIFAGHLLPLLDFSTIFKTVKMTFLGHKSVSKNSNIKVIANFDPLEIKGHKILILDTIIDTGVRLQKVCDFIKNCDVEEIKTCTLFNKISDYKDKYKPDWIGTNIPNEWVAGFGLDSRDKYRNFKHLGVVKIEKR

SEQ ID NO: 17923 - protein, 471 aa, Mycoplasma penetrans HF-2
MEYNKKIVTDLTDLKGKKVILRCDFNVPINKTSGEITDYTRIDAALQTINYLLDKGVKLIVLSHLSRVKTLEDISSGKKSLKVVHKALKNRLLGKTVLFEENNRNKDLPKIIDGMEEGSLLLLENTRYADVNEKGEVVKLESKNDPSLGKFWASLADIFVNDAFGTSHRAHASNVGIAKNIKESAIGFLVNKELAKLSKAVVNPRKPVVAIFGGAKVSDKVPSIKNIGKFADKILIGGGMAFIFLKAKGFEIGKSLYEDDQLELTKELLSEFGNKIVLPVDAVVADSIKAAKGKRYDMEQFPADLAGFDVGKKTIKLFKKELKLAETVIWNGPLGVFENDAFNKGTLKVCKYIAKITAKKGCYSVIGGGDSAAAAAKCGVTHSFSHISTGGGASLEFFSGVELPGVACIKNKGEEGKVEAVKEKTTTTTESASKEKSSTAKTASKPATSKTTAAKKPAEKKPAAKKPAAKK

SEQ ID NO: 17924 - protein, 346 aa, Mycoplasma penetrans HF-2
MKKNLFDSFKIGNVEIKNRIVMPPMCMHTAKNGEVNDFHILHYGSRSIGGVGLIIVEATSVQQHYGNITDQDLGIWDDSFIFGLSKIATAIHKFGAKAAIQLGHAGRKCESKYVDKIYGPSPIKFESKYVNYLTPTEMTIKEIQEVKQHFIDAAIRAKKAGFDMVEIHAAHGYLLSSFLTPISNQRDDVYGQNKALLLEEILTGIKKANGSDYPIIVRISAYDWHPNGNKPQDFIEMLNPLIKQSLIDAIDVSTGGTTEDAKITAYDCYQIPFCLEIKQNVNVPCIGGGLIVDAKSANKIVENEAADAVYIGRQLLRNPYWPIQASEDLNIDIKFPKQYERAKLVK

SEQ ID NO: 17925 - protein, 215 aa, Mycoplasma penetrans HF-2
MKLVLLGAPGCGKGTISDYLVKNYGLVHLSTGDIFRQTIDQKGPYWEELKSYISKGLLVPDELTNKILKNALDKNMDKSFILDGCIRTIAQADFLSTILDIDLALYLEVPFDVLEKRLTGRRICSKCKRIYNIHYSAPKKEDICDDDGEFLIQRKDDQKEIIDERMKVYRTNSEPLIKYYEKLNKLVAINSENLDDLEKNIDDLFINKFNLRKIA

SEQ ID NO: 17926 - protein, 177 aa, Mycoplasma penetrans HF-2
MDHRVEKILLTTEEIQKGIIEAAKWVDKTYQNKELVLVGLLKGCLPFFGQMISHITIDCLVDFMTVSSFQGKTYGVTEPQISHNISENITNKHVLLVDEIIDSALTLKYVKEYLMNNFNPASVEIITLLDKPAGRKVDLKPAYRCFEIENKFVVGYGCDYEGKLRNLPYVGVFKQDK

SEQ ID NO: 17927 - protein, 505 aa, Xanthobacter autotrophicus
MNKPEIAITKQSPFKARYGNFIGGKFVEPVGGRYFDNTSPVTGGKICEIARSDADDIEKALDAAHAAKDAWGKTSAAVRALILNRIADRMEENLDLLALAETWDNGKPIRETTAADMPLAIDHFRYFAGAVRAQEGGISEIDHDTVAYHFHEPLGVVGQIIPWNFPILMAVWKLAPALAAGNCVVLKPAEQTPASILVLAELIADLLPPGVLNIVNGFGLEAGKPLASSSRIAKIAFTGETTTGRLIMQYASQNLIPVTLELGGKSPNIFFADVVAEDDDFFDKAVEGFVMFALNQGEVCTCPSRALIQESIYDRFMEKALKRVAAIVQGSPLDPATMIGAQASSEQLEKILSYIDIGKQEGAEVLIGGERNTFGGDLAGGYYVKPTVFKGHNKMRIFQEEIFGPVVSVTTFTDDAEALHIANDTLYGLGAGVWTRDGNRAYRFGRAIQAGRVWTNCYHAYPAHAAFGGYKQSGIGRENHKMMLDHYQQTKNMLVSYSPKKLGFF

SEQ ID NO: 17928 - protein, 506 aa, Xanthobacter autotrophicus
MNSPAFLSSAHTSPFKPRYGNFIGGTFVEPVSGRYFENTSPITGKVICEVPRSDEHDIERALDAAHAAKKAWGRTSAADRALVLLKIADRLEANLELLAGAETWDNGKPIRETTLADIPLAIDHFRYFAACVRAQEGTLGEIDHDTIAYHYHVPLGVVGQIIPWNFPILMAAWKLAPALGAGNCVVLKPAEQTPASILVLAELIADLLPPGVLNIVNGFGLEAGKPLASSPRISKIAFTGETGTGRLIMGYAAQNLIPVTLELGGKSPNIFFADVAAEDDDFLDKAVEGFVMFALNQGEVCTCPSRALVQESIFDKFMEKALARVAAIKQGSPLDPSTMIGAQASSEQMHKILSYIDIGRAEGAQVLAGGERNVLTGELADGFYVKPTVFLGKNNMRIFQEEIFGPVVSVTTFKDEEEALHIANDTLFGLGAGLWTRDGSRAYRVGREIEAGRVWTNCYHAYPAHAAFGGYKQSGIGRETHKMMLDHYQQTKNLLVSYSPKKLGFF

SEQ ID NO: 17929 - protein, 350 aa, Glycine max
MSFLRSFARNKDISKVGRRGIHCMQKLCAEKISPDSLEKAQNRVIDAALTLVRENTGLRKNLCHSLGGAVATSTLLGVPLGHNSSFLEGPAFAPPFIREGIWCGSANSTTEEGKDLKDLRIMVDVGDIPIQEMRDCGIGDERLMKVVSDSVKLVMEEDPLRPLILGGDPSISYPVVRAISEKLGGPVDVLHFDAHPDLYDEFEGNYYSHASSFARIMEGGYARRLLQVGIRSINKEGREQAKKFGVEQFEMRHFSKDRPFLENLNLGEGAKGVYISIDVDCLDPGYAVGVSHYESGGLSFRDVMNMLQNLKGDIVGGDVVEYNPQREPPDRMTAMVAAKFVRELAAKMSK

SEQ ID NO: 17930 - protein, 1501 aa, Candida albicans
MAKTSQAEGQPYKGYYNNKSQGQPYHGYYSGFNKSASAQIHHLARSLTQGVQSHYDDTYTTATMHPNGINPISDKTDPTLDPESPSFSSKRWVQNMWKLYQSDSEYYKPGKLGVAYKNLRVYGDAIESDYQTTVSNGVLKYARNIFNKFRKDNDDYSFDILKPMEGLIKPGEVTVVLGRPGAGCSTFLKTIACRTEGFHVADGSVISYDGITQDEIRNHLRGEVVYCAETETHFPNLTVGETLEFAALMKTPQNRPMGVSREEYAKHVVDVVMATYGLSHTKNTKVGNDFIRGISGGERKRLSIAEVTLVQASIQCWDNSTRGLDAATALEFISSLKTSASILNDTPLIAIYQCSQNAYDLFDKVIVMYEGYQIFFGSSQRAAAYFKKMGFVCQDRQTTPDFLTSITSPAERIIKPGYERLVPRTPKEFYRYWRRSPERQALLEEIDEYLDNCENYDQKQKIFEANNAKKAKHTYNKSSYTVSLPMQVRYIMKRYWDRMRGDIIVPLSTVAGNIAMALILSSVFYNLQPNSSSFYYRTSVMYYALLFNAYSSVLEIYNMYEGRAIVQKHREYALYPPMADAIGSIISDFPLKVVCSVLFNLILYFMVNFKREPGAFFFYLLISFCSTLFMSHLFRTIGAFTNSLAEAMTPSSLLLFALSTFSGFAIPVTYMLGWCKWIRWVNPLAYAYEALISNEFHGRVFDCSNIVPSGFGYPKTGNSVVCASIGALPGEFKVDGDLYLKLAFDYSYSNVWRNFGVLMAFIIFLFGTTIFFVQTNKSSISKGETLVFRRKNIRKMRKMEEDEEAYMDGMAPLDFSGSTEISDYSYDYMDRKLLDTSNIFHWRNLTYTVKIKSEERVILNNIDGWVKPGEVTALMGASGAGKTTLLNALSERLTTGVITSGTRMVNGGELDSSFQRSIGYVQQQDLHLETSTVREALKFSARLRQPNSVSIAEKDSYVEKIIDLLEMRTYVDAIVGVPGEGLNVEQRKRLTIAVELVARPKLLVFLDEPTSGLDSQTAWSICKLIRKLANHGQAILCTIHQPSAILLEEFDRLLLLQKGETVYFGEFGANCHTLIEYFERNGASKCPQHANPAEWMLGVIGAAPGTQANQDYFETWRNSPEYRAVQNELHRLEEMPGLASGEKEPDTNQAYAASFWKQYIFVVHRLFQQYWRTPSYIYSKFAMAVLCSLFNGFTYYKSQNSMQGLKNQMLSIFSMFVVLTTLAQQYVPLFVTQRDLYEARERPSKTFSWLAFIAAQITAEIPYQVLAATISFFSWYYPVGLYRNAVYSGAVTHRGVLMWLIMTLMFIYSSTLAQFCISWNQLADYAANWISLLLTISMIFCGVIATKDSMPKFWVFLYRCTPLTYLTSAMMSIGLGDSFVKCAPTEILTFPPQTPGVQKCQDYMGAYISIAGGYLLNPEATDNCKFCIMDKTNQFLDFMNISIHNFGRDTGIFIVFIVFNMAATVFSYWLFRVPKGNREKGSFFDKLPFLNGGGDTNHENV

SEQ ID NO: 17931 - protein, 445 aa, Streptomyces coelicolor A3(2)
MSSTRTASGRTSGRNGTWRNWGGNVSARPAREVTPASVDELADAVRRAAEDGQRVKAVGTGHSFTSIAATDGVLIRPQLLTGIRSIDRDAMTVTVEAGTPLKRLNMALAREGLSLTNMGDIMEQTVSGATSTGTHGTGRDSASIAAQIRGLELVTADGSVLTCSADENPEVFAAARIGLGALGVVTAITFAVEPVFLLTAREEPMPFDRVLADFDALWSENEHFEFYWFPHTNSTNTKRNNRSAGPERPVGRFQGWLDDEFLSNGLFQAVNWVGRAAPATIPSIARISSRALSARTYTDTPYKVFTSPRRVRFVEMEYAVPREAVVEVLRELRTMVDRSRLRISFPVEVRTAPADDITLSTASARDSAYIAVHMFRGTPYQAYFTAAERIFTAHEGRPHWGKVHTRDAGYFSRVYPRFGEFTALRDRLDPDRLFQNDYLRRVLGP

SEQ ID NO: 17932 - protein, 469 aa, Prosthecochloris vibrioformis
MQQSESSSAQFDVAVIGSGPGGYEAALHAARHGMKVCLVEKRSLGGVCVNWGCIPTKALLRSAEVYDLAKNPSEFGVNVSELSFDLAQAVKRSRKVSLKSSKGVEFMLKKAKVEVWRGEAVLTGSKGVKVTAEDGSERSLEAANIIVATGAQPRVIPGLEPDGKKIITSREALILKDVPESMIVVGGGAIGVEMAWFYAKAGAKVTIVELMPRLLPAEEAEVSEALKRSFEKVDITVQCGAKLGNVAISEFGVNADLLAEGKEPQKIEASCMLVAVGVTGVIDGLGLDAAGIETERGFIRTDELCRTSASGIYAIGDVRGGMLLAHKASAEAAIAVEAIAGKLPEPLSEPLIPRCVYAQPSVASVGLTEEAAIAAGYKVLVGRSQFAASGKANAYGQLEGFVKLVFNAETGKMLGGHLIGHDAVELIGELGLACRYGVTAEGLVGTVHAHPTLSETVREAAFSALPNKG

SEQ ID NO: 17933 - protein, 507 aa, Candida tropicalis
MIEQVLHYWYYVLPAFIIFHWIVSAIHTNSLRRKLGAKPFTHTQLDGFYGFKFGRDFLKAKRIGRQVDLINSRFPDDIDTFSSYTFGNHVIFTRDPENIKALLATQFNDFSLGGRIKFFKPLLGYGIFTLDGEGWKHSRAMLRPQFAREQLPMSPSLEPHFNVKAYPQEQRWVFDIQELFFRFTVDSATEFLFGESVNSLKSASIGCDEETELEERKKFAEAFNKAQEYISTRVALQQLYWFVNNSEFKECNEIVHKFTNYYVQKALDATPEELEKQSGYVFLYELVKQTRDPNVLRDHHSISLLAGRDTTAGLLSFAVFELARNPHIWAKLREDVESQFGLGEESRIEEITFESLKRCEYLKAVMNETLRLHPSVPRNARFALKDTTLPRGGGPDGKDPILVRKMSCSIFISGTQIDPKHYGKDAKLFRPERWFESSTRNLGWAYLPFNGGPRICLGQQFALTEAGYILVRLAQSFDTLELKPDTEYLTKISHLTMCLFGAFVKMD

SEQ ID NO: 17934 - protein, 286 aa, Hordeum vulgare subsp. vulgare
MAKDIEAAPQGGEFSSKDYSDPPPAPIVDFEELTKWSLYRAVIAEFVATLLFLYITVATVIGYKHQSDPTVNTTDAACSGVGTLGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLAPLPIGFAVFMVHLATIPITGTGINPARSLGAAVIYNTDKAWDDQWIFWVGPLIGAAIAAAYHQYVLRASAAKLGSYRSN

SEQ ID NO: 17935 - protein, 398 aa, Aspergillus fumigatus
MKSTSLLTASVLLGSASAAVHKLKLNKVPLDEQLYTHNIDAHVRALGQKYMGIRPNVHQELLEENSLNDMSRHDVLVDNFLNAQYFSEISLGTPPQKFKVVLDTGSSNLWVPGSDCSSIACFLHNKYDSSASSTYKANGTEFAIKYGSGELSGFVSQDTLQIGDLKVVKQDFAEATNEPGLAFAFGRFDGILGLGYDTISVNKIVPPFYNMLDQGLLDEPVFAFYLGDTNKEGDNSEASFGGVDKNHYTGELTKIPLRRKAYWEVDFDAIALGDNVAELENTGIILDTGTSLIALPSTLADLLNKEIGAKKGFTGQYSIECDKRDSLPDLTFTLAGHNFTIGPYDYTLEVQGSCISSFMGMDFPEPVGPLAILGDAFLRKWYSVYDLGNNAVGLAKAK

SEQ ID NO: 17936 - protein, 178 aa, Zantedeschia aethiopica
MASSMMVSTAAVSRTSPAQSNMVVPFAGLHSSAAFPVTRKFADSSKLPSNGLRVRCMQVWPPEGKKKFETLSYLPPLTREQLGQEVDYLIRNGWIPCIEFCKVGFVYREYHNSPGYYDGRYWTMWKLPMFGCTDSSQVLKEVDECSKAYPDYFNRIIGFDNTRQVQCISFLTYKPEGN

SEQ ID NO: 17937 - protein, 506 aa, Candida tropicalis
MSLTETTATFIYNYWYIIFHLYFYTTSKIIKYHHTTYLMIKFKASPPLNYINKGFFGIQATFTELKHLICHTSIDYAIDQFNNVPFPHVHTFVTKVLGNELIMTKDPENIKVLLRFPVFDKFDYGTRSSAVQPSLGMGIFTLEGENWKATRSVLRNMFDRKSIDKVHDFEPHFKTLQKRIDGKVGYFDIQQEFLKLGLELSIEFIFGQVVSEDVPHYDDFTQAWDRCQDYMMLRLLLGDFYWMANDWRYKQSNQIVQAFCDYLVQKSLENTCNDKFVFVHQLAKHTTNKTFIRDQALSLIMASRDTTAELMAFTILELSRKSHHLGKLREEIDANFGLESPDLLTFDSLRKFKYVQAILNETLRMYPGVPRNMKTAKCTTTLPKGGGPDGQDPILVKKGQSVGFISIATHLDPVLNFGSDAHVFRPDRWFDSSMKNLGCKYLPFNAGPRTCLGQQYTLIEASYLLVRLAQTYETVESHPDSVYPPRKKALINMCAADGVDVKFHRL

SEQ ID NO: 17938 - protein, 505 aa, Candida tropicalis
MYQLFCFLAGIIVVYKAAQYYKRRTLVTKFHCKPARISPNKSWLEYLGIASVVHADEMIRKGGLYSEIDGRFKSLDVSTFKSITLGKTTYVTKDIENIRHILSATEMNSWNLGARPIALRPFIGDGIFASEGQSWKHSRIMLRPVFAKEHVKQITSMEPYVQLLIKIIKNHEGEPLEFQTLAHLFTIDYSTDFLLGESCDSLKDFLGEESNSTLDTSLRLAFASQFNKTQQQMTIRFMLGKLAFLMYPKSFQYSIQMQKDFVDVYIDRVVGMSEEELNNHPKSYVLLYQLARQTKNRDILQDELMSILLAGRDTTASLLTFLFFELSHHPEVFNKLKEEIERHFPDVESVTFGTIQRCDYLQWCINETMRLHPSVPFNFRTAANDTVIPRGGGKSCTDPILVHKGEQVLFSFYSVNREEKYFGTNTDKFAPERWSESLRRTEFIPFSAGPRACLGQQLPRVEASYVTIRLLQTFHGLHNASKQYPPNRVVAATMRLTDGCNVCFI

SEQ ID NO: 17939 - protein, 287 aa, Lactobacillus rhamnosus
NSGIKITADEDAEKLMYQAAHYETVASALVVKMGHEINPEFKIGCMMAMGPTYPATPAPQDVMKAERTMQAGYWLADIQCKGKYPNWLKRYFERHHFALDITEADLNILAVGTVDYIGFSYYASHVTKTTDNEPDDYMTPGQNPEVKNPALERSDWGWEIDPVGLRYALNWFSDRYDLPLFIVENGLGAFDKKDADGKIHDDYRIDYLRKHIEQMELAVDVDGVQLMGYTPWGFIDLVSAGTGQMDKRYGLIYVDKNDAGVGTLKREKKLSFDWFKKVIATNGADLS

SEQ ID NO: 17940 - protein, 475 aa, Liquidambar styraciflua
MSPQTETKASVGFKAGVKDYKLTYYTPEYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 17941 - protein, 475 aa, Magnolia acuminata
MSPKTETKASVGFKAGVKEYKLTYYTPEYETKDTDILAAFRVTPQPGVPPEEAGAAVAAESSTGTWTTVWTDGLTSLDRYKGRCYHIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTTLAHYCRDNGLLLHIHRAMHAVIDRQKNHGIHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLASQGNEIIREASKWSPELAAACEVWKEIKFEFKAVDTL

SEQ ID NO: 17942 - protein, 475 aa, Quercus rubra
MSPQTETKASVGFKAGVKDYKLTYHTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 17943 - protein, 164 aa, Euphorbia esula
MSADIEYRCFVGGLAWATTDQSLQEAFSPYGEILDSKIINDRETGRSRGFGFVTFNNEKSMRDAIQGMNSQELDGRNITVNEAQSRGSGGGGGGGGYSRGGGGGGYGGGGRREGGYGGGGGGYNSRSSGGGGGYGGGRDQGYGGGGGGSRYSRGGGESDGNWKN

SEQ ID NO: 17944 - protein, 258 aa, Streptomyces coelicolor A3(2)
MTEVSVAKEDKAATGELVVLKSVNKHFGALHVLQDIDLTIQRGEVVVVIGPSGSGKSTLCRTINRLETVDDGSITIDGKPLPAEGKELARLRADVGMVFQSFNLFAHKTVLENVTLGQVKVRKVDAKKAEEKARALLDRVGVGAQADKYPAQLSGGQQQRVAIARALAMDPKVMLFDEPTSALDPEMINEVLEVMKQLAEDGMTMIVVTHEMGFARSAANRVVFMADGRIVEEATPDQFFSNPRSDRAKDFLSKILHH

SEQ ID NO: 17945 - protein, 266 aa, Gossypium robinsonii
LSVEEIEVAPPQKNEVRVKIHFTSLCHTDVYFWEAKGQNPLFPRILGHEAGGVVESVGEGVMDVQPGDHVLPIFTGECKECPHCLSEASNMCDLLRINTERGGMLHDGQTRFSKDGKPIYHFLGTSTFSEYTVVHVGQIAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 17946 - protein, 266 aa, Gossypium raimondii
LSVEEIEVAPPQKNEVRVKIHFTSLCHTDVYFWEAKGQNPLFPRILGHEAGGVVESVGEGVMDVQPGDHVLPIFTGECKECPHCLSEASNMCDILRINTEWGGMLHDGHTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 17947 - protein, 265 aa, Gossypium hirsutum
LSVKEIEVAPPQKNEVRVKIHFTSLCHTDVYFWEAKGQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPIQELIAEMTGGVDCSIECTGSTQAMVSAFECVHD

SEQ ID NO: 17948 - protein, 266 aa, Gossypium barbadense
LSVEEIEVAPPQKNEVRVKIHFTSLCHTDVYFWEAKGQNPLFPRILGHEAEGVVESVGEGVIDVQPGDHVLPIFTGECKECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 17949 - protein, 266 aa, Gossypium tomentosum
LSVEEIEVAPPQKNEVRVKIHFTSLCHTDVYFWEAKGQNPLFPRILGHEAGGVVESVGKGVIDVQPGDHVLPIFIGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPVQEVIAEMTGGGVDCSIECTGSTQAMVSAFECVHD

SEQ ID NO: 17950 - protein, 266 aa, Gossypium mustelinum
LSVEEIEVAPPQKNEVRVKIHFTSLCHTDVYFWEAKGQNPLFPRILGHEAGGVVESVGEGVMDVQPGDHVLPIFTGECKERPHCLSEASNMCDLLRINTERGGMLHDGHTRFSKDGKPIYHFLGTSTFSEYTVVHVGQVAKINPEAPLDKVCVLSCEMSTGIGATVNVAKPKKGGSVAVFGLGAVGLAAAEGARVCEASRIIGIDLNPNRFEEAKKFGCTEFVNPKDHNKHVQEVIAEMTGGGVDCSIKCTGSTQAMVSAFECVHD

SEQ ID NO: 17951 - protein, 266 aa, Gossypium darwinii
LSVEEIEVAPPQKNEVRVKIHFTSLCHTDVYFWEAKGQNPLFPRILGHEAGGVVESVGEGVIDVQPGDHVLPIFTGECKECPHCLSEASNMCDLLRINTERGGMLHDGHTRFSKDGKPIYHFLGTSTFSEYTVVHVGQVAKINPEAPLDKVYVLSCGMSTGFGATVNVAKPKKGGSVAIFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 17952 - protein, 266 aa, Gossypium hirsutum
LSVEEIEVAPPQKNEVRVKIHFTSLCHTDVYFWEAKGQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 17953 - protein, 266 aa, Gossypium tomentosum
LSVEEIEVAPPQKNEVRVKIHFTSLCHTDVYFWEAKGQNPLFPRILGHEAGGVVESVGEGVMDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 17954 - protein, 266 aa, Gossypium mustelinum
LSVEEIEVAPPQKNEVRVKIHFTSLCHTDVYFWEAKGQNPLFPRILGHEAGGVVESVGEGVTDVQPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 17955 - protein, 272 aa, Gossypium barbadense
LSVEEIEVAPPQKNEVRVKIHFTSLCHTDVYFWEAKGQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMTYSSSLLAGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 17956 - protein, 272 aa, Gossypium darwinii
LSVEEIEVAPPQKNEVRVKIHFTSLCHTDVYFWEAKGQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMTYSSSLLAGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAVVSAFECVHD

SEQ ID NO: 17957 - protein, 465 aa, Eschscholzia californica
  misc_feature (75)..(75): Xaa can be any naturally occurring amino acid
  misc_feature (123)..(123): Xaa can be any naturally occurring amino acid
VGFKAGVKDYKLTYYTPEYETKDTDILAAFRVTPQPGVPAEEAGAAVAAESSTGTWTTVWTDGLTSLDRYKGRCXQIEPVAGEDNQYICYVAYPLDLFEEGSVTNMFTSIVGNVFGFKALRAXRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 17958 - protein, 465 aa, Glaucium flavum
  misc_feature (123)..(123): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYHIEPVAGEDNQYICYVAYPLDLFEEGSVTNMFTSIVGNVFGFKALRAXRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIRAACKWSPELAAACEVWKEIKFEFEAMDTL

SEQ ID NO: 17959 - protein, 465 aa, Hunnemannia fumariifolia
VGFKAGVKDYKLTYYTPEYETKDTDILAAFRVTPQPGVPAEEAGAAVAAESSTGTWTTVWTDGLTSLDRYKGRCYQIEPVAGEDNQYICYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCTEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 17960 - protein, 465 aa, Macleaya cordata
  misc_feature (45)..(45): Xaa can be any naturally occurring amino acid
VGFKAGVKDYKLTYYTPDYETKDTDILAAFRVTPQPGVPPEEAGXAVAAESSTGTWTTVWTDGLTSLDRYKGRCYHIEPVAGEDNQYICYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 17961 - protein, 465 aa, Stylophorum diphyllum
  misc_feature (392)..(392): Xaa can be any naturally occurring amino acid
  misc_feature (401)..(401): Xaa can be any naturally occurring amino acid
  misc_feature (407)..(407): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYDIEPVAGEENQYICYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQXGGGTLGHPXGNAPGXVANRVALEACVQARNEGRDLAREGNEIIREACKWSPELAAACEVWKEIKFEFEAMDTL

SEQ ID NO: 17962 - protein, 393 aa, Borrelia burgdorferi B31
MSIKTVKDFSSFAGKRALVRCDFNVPLKEGSISDDTRIRAALSTIEYLKERGARIVLVSHLGRPDGKKNPKYSLKPVANRLSELLGQDVKMLSDCIGSEVVNSTLQMKDGDVVLLENVRFYAEEEKNDKNFAKKLSENGDVFVNDAFGAAHRAHASTVGVADYLPSVGGFLMEKEDKFLGGILKNPERPFVSIIGGSKVSSKIAVLESLLSKSNVVVIGGGMAYTFLHSEGYSIGKSLLEDEYIGIASSFLKKAKELGVKVILPLDHIVADDFNKNSIPEYIDSFNIPENKIGMDIGANTLKEIENVVKTAKTIIWNGPLGVFEFDSFSKGTAKVAEMVASCSGLTVVGGGDSVAAVNKFNLSDKITHVSTGGGASLEYLEGRILPGIKVLEN

SEQ ID NO: 17963 - protein, 253 aa, Borrelia burgdorferi B31
MRKTFLAGNWKMHYTSAEASIVAKKIATEVKTLKDDVVIMITPPFTALSKVSECIKGSNILLGAQNMSYMESGARTSEISPSMLLEFGVEYVILGHSECRLYLAETDEIINKKILAGLKHPFKYLILCVGETLDERDSGKTLEVVLNQVKKGLNCVSESDIQRIILAYEPVWAIGTGKTATKEEAEEVHKAIRLEITKLYSKSASDNIIIQYGGSVNSNNVKELMNEPNIDGALIGGASLKAESFLSIINNVL

SEQ ID NO: 17964 - protein, 254 aa, Borrelia burgdorferi B31
MNYTKFQEFISEFLGTFILLALGTGSVAMTVLFSSSPEIPGEIIKGGYTNIVFGWGLGVTFGIYTAARMSGAHLNPAVSIGLASVGKFPVSKLLHYIVAQILGAFTGALMTLVVFYPKWIEMDPGLENTQGIMATFPAVPGFLPGFIDQIFGTFLLMFLISVVGDFTKKHSDNPFIPFIVGAVVLSIGISFGGMNGYAINPARDLGPRILLLFAGFKNHGFNNLSIVIVPIIGPIIGAILGATIYEFTLKNNKD

SEQ ID NO: 17965 - protein, 433 aa, Borrelia burgdorferi B31 [sequence omitted]

SEQ ID NO: 17966 - protein, 477 aa, Borrelia burgdorferi B31
MISKLTKIVATISDLRCEPEHIKDLHDAGVNVIRLNTAHQSHEDTIKVIDNVRKISNKIALMIDTKGPEVRTANIENPIIVKTGDKVIISTSPINEPNNFQTNYDGFVKEVPQGSKVLIDDGELEMTVVAKLPDRLICEIKNDGQIKNKKSINTPGISLKLQSVTEKDKGFIELAAKYNVDFIAHSFVRHSKDVQDVQEILTASGNPDVKIISKIENQEGIDNIEEIAKASYGIMVARGDMGVEIPAEDVPIAQLKITQTCIKYGIPVITATQMLHTMIENPRPTRAEVSDIANAILNGTDAIMLSGETAYGKYPIEAVKMMTSIAKKVEKHRKMTLYKDELFYDKSITRNYIIKCAIDATKLMDIKAIIVDSLKGKTARIMATYRASVPLFITTNSERLARELALSYGVYSNLVDNNFKRTTEFVVTSLKMLKEQGVVNDKDTVIIISGNPNRNIEKGTEFMEINTVEDAIKGRNI

SEQ ID NO: 17967 - protein, 211 aa, Borrelia burgdorferi B31
MGLVFLGPPGSGKGTISKIISNEFKYQHISTGDLFRENILNSTALGQEIKKIVERGELVPDLITIKIVEDKIKAIKKNKDFILDGFPRNICQAEALDKFLPNVKIINFLIDEELVIKRLSGRRICKSCNNIFNIYTLTTKKNGICDVCGGDLYQREDDKEECLKTRLKEYKLQTKPLIEFYSKCSRLNNVDASVKIDEIKKKIIKIMLKKN

SEQ ID NO: 17968 - protein, 464 aa, Borrelia burgdorferi B31
MDVGIYGLGVMGSNLALNIADNGFNVSVYNRDNEKTEIFVKQNSHKKINGFKDIESFVKSLKTPKKIILMVTSSAIEKVIEQILPFMNKSDIIIDGGNSHYKSTMRLEKELFAKDIYFVGLGISGGERGARFGPALMYGGSKSAYEILEPMLNKIAAKTKNNDICSTYIGENGSGHYVKMIHNGVEYADMQLISEVYFFMKKAFNLDNLKISEVFEKWNEGDLSGYLLEITSKILKYKENNEYLVDKILDIANQKGTGVWTAIDALESGVPVNLIVESVFSRFMSGLKHERIIASDLLKMDTSSFEFELSDWILDLYYALLVSKIVAYAQGFMMLKTASVNYGWDLNLGKISLVWREGCIIRSSFLDKIKLAYDKNPHLINLLFDDYFLDLLKNNHKSLRRIISKASEIGIPLPAFYASLSFLDSYSTNYLPSNLIQAQRDFFGAHSFERLDSKRGEFFHSAWQ

SEQ ID NO: 17969 - protein, 449 aa, Borrelia burgdorferi B31
MIKKFKNYDQIIKELFVIAIPTAFESLLFQMVTFFDNFMISYLGSFHVTGVSLANRVTFLFFIIVFGLGTALSAYVSQAIAKKKFLQVRQSFAYILLIGTTIGIIFFIFSFLFPRNIIKLFTANQDSLNFGSEYLKIISLSYVLMAYSFLSAMGFKSAKEVKIPLYVTSIVVLINIVFNYILIFGFSMGIKGAAYATVLARIVEFVFYFLYSLISSNSYYRIKFGDFFAPKVVTRANLKLIIPVLSHEIFWVLSITILHAFYARVGSIEYASFAVASNLFDICFVLLHGMGLATGVVIGHLMIYDKKHVRSVGFFLSFLGFLLGIFVVILLIGISSFAPYIFSKLDSPELVSVFIYVFASIVIFKAFTAQVLVGVFRASGIPNVCFFIESGVIVFYTLPVAYLLVFYTNLSLPIVVFIVNLEEIIKNIFIIIEFFHDDWIREIEYEELA

SEQ ID NO: 17970 - protein, 481 aa, Borrelia burgdorferi B31
MKNLSLFTDFYEISMMNAYFTKGINPKAKFEVFFRKTPFKNGYIVLAGMHTLINELKNIRFGENELKYLKSFNILDKQFLNFLREFKLNVKISSIEEGRIVFPQAPVVVIEGHLIELLLIEGLVLNIINFESLIATKTARIKESGAKILAELGLRRAQGINGALSASKAAYIGGADFTSNMLAGYKYNIPVTGTMAHSWIMSFETEEQAFREYAKTYPNKVSLLIDTYDTLNSGLKNAIKIFKELKHEEKNNFSIRIDSGDLEYLSKAARKELNRNGLNHVKIIASNELDENIIMYLNSINAPIDIWGVGTNLVTAKGDPSLSGVYKMISIEKNGKFIPKIKISNNAEKSTLPDQKEVARIYLNDQMILDFIFLKEEKDKIKDHLNSRKEFTVFHPIQDNIFKIIKQYDDFEFLTHTVLENGKLRKGYESSLTNIRNKTKLDLSKLEHTYKRIINPHIYKVSISKNLRKLKNKLTKDIKNN

SEQ ID NO: 17971 - protein, 276 aa, Borrelia burgdorferi B31
MTKDYYNILGIQKNASNEEIKKAYKKLAIKYHPDKNKGNKIAEEKFKEINEAYEILSSPDKKRNYDSLGNTNFNGNNDHFEREFSSTRFGNFEDLDFFSKIFGGSSRKTADREIIINISLYDAYMGSKKIILINNKKIEVIIPKGTLETTTIKINNKGPINPISGIKGSLIVKFNISSYKNFKLNGKTLETTIEVYPWEIALGCEKLFETIEGKKIKLKIPSDAKNGEILNLKGLGMPIIGSSSKRDLKVTLIVKIPKIINNEVKTIYERLKEIYS

SEQ ID NO: 17972 - protein, 253 aa, Borrelia burgdorferi B31
MLGDFMYKLVLVRHGESEWNKENLFTGWTDVKLSDKGIDEAVEAGLLLKQEGYSFDIAFSSLLSRANDTLNIILRELGQSYISVKKTWRLNERHYGALQGLNKSETAAKYGEDKVLIWRRSYDVPPMSLDESDDRHPIKDPRYKHIPKRELPSTECLKDTVARVIPYWTDEIAKEVLEGKKVIVAAHGNSLRALVKYFDNLSEEDVLKLNIPTGIPLVYELDKDLNPIKHYYLGDESKIKKAMESVASQGKLK

SEQ ID NO: 17973 - protein, 444 aa, Borrelia burgdorferi B31
MMKIIIIGGTSAGTSAAAKANRLNKKLDITIYEKTNIVSFGTCGLPYFVGGFFDNPNTMISRTQEEFEKTGISVKTNHEVIKVDAKNNTIVIKNQKTGTIFNNTYDQLMIATGAKPIIPPINNINLENFHTLKNLEDGQKIKKLMDREEIKNIVIIGGGYIGIEMVEAAKNKRKNVRLIQLDKHILIDSFDEEIVTIMEEELTKKGVNLHTNEFVKSLIGEKKAEGVVTNKNTYQADAVILATGIKPDTEFLENQLKTTKNGAIIVNEYGETSIKNIFSAGDCATIYNIVSKKNEYIPLATTANKLGRIVGENLAGNHTAFKGTLGSASIKILSLEAARTGLTEKDAKKLQIKYKTIFVKDKNHTNYYPGQEDLYIKLIYEENTKIILGAQAIGKNGAVIRIHALSIAIYSKLTTKELGMMDFSYSPPFSRTWDILNIAGNAAK

SEQ ID NO: 17974 - protein, 348 aa, Prunus armeniaca
MAAKTELGSLTVQELLGKGKGEQVPEKYIHKVGAPNASSAQLMDIPVIDLGLLLTPSSITAPQLEKLRSALTTWGCFQVINHGMTPEFLDEVREMTKQFFALPVEEKQQYLRQVNDIQGYGNDMVFSEQQTLDWSDRLYLSVYPEEHRKLKFWAQDPKSFSETLHQYTMKLQVVTKTVLEAMARSLNLDVNCFRDLYGEQGKMDVRFNFYPPCSRPDVVLGVKPHADGTIITLLLQDKQVEGLQFLKDDQWFRAPIVPEALLINVGDQAEILSNGIFKSPVHRVVTNPDKERISLAAFCIPESDKDIEPFESLVNESTPGLYKKVKNYVGIYFEYYQQGKRPIEAAKI

SEQ ID NO: 17975 - protein, 475 aa, Prunus armeniaca
MSTLKARSVQARASDGDLENLVPSKPQGKSSGTVFPFVGVACLGAILFGYHLGVVNGALEYLSKDLGIAENAVLQGWVVSALLAGATVGSFTGGALADKFGRTRTFQLDVIPLAIGAFLCATSQSVQTMIVGRYLLAVGIGITSAIVPLYISEISPTEIRGALGSVNQLFICIGILGALVAGLPLAANPLWWRTMFGVAIVPSVLLALGMAASPESPRWLFQQGKISEAEKAIKTLYGKERVSEVMHDLTSATQGSVEPEAGWFDLFSSRYWKVVSVGAALFLFQQLAGINAVVYYSTSVFRSAGITSDVAASALVGAANVFGTAVASSLMDRQGRESLLLISFGGMAASMLLLSLSFTWKVLAPYSGPLAVAGTVLYVLSFSLGAGPVPALLLPEIFASRIRAKAVSLSLGMHWISNFVIGLYFLSFVTKFGISSVYLGFAGVCLLAVLYISGNVVETKGRSLEEIERALSVST

SEQ ID NO: 17976 - protein, 475 aa, Vibrio parahaemolyticus
MSKEIKAQVVVLGSGPAGYSAAFRCADLGLETVLVERYSTLGGVCLNVGCIPSKALLHVSKVIEEAKAMADHGVVFGEPQTDINKIRIWKEKVVNQLTGGLSGMAKMRNVTVVNGYGKFTGPNSILVEGEGESTVVNFDNAIVAAGSRPIKLPFIPHEDSRIWDSTDALELKEVPEKLLIMGGGIIGLEMGTVYHSLGSKVEVVEMFDQVIPAADKDIVKVYTKRIKDKFKLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKAEGIKYEVATFPWAASGRAIASDCSDGMTKLIFDKETHRVIGGAIVGTNGGELLGEIGLAIEMGCDAEDIALTIHAHPTLHESVGLAAEVFEGSITDLPNKKAVKKK

SEQ ID NO: 17977 - protein, 477 aa, Helianthus tuberosus
HEWVLGVGKPKNLPPGPTRLPIIGNLHLLGALPHQSLAKLAKIHGPIMSLQLGQITTLVISSATAAEEVLKKQDLAFSTRNVPDAVRAYNHERHSISFLHVCTEWRTLRRIVSSNIFSNSSLEAKQHLRSKKVEELIAYCRKAALSNENVHIGRAAFRTSLNLLSNTIFSKDLTDPYEDSASGKEFREVITNIMVDSAKTNLVDVFPVLKRIDPQGIKRGMARHFSKVLGIFDQLIEERMRTGRFEQGDVLDVCLKMMQDNPNEFNHTNIKALFLDLFVAGTDTTSITIEWAMTELLRKPHIMSKAKEELEKVIGKGSIVKEDDVLRLPYLSCIVKEVLRLHPPSPLLLPRKVVTQVELSGYTIPAGTLVFVNAWAIGRDPTVWDDSLEFKPQRFLESRLDVRGHDFDLIPFGAGRRICPGIPLATRMVPIMLGSLLNNFDWKIDTKVPYDVLDMTEKNGTTISKAKPLCVVPIPLN

SEQ ID NO: 17978 - protein, 157 aa, Solanum commersonii
MAHYENQYSAGQALQKDEYGNPVRQTDEYGNPIQQTGGTMGEYGTTGTGYGTQAGHTTGVLGGDQRQHGTLGGMLHRSGSSSSSSSSEDDGHGGRRKKKGIKDKVKEKLPGGHRDDLAHSTATTTTTGYGMDGTHEKKGIMEKIKEKLPGHHGPGHH

SEQ ID NO: 17979 - protein, 505 aa, Alteromonas sp.
MIYAKPGSEGSVVSFKESYGNFINGEWVAPVKGEYFTATSPVDGSDIAQVPRSTSEDVELALDAAHAAKKGWAEKSVAERSNVLLKIADRIEENLELLAVAETWDNGKAVRETLNADIPLCADHFRYYAGCIRSQEGTIGEIDKNTVAYHFHEPYGVVGQIIPWNFPLLMAAWKLAPALVTGNVVVLKPAEQTPVSILLFAELIQDLLPPGVLNIVNGFGAEAGQALATSTRIAKIAFTGSTPVGGHILRCAAENLIPSTVELGGKSPNLFFADIMDHEPEFIDKCAEGLVLGYFNQGEVCTCPSRAIIQEDIYDAFMEKVLEKIQKIKRGNPLDTETMVGAQASNEQFEKILKYIDIGKSEGAQVVTGGEKEQLPGFDDGYYIQPTILKGENHMRVFQEEIFGPVIAVQTFKTEEEAIEIANNTSFGLGAGVWSRDANVAFRVGRAIEAGRVWTNCYHLYPAHAAFGGYKKSGIGRETHKMMLDHYQQTKNLLVSYDINPLGFF

SEQ ID NO: 17980 - protein, 220 aa, Thermotoga neapolitana
MMAYLVFLGPPGAGKGTYAKRIQEKTGIPHISTGDIFRDIVKKENDELGKKIKEIMEKGELVPDELVNEVVKRRLSEKDCEKGFILDGYPRTVAQAEFLDSFLESQNKQLTAAVLFDVPEDVVVQRLTSRRICPKCGRIYNMISLPPKEDELCDDCKVKLVQRDDDKEETVRHRYKVYLEKTQPVIDYYGKKGILKRVDGTIGIDNVVAEVLKIIGWSDK

SEQ ID NO: 17981 - protein, 431 aa, Treponema maltophilum
MEKFFKMGARGTNVRREIVAGLTTFLAMAYILAVNPKMLANAGMDAGGVFTATALAACIATLVMAFTANLPIALAPGMGLNAFFAFTVVLGMGISWKIALTAVFLEGVLFIILSLFNVRERIIKAIPSNLKKAVAAGIGLFICFIGFQNAGIIVNNDATLVGLGNLTHGPAAVAMIGLALTAVLYALKIPGSILIGILVTTLIGIPFGVTSVPANWTPVSMPAAPLLFQFDFSHIFTLDFFAVFFTFLFVDIFDTVGTLVGVSSEAHIMDANGNVPRVKQALLSDAIGTVAGACLGTSTVTSYVESTAGAAGGRTGMTALTTGVLFLLALFLSPLFLLVPGAATAPALIIVGFLMLKAVTGINFNDVTEGLSAFITIVMMPFAYSIAEGIVWGIITYVFMKAATGKAKSIPVVTWVLFVIFILRLILTSGA

SEQ ID NO: 17982 - protein, 512 aa, Propionigenium modestum
KKIQDLQKKKEKIALGGGIKRIEKQHASGKMTARERLAYLFDEGTFVEMDAFVQHRCTNFGMDKQDLPSESVVTGYGMVDGRVVYAFSQDFTVTGGALGEMHAKKICKAMDMAGKVGAPVVGLNDSGGARIQEAVDALSGYGDIFYRNSIYSGVVPQISAILGPCAGGAVYSPALTDFIFMVDQTSQMFITGPQVIKTVTGEEVTAEQLGGAMTHNSTSGCAQFISQDDKACIDDIRRLISFLPSNNMEKAPEFGCEDDLNIQFPELDALMPDNPNKAYNMFDVITKIVDNGDYMEYQPHYSKNIITCFARVNGKSVGIIANQPQVMAGCLDIDSGDKCAKFIRTCDAFNIPLLTIVDVPGFLPGVTQEYGGIIRHGAKILYAYSEATVPKVTLITRKAYGGAYVAMCSKSLGADVVLAWPTAEIAVMGPAGAVNIIFRKDIKDAKDPAATTKQKLDEYTTEFANPYQAARRGLVDDVIEPKTSRQRIVDAFNMLEGKREKLPAKKHGNIPL

SEQ ID NO: 17983 - protein, 283 aa, Schizosaccharomyces pombe
MADDTAYILSEYLQTLDNVPNETKHIFDEISVKEVAVHDIWKRIQAADSQIQSYIKSHGSLTPHPKEDALYSTIREEYQKAINIQNEKVQLADRARLGLTRHIKRLDDRLAKAGHGFTAAELLNAPDYYASSPYGGYSPSGASSARQTPAPSRSGASTAGRRRTSATTRGAIQNGVYHSPYTASLADSGSTRGQKVSNATATTQLETKADSTTPNEMVSEEDMEEDNEKYCFCQQGSYGQMVACDNANCEREWFHMECVGLKAPPEGTWYCEACRDQKLVDAK

SEQ ID NO: 17984 - protein, 479 aa, Streptomyces sp.
MVPAAQQTATAPDAALTFPEGFLWGSATASYQIEGAAAEDGRTPSIWDTYARTPGRVRNGDTGDVATDHYHRWREDVALMAELGLGAYRFSLAWPRIQPTGRGPALQKGLDFYRRLADELLAKGIQPVATLYHWDLPQELENAGGWPERATAERFAEYAAIAADALGDRVKTWTTLNEPWCSAFLGYGSGVHAPGRTDPVAALRAAHHLNLGHGLAVQALRDRLPADAQCSVTLNIHHVRPLTDSDADADAVRRIDALANRVFTGPMLQGAYPEDLVKDTAGLTDWSFVRDGDLRLAHQKLDFLGVNYYSPTLVSEADGSGTHNSDGHGRSAHSPWPGADRVAFHQPPGETTAMGWAVDPSGLYELLRRLSSDFPALPLVITENGAAFHDYADPEGNVNDPERIAYVRDHLAAVHRAIKDGSDVRGYFLWSLLDNFEWAHGYSKRFGAVYVDYPTGTRIPKASARWYAEVARTGVLPTA

SEQ ID NO: 17985 - protein, 393 aa, Saccharomyces cerevisiae
TLQESDKFATKAIHAGEHVDVHGSVIEPISLSTTFKQSSPANPIGTYEYSRSQNPNRENLERAVAALENAQYGLAFSSGSATTATILQSLPQGSHAVSIGDVYGGTHRYFTKVANAHGVETSFTNDLLNDLPQLIKENTKLVWIETPTNPTLKVTDIQKVADLIKKHAAGQDVILVVDNTFLSPYISNPLNFGADIVVHSATKYINGHSDVVLGVLATNNKPLYERLQFLQNAIGAIPSPFDAWLTHRGLKTLHLRVRQAALSANKIAEFLAADKENVVAVNYPGLKTHPNYDVVLKQHRDALGGGMISFRIKGGAEAASKFASSTRLFTLAESLGGIESLLEVPAVMTHGGIPKEAREASGVFDDLVRISVGIEDTDDLLEDIKQALKQATN

SEQ ID NO: 17986 - protein, 155 aa, Neisseria meningitidis
EAKKIIDKGGLVRDDIIIGMVKERIAQDDCKNGFLFDGFPRTLAQAEAMVEAGVDLDAVVEIDVPDSVIVDRMSGRRVHLASGRTYHVTYNPPKVEGKDDVTGEDLIQRDDDKEETVKKRLAVYHEQTEVLVDFYSKLEGEHAPKYIKVDGTQAV

SEQ ID NO: 17987 - protein, 155 aa, Neisseria meningitidis
EAKKIIDEGGLVRDDIIIGMVKERIAQDDCKNGFLFDGFPRTLAQAEAMVEAGVDLDAVVEIDVPDSVIVDRMSGRRVHLASGRTYHVTYNSPKVEGKDDVTGEDLIQRDDDKEETVKKRLAVYHEQTEVLVDFYSKLEGEHAPKYIKVDGTQPV

SEQ ID NO: 17988 - protein, 254 aa, Brucella melitensis biovar Abortus
MKAMVLEKPGQPLVLVERPDPLPGPGQIRLKVEACAVCRTDLHVVDGELERPKLPLVPGHEIVGVIDAVGTGVDPSRTGRRVGVPWLGHTCGACDYCRSGAENLCDAPLFTGYTRDGGFATHVVADADFAFDLDEAADPVALAPLLCAGLIGWRSLKKAGEGKRIGLYGFGAAAHIIAQVCRWQTGRFTLSQSPEIRKRKILRAALARYGPEIQIFCRRHRWMQLSFSHPPGSSFQPPCVRCARAAGWSAAASI

SEQ ID NO: 17989 - protein, 155 aa, Solanum tuberosum
  misc_feature (143)..(143): Xaa can be any naturally occurring amino acid
TTLMDVLAGRKTGGHITGNIYISGHPEKQETFARVSGYCEQNDVHSPCLTIHESLLFSAWLRLSSQVDVKTQKAFVEEVMELVELTSLRRALVGLPGVDGLSQSKGKRLTIAVELVANPSIVFMDEPTSGLDARSAAIVLITXKNIVYTGRTILC

SEQ ID NO: 17990 - protein, 155 aa, Solanum tuberosum
TTLMDVLAGRKTGGYIDGSIKISGYPKKQETFARISGYCEQNDIHSPYVTVYESLVYSAWLRLPQDVDEHKRMMFVEEVMDLVELTPLRSALVGLPGVNGLSTEQRKRLTIAVELVANPSIIFMDEPTSGLDARAAAIVMRAVRNTVDTGRTVVC

SEQ ID NO: 17991 - protein, 155 aa, Solanum tuberosum
TTFLDVLAGRKTSVHVEGEIKVGGYLKVQETFARVSGYCEQTDIHSPQITVEESVIFSAWLRLHPQIDSKTKYEFVKEVLETIELDGIKDTMVGMPGVSGLSTEQRKRLTIAVELVANPSIIFMDEPTTGLDARSAAIVMRAVKNVADTGRTIVC

SEQ ID NO: 17992 - protein, 155 aa, Solanum tuberosum
TTLMDVLAGRKTDGYIEGTISIPGYPKQQETFARIAGYCEQTDIHSPHVTVYESLLYSAWLRLPREVDTETQKSFIEEVMELVELTPLREALVGLPGVNGLSTEQRKRLTVAVELVANPSIIFMDEPTSGLDARAAAIVMRTVRNTVDTGRTVVC

SEQ ID NO: 17993 - protein, 429 aa, Bacillus megaterium
MRSYEKSKAAFLEAQQLMPGGVNSPVRAFKSVDMDPIFMERGKGATIYDIDGNKYIDYVLSWGPLIHGHSNDQVVEAVKKVTESGTSFGAPTLIENELAKVVIERVPSIEIVRMVSSGTEATMSALRLARGYTGRNKILKFEGCYHGHGDSLLIKAGSGVATLGLPDSPGVPEGIAKNTITVPYNDLESVQYAFKEFGDDIAGVIVEPVAGNMGVVPPQPGFLQGLRDITSEYGSLLIFDEVMTGFRVAYNCAQGYYNITPDLTCLGKVIGGGLPVGAYGGKAEIMERVAPSGPIYQAGTLSGNPLAMTAGYETLTQLTPQSYDEFIRKADRLEEGLMAAAEKYDVPFTVNRAGSMIGFFFTNEQVINYETAKTSNLDYFAAYYREMANEGVFLPPSQFEGMFLSTSHTDADIEHTIAAAEKAFSKLRG

SEQ ID NO: 17994 - protein, 248 aa, Borrelia burgdorferi
MYKLVLVRHGESEWNKENLFTGWTDVKLSDKGIDEAVEAGLLLKQEGYSFDIAFSSLLSRANDTLNIILRELGQSYISVKKTWRLNERHYGALQGLNKSETAAKYGEDKVLIWRRSYDVPPMSLDESDDRHPIKDPRYKHIPKRELPSTECLKDTVARVIPYWTDEIAKEVLEGKKVIVAAHGNSLRALVKYFDNLSEEDVLKLNIPTGIPLVYELDKDLNPIKHYYLGDESKIKKAMESVASQGKLK

SEQ ID NO: 17995 - protein, 248 aa, Ralstonia solanacearum
MHKLVLIRHGESTWNLENRFTGWVDVDLTDTGIAQARQGGRLLREAGFTFDLAYTSVLKRAIRTLWHVQDEMDLMWIPTRTEWRLNERHYGGLSGLNKAETAAQYGDQQVLVWRRSYDTPPPALEAGDERDAYGNPRYAGLPREQVPLTECLKDTVARVLPLWETSIAPDIKSGKRVVIAAHGNSIRALVKYLDNISDDDIVGLNIPNGTPLVYELDANLKPIRHYYLGDQEAIAASLAAVAGQGKAK

SEQ ID NO: 17996 - protein, 206 aa, Brucella melitensis
MSRTLVLVRHGQSEWNLKNLFTGWRDPGLTEQGHAEAKAAGQRLKAAGLKFDIAYTSALSRAQVTCQHILDELGQPGLETIRDQALNERDYGDLSGLNKDDARAKWGEEQVHIWRRSYDVPPPGGESLKDTGARVWPYYLHTIQPHVLREETVLVAAHGNSLRALIMALEGLTPEQILKQELNTGVPIIYRLNADSTVASKEILSA

SEQ ID NO: 17997 - protein, 336 aa, Emericella nidulans
MSTSKSRWADEDPETEALIAQRKREKEEKRRAKAEKQRLEEQAKAQAAAERQAGDSRLNGDPSEAPPKKRRRLSNEQQPGSSGEQAAKQGKPTTLLQFPALEWGPCRHVDNFERLNHIEEGSYGWVSRAKELTTGEVVALKKLKLDNSPDGFPVTGLREIQTLLEARHQNVVYLREVVMGNKMDEVYLVMDFLEHDLKTLLDDMREPFLPSETKTLLLQFISGLDFLHSQWIMHRDLKTSNLLLNNRGELKIADFGMARYYGDPPPKLTQLVVTLWYRSPELLLSAESYGPEVDMWSVGCIFGELLTKEPLLQGKNEVDQVSKVCTVLFFFFSFKI

SEQ ID NO: 17998 - protein, 203 aa, Isochrysis galbana
GEGTYGVVYKAQDTEDPQGATVALKKIWLDDRDEGVPVTTLREVALLRNLDHVNIVRMREFVTIPPRIYLVFEYLDHDLKACLDTKFRSGMPAPLVKSCALQILRGLAFCHSHRILHRDLKPQNVLIDNAGIVKLADFGLARASLLLNSQLYTNEVVTLWYRAPELLLGTQNYINSVDVWAAGCIFTELSCRMPLFPGDSEIE

SEQ ID NO: 17999 - protein, 378 aa, Wolbachia endosymbiont of Tunga penetrans
MSDLAKRMSLIKPSPTIAVTDKANRLKSEGKKICVLAAGEPDFDTPGHVKKAAIQAINEGKTKYTAVDGTLELKEAIINKLKKDNSLKYTPSQICVGAGAKQVLFNLFMATVNPGDEAIIPAPYWVSYVDMVSLFGGLPVVVECKQSFKLTPELLKSKITKKTKWLILNSPNNPAGVIYTYDELKGIAQILLEYPHVNVVTDDIYEHIIYDEKFFTIAQVEPKLYDRIFVVNGVSKAYAMTGWRIGYIAGRSDVIKAISTLQSQSTSNPNSIAQAAAVEALNGDHDFLKERTKIFKSRRDFVVEKLNSVPGLSASTPQGAFYLFVSCEGLLGKSTRSGKVINNDLDFAEYLLEDHLVAVVPGIAFGLKNFVRISYATS

SEQ ID NO: 18000 - protein, 489 aa, Citrus unshiu
MWGRQREASMMYKRTSSRDRSSTFDVEETTALVQNGTEVENTNPSWKLSFPHVLVATLSSFLFGYHLGVVNEPLESISLDLGFNGNTLAEGLVVSMCLGGAFIGSTLSGWIADGVGRRRAFQLCALPMIIGASISATTRNLIGMLLGRFVVGTGMGLGPTVAALYVTEVSPPFVRGTYGAFIQIATCLGLMGSLLIGIPVKEIAGWWRICFWVSIVPAAILCLAMVFCAESPHWLYKKGRTAEAEAEFEKLLGGSHVKSSLAELSKLDRGDDGDIVKFEELLYGRHFRVVFIGSTLFALQQLSGINAIFYFSSSVFKSAGLSSGLANVFVGIANLLGSVVAMVLMDKLGRKALLQWSFFSMAVSMAIQVAASSSYIPGSASLYLSVGGMLMFVLTFALGAGPVPSLLLPEIFPSRIRAKAMAVCMSVHWVINFFVGLLFLRLLEQLGPQLLYSIFGTFCLMAVAFVKRNVVETKGKSLQEIEIALLPQE

SEQ ID NO: 18001 - protein, 434 aa, Heliobacillus mobilis
MEGFCVSVIAEVYAREILDSRGNPTVEVEVVLEDGTVGRAAVPSGASTGAYEAVELRDGDKERYLGKGVLNAVDNVNTEIAPEIIGWDVTRQMEIDSALIELDGTPNKGRLGANAILGVSMACAKAAAQYQGLPLFQYLGGVFARELPVPMMNILNGGKHADNNVDIQEFMVMPVGAQSFSEGLRMGVEVFHSLKKVLQSKGLNTAVGDEGGFAPNLKSNEEALKVILEAVQAAGYKAGEDILLAVDAAASEMYKDGKYHLEGEGKVMTSAEMVDFWEDLVNRYPIISIEDGLNEDDWDGWKLLTDRLGKRAQLVGDDLFVTNTEKLSKGIETGVGNSILIKVNQIGTITETLAAIEMARRAGYTAVISHRSGETEDATIADLAVAVNAGQIKTGAPSRTDRVAKYNQLLRIEEELDEQATYRGKKTFFNLERR

SEQ ID NO: 18002 - protein, 452 aa, Heliobacillus mobilis
MVRECPGGPGRPGGGRPIPKSAIPKPPETTEVPKKDGRQRHANNKLQPKEHDHRYEDRPGAKLVHPRQGKGKKGHRYTEHEGPKHILIDEAVTVLELSQAMGKTVTDIIKKLMQLGVMATINQEIDADTASILAADWGITVDVKKNITAEGILAEEPEETEEELIHRPPVVTVMGHVDHGKTSLLDAIREANVTASEAGGITQHIGAYQVEIEGKKITFLDTPGHEAFTAMRARGAQVTDIAILVVAADDGVMPQTVEAINHAKAAGVPIVVAINKIDKPDATPDRVKQELTEHGLVVEEWGGDTIAVPVSAKARQNIDQLLEMVLLVAEVQDLKANPDREARGTVIEAELDKGRGPVATVLVQKGTLNIGDVIVAGYSVGKVRAMIDDKGRRVKKADPSTPVEVLGLSDVPQAGDTFAVVTDEKLAKQVISERVNKRKEEEQRRTSKVSLG

SEQ ID NO: 18003 - protein, 391 aa, Heliobacillus mobilis
MNTYGRLPIALVKGEGAKVWDADGREYLDFLAGLAVNSLGHCHPKVTEAVKAQVDQLIHVSNLYWIEPQIELAQSLVENSFADKVFFCNSGAEANEGAIKLARKYAKLHMGPDKYEIITMEKSFHGRTLATVTATAQPKYQKAFTPLPEGFRYVPFGDLKALEKAIGPHTCAIMVEPVQGEGGVNLAEPAFWEGLAKLAKEQNLLLIFDEVQSGLGRTGKLFAHEHYGITPHIMTLAKALGGGTPIGALLATDEVASAFEPGDHASTFGGNPLVTAAGVATMDVLVQGGLLAHCLEMGAYFRGHLNRLAEKYTFIQEVRGLGLILACELDRPGADIVAACLEKGLIINCTAVNVLRFLPPLIITKEDIDHAVAILEEVLASVEANAGGTPA

SEQ ID NO: 18004 - protein, 459 aa, Heliobacillus mobilis
MGYPWQYKGVSAMTGLELDLSYSTVESSIGSLEPEVLRAHEMLHQGSGLGSEYTGWLHLPERYDRAEFARIEAAAERIRSSSDALVIIGIGGSYLGARAAIDMLSHTFHNQLPRNRRPGCEIYFAGHQISSTYLHHLFEILEGKDVSINVISKSGTTTEPAIAFRLFKTWMEQKYGAEEAKKRIYATTDRAKGALKSLADQEGYETFVVPDDVGGRYSLLTAVGLLPIAAAGIDISTLMAGARAAMAEYEKPALAENACYRYAAARNALYRQGKMIELLVGYEPSLQYVAEWWKQLFGESEGKEHKGLFPASVQFSTDLHSMGQYIQEGMRILFETVLQFRQPRLEMAIPTDPANSDGLNFLAGKTMDFVNQKAFSGTLLAHVDGQVPNIALTVPKQDAYSLGQLFYFFEKACAVSGYMLGINPFDQPGVESYKRNMFALLGKPGYEAEREALEKRLSL

SEQ ID NO: 18005 - protein, 460 aa, Heliobacillus mobilis
MSMAKAKTRFFCSECGQESLKWMGRCSGCGAWNSLVEERIAKSSGDGALSQRYGAAANGAVVHVDKAEVTENIRLSTGISELDRVLGGGLVAGSLTLLAGDPGIGKSTLLLQAAQKIADNGGRVLYVSGEESVQQIKLRAARLGVQGVELYLLAETNIQTICDSIRECKPVWVIIDSIQTMYWDEIGSAPGNVAQVRECTGQLLRLAKDLPVAMTLVGHVTKDGAIAGPRLLEHMVDAVLYLEGERHYLYRVLRGVKNRFGSTNELGIFEMLGQGMVEVPNPSAFFLAERTQGVSGSVVVPCMEGTRPVLVEVQALVTPTTFGQPRRMATGMDYNRTVLLAAVLDKKVGLHLGQQDIYVNVAGGLKLAEPASDLAVVTAIASSWRNRPADPEVVVIGEVGLTGEVRAVTHLEKRINESVKLGFSRCVCPKQNRKYLREETGMEVIAVETVDEALAAVLGG

SEQ ID NO: 18006 - protein, 500 aa, Heliobacillus mobilis
MVKDEGYLWKGDVAVLRDLGMIREGLTFDDVLLVPAKSEILPREVETSTWLTRRIRLNIPLMSAGMDTVTDSRMAIAMAREGGIGVIHKNMTIDQQAHEVDRVKRSEHGVITDPIYLTPKHKINDALAIMERYHISGVPIADEEGKLVGILTNRDLRFETEFSRPISDVMTKDNLVTAPIGTSLKEAKDILRNHKVEKLPIVDVEGHLKGLITIKDIQKARQFPNSTKDERGRLRACAAVGVTVDTMERARALVAAGVDALVVDTAHGHSRGVLNAVEKLKGEFPQVDIIAGNVATYEATIDLINAGADCVKVGIGPGSICTTRVVAGIGVPQITAIADCARAAREKNVPIIGDGGIKFSGDVVKAIAAGANVVMIGSLLAGTEESPGDIEIYQGRSFKVYRGMGSLGAMKEGSKDRYFQEDDKKLVPEGIEGRVPYKGSLSDTVFQLIGGLRSGMGYCGCRNIDELMTRTQFIRITAAGLRESHPHDVTITKEAPNYSL

SEQ ID NO: 18007 - protein, 251 aa, Heliobacillus mobilis
MRKTIIAGNWKMHKTIAEAVTLAEAIKSQNPNPTVEIVICPPFTALAEVAKAVQGSPVAVAAQNMHWEVQGAFTGEVSPAMVKDAGCKYVVLGHSERRQYFGETDETVNKKVKAAIAHELIPIVCVGETLEQREAGQTEDVVATQTKGGLAGLSAQEVADLVIAYEPVWAIGTGRTASDDDAQQVNAYIRSVVAEVFGKEAAEAVRIQYGGSVKPSNAENLLAKGDIDGALVGGASLKIEDFQGIIDGAKA

SEQ ID NO: 18008 - protein, 426 aa, Heliobacillus mobilis
MGNKPWKSFFNGQRGKQILGGRAKPTIPNFPILGNMDQANWNLSGPYSLESIGCPFRNGGDEEQVLNSHGIWSASEGITIKLQAVRLQYKAKDGQTYTLNLIDTPGHVDFTYEVSRSLAACEGALLIVDAAQGIEAQTLANVYLALENDLEIIPVINKIDLPSAEPERVKQEIEDVIGLDASDAVLASAKSGIGIEEVLEAIVKKIPAPKGEPEEPLQCLIFDSFYDIYKGAISYVRVVQGSVKKGSKIQMMSTGRTFEVTEVGVFAPAPRQVQELSTGEVGFIVASIKNVKDTRVGDTITNAERPAAEPLAGYRQVTPMVYCGLYPVEGADYEDLRDALDKTPPERRIANLRTGNIRRLRFWLPLWFLRPSAYGDHSRAVGAGIRPGSDPKGTASHLRVNQKDGQWSRQNPRNVPEPKISFENLL

SEQ ID NO: 18009 - protein, 271 aa, Heliobacillus mobilis
MSTKGGTERIEHTFQQLKAEGRTAFIPYITAGDPDLNTTAELVLALEASGASIVELGVPFSDPVADGPVIQEAACRALAGGVTLMKVLKMVEELRNRSQVPIVLMTYYNLLMRMGLKRFAQEAYAAGVDGVIIADLPVEEGDELRSYLDEVGIALIPLVAPTTPPERIQLIAEKARGFIYCVSLLGVTGDRTELPPDVDLLLNRVREQTDLPLGLGFGISTAAHASAVAPKADGVIVGSAIVKRIAQHPDDKDQAIAEVRQFTKEITAALA

SEQ ID NO: 18010 - protein, 272 aa, Heliobacillus mobilis
MQKRGAMKEMDGLWVKCKQCQQIFLVKELEKNLKVCRCGYHYRMTAKERIDSLIDEGTFIEWDKELVTKDPLRFPGYAQKIQKCQSDTSMAEAIITGQGDIHGIPVAIGAMDSRFIMASMGAVVGEKIVRAAEKALEKGWPLILFSASGGARMQEGVLSLMQMARTSAALTRLSEAGLPFFSVLTDPTTGGVTASFAMLGDLIIAEPGALIGFTGPRVIEQTIRQKLPAGFQRSEFLQKHGMVDIIIERPKMKAQLATLLSLHMPMAGGVNS

SEQ ID NO: 18011 - protein, 288 aa, Heliobacillus mobilis
MTDVKSKLAGSVQGPVGYLGPEGTFSDEAAQAFFLPETPRRPYSTIPMVYEGLNRWEIDAAVLPIENSIEGAVNQTLDALIENPGLFIVGEIILPVCHHFLVPPDVDWTEVTEVYSHPQPLAQCRHFLENRLPNAQATATNSTAEGAKKALQVSTAESPKGAIASEFVAKTYGLEIAVRDVQSRPNNKTRFVVVGRQLTEPTGNDKTSIVCALPSDRPGGLYEILREFAEREINLSRIESRPTKYELGQYLFFIDCAGHQRDRKVSEALNAIGRFTILTRVLGSYVRG

SEQ ID NO: 18012 - protein, 157 aa, Heliobacillus mobilis
MMIKIAPSILSADFSNLGSQVADVEAGGAEYLHIDVMDGHFVPNITIGPLVVASLRPRSQMVFDTHLMIEEPDRYIPDFIKAGSDLVTVHQEACTHLHRTVSLIREKGAKAGVALNPATSWQSLEYVLPMVDLVLVMSVNPWFWRSKVYQRRLAEDH

SEQ ID NO: 18013 - protein, 340 aa, Pseudomonas putida
MSRMIRFHKFGAADVLRCEEQAEPSPAADEVQIRVEAVGVSWYDVLWRQNLAPSQARLPAGIGHEMAGVVTAVGEGVDDIAVGDRVASFPATSANDHPVYGDVIVLPRTAITRYPNVLTPIEASVHYTPLLIAYFAYVDLARAKAGQTALVTDASHCAGPAFVQLGRALGLKVFAATKDAAQRDYLLGLGADKVIVTEEQDLLLQIGKYTDGRGVDMVLDGMGGPQMSLLGDVLAPRGSLVLYGLQGGNQTPFPACAAFQKNIQFYVHCIGNFTGKPELGISQDQVALQRALRDINQFTADQLLTPQIIKVYPFEQVVEAHRYMDQCPCGGRVVLDMAQH

SEQ ID NO: 18014 - protein, 513 aa, Arabidopsis thaliana
MGVFSNLRGPRAGATHDEFPATNGSPSSSSSPSSSIKRKLSNLLPLCVALVVIAEIGFLGRLDKVALVDTLTDFFTQSPSLSQSPPARSDRKKIGLFTDRSCEEWLMREDSVTYSRDFTKDPIFISGGEKDFQWCSVDCTFGDSSGKTPDAAFGLGQKPGTLSIIRSMESAQYYPENDLAQARRRGYDIVMTTSLSSDVPVGYFSWAEYDIMSPVQPKTERAIAAAFISNCGARNFRLQALEALMKTNIKIDSYGGCHRNRDGKVDKVEALKRYKFSLAFENTNEEDYVTEKFFQSLVAGSVPVVVGPPNIEEFAPASDSFLHIKTMEDVEPVAKRMKYLAANPAAYNQTLRWKYEGPSDSFKALVDMAAVHSSCRLCIFLATRVREQEEESPNFKKRPCKCSRGGSDTVYHVFVRERGRFEMESVFLRGKSVTQEALESAVLAKFKSLKHEAVWKKERPGNLKGDKELKIHRIYPLGLTQRQALYNFKFEGNSSLSSHIQNNPCAKFEVVFV

SEQ ID NO: 18015 - protein, 457 aa, Arabidopsis thaliana
MASLSQITLPRAPSSEIGLLRRRLERPIIRTRIGFNGRIASVLTNAGDQAVSVKASVSQKVIEEEAKVIVGTYARAPVVLSSGKGCKLFDPEGKEYLDCASGIAVNALGHGDPDWLRAVTEQAGVLAHVSNVYYTIPQIELAKRLVASSFADRVFFCNSGTEANEAAIKFSRKFQRFTHPEDKEVATGFIAFTNSFHGRTLGALALTSKEQYRTPFEPIMPGVTFLEYGNIQAATDLIRSGKIAAVFVEPIQGEGGIYSATKEFLQSLRSACDAAGSLLVFDEVQCGLGRTGLMWAYEAFGVTPDIMTVAKPLAGGLPIGAVLVTEKVAETINYGDHGSTFAGSPLVCSAAIAVMDKVSKPSFLSSVSNKGRYFRDLLVKKLGGNSHVKEVRGEGLIIGVELDVPASSLVDACRDSGLLILTAGKGNVVRIVPPLVISEEEIERAVEIMSQNLTALD

SEQ ID NO: 18016 - protein, 417 aa, Malus micromalus
MAAKESNSAAAAASSDGKIKRMLTHGGRYAQYNVFGNLFEVSSKYVPPIRPIGRGAYGIVCAAVNAEAREEVAIKKIGNAFDNRIDAKRTLREIKLLRHMDHENVIATKDIIRPPQKENFNDVYIVYELMDTDLHQIIRSNQPLNDDHCRYFLYQLLRGLKYVHSAGVLHRDLKPSNLFMNANCDLKIGDFGLARTTSETDFMTEYVVTRWYRAPELLLNCSEYTAAIDIWSVCCILGEIMTRKPLFPGKDYVHQLRLITELLGSPDDSSLGFLRSDNARRYVRELPQYPKRSFSLGFPNMSPSSIDLLEKMLIFDPNRRITVDEALSHPYLAPLHDINEEPVCPMPFNFDFEQPSFTEENIKELIWRESVRFNPESHFSMDHDIICCILLQTNLKTDCNDMFVDTVIVECVKGVDS

SEQ ID NO: 18017 - protein, 475 aa, Abobra tenuifolia
MSPQTETKASVGFKAGVKGYKLTYYTPEYETKDTDMLAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRVPTAYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAMCARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWNEIKFEFEAVDTL

SEQ ID NO: 18018 - protein, 475 aa, Begonia glabra
MSPQTETKASVGFKAGVKDYKLTYYTPDYQTKDTDILAAFRVSPQPGVPPEEAGAAVAAESSTGTWTAVWTDGLTSLDRYKGRCYYIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMNKRAIFARELGVPIVMHDYLTGGFTANTSLAHYCRDNGLLLHIHRAMHAVIDRQKNHGIHFRVLAKALRMSGGDHIHAGTVVGKLEGERDITLGFVDLLRDDYIEKDRDRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 18019 - protein, 493 aa, Vibrio vulnificus CMCP6
MELKQRLSQQLKESRDAFLRNPYPTYQKRLENLNKLESLIKAHQAEIIYAIEQDFGTRSISETGLLELFTSIETIRDAKKQLKKWMKPSHRHTSVWFFPAKNRVVPQPLGVVGVIVPWNYPLMLTIGPLVAALAAGNRVMLKMSQNSPHLAQLLVELFEAQFNRDEVAIYADEAEMGPEFSKLKFDHLLFTGSTKTGRAVMQSAANNLVPVTLELGGKSPVILDEKFDVKIALERLLGGKLYNCGQTCIAPDYLFVPQSRLNEVVETTKAIMAKRFRTIQHQDYTSIIDANAFERLTHLLSDAKEKGAKLINCIPDSEPERGSRKLPFYLVTEVESDMAVMQEEIFGPILPIITYQHIDEVFHYIAQRPRPLALYLFSEDKWLQKKFTQETLSGGLCINDVMLHVAQHDLPFGGVGESGMGHYHGREGFNTFSKLKPVMTQSRFALTPLFYSPYSGFAKSILNVMINRKIGNYESAIQQKLTSLLRIIGRDVS

SEQ ID NO: 18020 - protein, 489 aa, Vibrio vulnificus CMCP6
MCKTKIVATLGPASQTREKLTQLIQAGVNVVRLNFSHGSAEEHIARAEMVREIAQELNVSVGVLVDLQGPKIRIACFEQGSIQLKAGDPFILDGTLDREAGTQERVGLDYPELIDDLQVGNILLLDDGRIQLEVTAVDTQTRLVNTIALNGGKLSNRKGINLLGGGLSAPALTDKDKQDILTAAELKADFLAVSFPRNADDIEYARSLALQAGCHAHIVAKVERAEVVASEEAMDGVIRASDVIMVARGDLGVEIGDARLPGVQKALIARAKYLGKPVITATQMMESMIENPLPTRAEVLDVANAVLDGTDAVMLSAESAAGLYPVEAVAAMVRIAQGVEHETSCAQGCWDKLHHLCNDAGKSFALSSMISATKVHKDLGVAIVTQHGETPLLMSRCQSQATIWAVSNKPELLRKLAILRGVTPVYLPTLDKRGDIAHQLISLLGADAKQKQISSIMMTQLESVEGVGDMNVCRLLNLNETPITTAIAA

SEQ ID NO: 18021 - protein, 459 aa, Vibrio vulnificus CMCP6
MLNFFKTRPDAPLSDSSNEGMLKRYKNYQWQVFLGLIFGYAVFYVVRMSLGVVKKPMLDAGIVTIEELGIMGSAFFFTYAFGKFLNGFLSDYANIGRFMSCSLLVSGVLSVVMGMNTVGFFFVLLWGLNGWFQSVGSAPSCVSLYQWFSPKQRGSRYSIWGGSRNIGEGITWILTATLVSYFGWRAGFIGAGIAAVVAALIMLKVLKDRPQTYGLPDPGTAFGEGTEIKKANDPKETRRAQMFILKQPVVWLIALSCAAMYISRYAMSSWAVLFLQETKGYSLIDAGFAMSMYPTAGLAGAILSGILSDKVFKGNRNIPNLLYGLANIAGMCLMFFGPDNRVIDAVALSMIGFSIGGLVVFLAGLIACDLMPKNAVGAVKGLIGLCSYIAASAQELISASLITITEVDGVKHYDFGNAQYFWLAAGVVSVLLALTVWNAKKVVDIDEEQDKKLQTRTAS

SEQ ID NO: 18022 - protein, 461 aa, Vibrio vulnificus CMCP6
MNALHSETNNPKTLPEGLLKTITKLGFPVAIQSALVAILALADVLMVSDFGKEATAAVGIASKWHFIAIMIMAGLASANGTLVAQYWGKDDARSAKAVSLIALSFGLKVLIPVTLLITLGSQFIMMLQTNDQTVIGLGSVYLWYAFPVLLLTHIVIVIESSMRSSGDTVTPLIIGSLTIVINIALNYWLIKGGFGIPAMGVAGAALATSISRAIQVLLMLALMKLKQHWLLTTEASSERPSLWLSYRRLALPVTLGAVLWGIGTMAYQIIFGHMGTTELAVFSMLGPFESLCYAIFFGLSVACSVLIGQSLGRNEFERAQAMAAYFIKVVFIVGLSVGAFMLLNREWILAGLNLNTEELRPLAAPAVIILCCGIWIRMLNMTIINGIIRAGGDNIFCLRMDFIAMWMTGIPLCAFAAFIAGMEFKVVYSLMLAEEVVKLALCYRRYTQKFWIKNLTVVTTC

SEQ ID NO: 18023 - protein, 458 aa, Vibrio vulnificus CMCP6
MFGIFKPKAHIDRVSSDSLDSTYSRLRWQLFIGIFVGYAGYYLVRKNFSLAMPYLIEQGFSRGDLGVALAAVSIAYGLSKFLMGSVSDRSDPRYFLSAGLVMSSLVMFCFGFMPWATGSITAMFILLFLNGWFQGMGWPACGRTMVHWWSRKERGEIVSVWNVAHNVGGGLIGPIFLFGLWMFNDDWRTAFYVPAFFAMIVAVFIWLTVRDTPQSCGLPPIEEYKNDYPDDYNTSHETEMTAKEIFFKYVFSNKLLWSIAIANAFVYLIRYGVLDWAPVYLKEAKEFTVDKSSWAYFLYEWAGIPGTLLCGWISDKLFKGRRAPAGILFMFLVTLAVLVYWFNPAGNPGIDMAALVAIGFLIYGPVMLIGLYALELAPKKAAGTAAGLTGLFGYLGGAVAANAVLGYTVDHFGWDGGFIILVGSCITSIVCLTYALLGEKAHHDAKQKEKEKEQEAIA

SEQ ID NO: 18024 - protein, 329 aa, Vibrio vulnificus CMCP6
MPIEHCKLAWNAARAESQPSVKNMENVMQNIGFIGLGNMGAPMAENLLKAGHQVKVFDLNQAACEKLAQQGASVCANLEELAQDVSCVITMLPAGEHVRSVYLGTHQSDKGLLDLVIENSLLIDSSTIDPQSARLVGEEAAKRGLDFVDAPVSGGVAGAHAATLTFIVGGSDNAFARAETILKNMGKNIFHAGQAGDGQMGKICNNLMLGILMSGTCEALNLGIDNGLDPTVLSNIMLQSSGRNWALELYNPCPGVMENAPASRGYQPGFMSKLMLKDLGLGLDAAAKSQSSVPMGALARNLYAFHNAAGNEELDFSSLFEFYAKNNKE

SEQ ID NO: 18025 - protein, 443 aa, Vibrio vulnificus CMCP6
MWFKPFIQSYLVVFIGYLTMYLIRKNFNVAQNDMISTYGLSMTDLGLIGLGFSITYGIGKTVVSYYADGKNTKQFLPFMLILSGLAMLGFSFSMGGGSASLFLMVAFYALSGFFQSTGGPSSYSTITKWTPRNKRGSYLGLWNMSHNVGGAGAAGVALFGANYLFDGHVIGMFVFPSIIAIIVGFIGMRFGSDSPEAYGLGKVEELFDEAISEEDTAAEENQMTKKEIFVEYVLKNKVIWLLCFANIFLYIVRIGIDQWSTVYAYQELGLSKEAAISGFTLFEVGALVGTLMWGYLSDLANGRRALVACVSLALIIVSLEFYQHATSEFMYLASLFVLGFLVFGPQLLIGVAAVGFVPKKAISVADGVKGTFAYLIGDSFAKLGLGMIADGTPIFGLTGWKGTFAALDTSAMICIVLLAFVAIAEEKKIRHNKKKLELAASQS

SEQ ID NO: 18026 - protein, 446 aa, Vibrio vulnificus CMCP6
MFGLFQSPSYTQAPLDKSQVDERYRYWRLHIMIGMYIGYAGFYFTRKTFNYAAPAMIVDLGLDKGDLGLIGTLFYITYGLSKFISGTISDRSNPRYFMGVGLIASGIINIVFGFSSSLIALSILWVLNAWFQGWGWPSCSKLLTTWYSRSERGFLWAIWNTAHNVGGALIPLLVGYLTFHFSWREGFIVPGIIGVLLGLIVCWRLRDKPTTQGLPTVGQWRHDALELAQEKHGQGLSYHEILTHYVFNNKYIWLLAFSYVLVYIVRTAINDWGNLYLTEQHHYSLINANAALSMFEIGGFVGSLVAGWGSDKLFGGNRGPMNLLFAAGIFLSVAALWLMPLTNFAFQAAGLFSIGFFVFGPQMLIGMAAAECSHKDSAGAATGFVGLFAYMGAALSGYPLALILEEYSWTGFFVTISICAAVIGLLLLPFLQAQPSRKPLAPKLRL

SEQ ID NO: 18027 - protein, 141 aa, Vibrio vulnificus CMCP6
MIYRTWNNHKAAEVNFEKGQAFLLENSKKEGVITTESGLQYQVLEKGHGDKHPSASSKVKVHYHGMLTDGTVFDSSVERGSPISFNLNQVIKGWQEGLQYMVEGEKVRLFIPSTLGYGKGGSGPIPPASVLIFDVELLEIQ

SEQ ID NO: 18028 - protein, 345 aa, Vibrio vulnificus CMCP6
MSIQVSGLCKHFGQFTALNNVSIEFPSGGLVALLGPSGCGKTSLLRVIAGLERPDSGTVAIQNRDVSGLDIRERQVGFVFQHYALFRHMTIFENVAFGLRAKPKARRPNEATIKQKVNRLLQLVQLDWLADRYPAQLSGGQRQRVALARALAIEPQVLLLDEPFGALDAKVRKELRRWLRKLHDELHITSLFVTHDQEEALEVADHIVVMNKGQIEQIGTPEEIYRTPRTEFVYQFVGSSNRLYLEDSNGLSFTPSDVVSTHGKQAKRIYCRPHDFAVNTQHRPDAIPVAVARKLALGNMVRLEAYSLDNQQLVEVELSNHDPVLDEIQAKRHLWLTPKTVSQFA

SEQ ID NO: 18029 - protein, 348 aa, Vibrio vulnificus CMCP6
MRIEQELKLGFKDVLFRPKRSTLKSRSQVNLTREFTFKHSGRQWSGVPVIAANMDSVGSFEMAKALSQHGVMTAIHKHYTVQDWADFVKDADSETLNKVMVSTGTSEADFQKTKDVMALSDELIFICIDIANGYSEHLVQYVQQVRAAFPDKVISAGNVVTGDMVEELILAGADIVKVGIGPGSVCTTRVKTGVGYPQLSAIIECADAAHGLGGRIIGDGGCACAGDVAKAFGGGADFVMLGGMLAGHEESGGEIVLKDGESYMKFYGMSSKSAMDKHSGGVAGYRAAEGKTVLLPYRGSVHGTIQDILGGVRSTCTYVGAAELRELTKRTTFIRVLEQENNVFGKEK

SEQ ID NO: 18030 - protein, 495 aa, Vibrio vulnificus CMCP6
MDLRKALYTAKQVREGEVGAAANAGVTLYELMERAGRATFAVILNYYPAVSRLCVVCGKGNNGGDGYVVARLARQQGLHVVLIQSGNAESLSGDAKQAQQAWRDAGGEISDTASLNAALSDCDLVVDALLGTGLAGAVREKMAKVIDTVNLAGKPIVSVDIPSGLCADTGQALPDAIHADHTVTFIGTKQGLVTGKARAFCGAIHFADLGVGAEFSKLVPSFKMTIERDEIAQWRLTRDRCAHKGDHGRVVLLGGNRGMSGAISLAATACARSGAGLVAALTHPESALPLQIHCPEVMTLGYNEDKRELEKKLDWADVLVVGPGLGTDEWAKKRWNDIANFQGPMVLDADALNWLARYPNHNDRRIITPHPGEAARLLGCSVNEVEADRFAAISVLQSQYGGVVVLKGAGTLICDGTQTFACSAGNPGMATGGMGDVLSGVIGALLAQKLPLLRAASLGVLLHSCAADICATEKGEIGLLASDLFDKIRQLLNAD

SEQ ID NO: 18031 - protein, 242 aa, Vibrio vulnificus CMCP6
MSIQVKSVNKSYGSNQILHNISFECAKGETLVLLGPSGAGKSSLLRVLNLLESADNGQLTIANQAFDFASSPSEADGLLLRRKVGMVFQQYNLWPHLTVIENLIEAPIRVLGVAKAEAIEQAREILATLQLADKADAWPLQLSGGQQQRVAIARALMMKPEVLLFDEPTAALDPEITNQVVKIISGLSDTGITQVVVTHEVDFAKKIASHVLYLEKGHIVEHGTKQAFSEPQTRAFAEYLKH

SEQ ID NO: 18032 - protein, 506 aa, Vibrio vulnificus CMCP6
MIYAQPGSDNAVVNFKSHYDNYIGGEWVKPVSGEYFDNISPVNGQAYCKVARSSAADINLALDAAHSVRYQWAKTSVTERANILLKIADRIEAHLEELAVAETWENGKPVRETLAADLPLVVDHFRYFAGCIRAQEGSAAELDANTASYHFPEPIGVVGQIIPWNFPMLMAAWKLAPALAAGCCVVLKPAEQTPTSILVLMEKIGDLIPAGVVNVVNGFGAEAGQALATSDRIAKLAFTGSTEVGNHILKCAAESLIPSTVELGGKSPNIYFPDVFDHEDAYLDKCIEGTLLAFFNQGEVCTCPSRVLVHESIYDQFIAKVAERAKSIKQGNPLDTDTQVGAQASQEQFDKILSYLEIGRQEGAKVVFGGEIAKQEDDLASGYYIQPTLLQGHNKMRVFQEEIFGPVIAVTTFKDEAEALAIANDTEYGLGAGVWTRDQNLAYRMGRNIEAGRIWINCYHAYPAHAAFGGYKKSGIGRETHKMMLNHYQNTKNLLISYDVNPLGFF

SEQ ID NO: 18033 - protein, 230 aa, Vibrio vulnificus CMCP6
MSNTPLVELTNICKFYSSGEAEVRALDGVDLTIHQGEFLSILGPSGSGKSTLMNMLGCLDKPTEGEYQLAGQNVASLSANELASIRNQKIGFVFQSFNLLEYATALDNVALPLVYSGIKAKERRQRAAKLLAQVGLGDRLDHKPNQLSGGQKQRVAIARALVNDPQIILADEPTGALDSKSGAEIEALFNQLHAEGRTLIIVTHDNALAERTKRIITIKDGKVISDRAPS

SEQ ID NO: 18034 - protein, 364 aa, Vibrio vulnificus CMCP6
MSKLFEPTQLKHLDLQNRVAMAPMTRARTSQPGNIPNAMMATYYKQRASAGLIISEATQISDDSQGYSFTPGVYTDEQVAGWKRVTQAVKSQGAAMFCQLWHVGRVSHPVFQKGEQPIAPSALAPVETKVWIADEQGNGNMVDCVEPRAMTQDDIDRVVSDFAYAAKRAIEAGFDGVEIHGGNGYLIDQFLRTNSNHRTDQYGGSRENRIRFLLQVVDAVSQAIGADKVGVRLAPFITFKDMNCPDIVPTILEASKQLQARDIAYLHLSEADWEDAPEIPESFRIELREYFTNTIIVAGSYTQARADEVLEKGYADLVAFGRPFVSNPDLVARLKHQQPLAELDGATLFGGDERGYTDYTALHV

SEQ ID NO: 18035 - protein, 1043 aa, Vibrio vulnificus CMCP6
MFTATDVLKPEFVAQPLDKLWALISPLYMVDESQWLEQLLPLATPSAEEKQAIASRTTQLIEAIRADKKSIQLIDALLLEYSLDTHEGILLMCLAEALMRIPDAATADALIKDKMSVADWKSHLKNSESVFVNASTWGLMLTGKVVGLGDDETQSASQALNRLVNKLSEPVIRKAMYQAMKIMGHQFVRGRTIEEAQKNGRPMRDKGFTYSFDMLGEAALTTADANKYFKDYLMAIEAVGRETYGNDTSPAPSVSIKLSALHPRYEVANEHRVMSELFDTLAQLLKRAVELDVAITIDAEEADRLELSLKLFEKLYRSETVKGWGKFGLVVQAYSKRALPVLVWLNALAKEQGDLIPLRLVKGAYWDSEVKWSQQRGYDNYPVYTRKEATDVAYLACARFLLSDDVRGNIFPQFASHNAQTVSSIATMATHSDYEFQRLHGMGDSLYNHVMEQYRQPVRIYAPVGSHKDLLPYLVRRLLENGANSSFVHRLVDARCPVAELTKHPVEALTSFETLNNTKIPLPAAIFPERKNSYGVNVDIESEAKPFEAQVESFLSKQWLAGPIINGASLAESMIKDGQAESVTAPYDRRIQVGQIAFANLDHVSQAIDIAQAAFADWNRTPLVEKARCLDNLADLMEANLAELVALCHQEAGKTLHDSIDEVREAVDFCRYYAKQAQNLQPFELEGFDGVKRVASREGLGVFVCISPWNFPLAIFLGQVTAALVAGNTVVAKPAEQTSLIAVRAVELMLQAGFPAGVVQLIPGRGADIGSALTSHPAIAGVAFTGSTATAQRINVTLAQREAKPVPFIAETGGQNAMIVDSTALPEQVVRDVIRSAFASAGQRCSALRVLFVQQDIADRVIGLIQGAMNELSVGVPHRHKTDVGPVIDARAKEKLLLHIEQMNQTQRPIAQLTLADDCQHGDFVAPTAFEISGIDVLKEEQFGPILHIVRFKASELTRVVEQINQTGFGLTMGIHSRNETTYRWIEKHARVGNCYINRDQVGAVVGVQPFGGQGLSGTGPKAGGPHYLYRFTQVQFNQTENA

SEQ ID NO: 18036 - protein, 1203 aa, Vibrio vulnificus CMCP6
MNKQPLKLSVVAKAIMPLMATSLLIGCNSSNDGETANPQPDTGKVARVYFKASETATRAAADSSAYDQASLYVWNNDTCGGYAETDEGHDDWGTGIKPTGVDDKFGAYWDLQVRSEATQCINFIPRVDGAKPLGDFDAKLDLTQTGKNNAVYTQQGVAAVYPELISTSDIPANTARVYMNTPDGDEGHFTLHVWNNDTCGAFDGNDTSWPGMEPTGFSDVYGPYWDLPVKGAEGCINIIPNNKSNGDYQTENLKFEFDKTTAIGNVAFVFKGTNKVYYTALAQKPVAQVELAGASAIFADDSVILVNAKDATSVTLYYSENGELAFDSASKKVTGATKQISSSKAASSDWNKTKPHLSNDFIGFEMDFSGEGNALKDLLKGQLILVASDATGVIKATEVQPASALDALYAAAATKLSYGAVINPDSTTTFRLWAPTAQNVKLIPYNAEKQAQTAIAMTFDATSGAWVAANTALKHGDFYRYEVTVYHPATDKVETYQVTDPYSLSLSMNSEYSQVVDLTNAELKPSGWDALAAPHNQANPAEFVLYEAHIRDFSALDDSTAEANRGKYKAFTQAGTAPVEHLKKLAQSGVTHLHLLPTFDIATINEDPTKVANINQPFAKLCELDASVKNDADFGNYCDSNETLSTVFETLAKKDSKESAVVQRLNSHVRNLDSFNWGYDPFHYTVPEGSYSSDAEGMVRIKEFREMVMSVKKEIGMNVVMDVVYNHTNESGVSSKSVLDRIVPWYYQRLNEFSGAVEQSTCCSNTAPENQMFAKLIDDSISTWVKEYKIDAFRWDLMGHHPLAQMQQTLAAAKAVDPNVYFYGEGWNFGEVGSDRMFKQATQLNLAGTGIGSFSDRLRDAVRGGGPFDSQDSLRSNQGFGNGIYVQVNEKNEQNAALKTTALHLADLTRLGMAGNLKAFPFTDSKGKAITGAELDYNGQPAGYAQDAWEIQNYVSKHDNQTLWDNNQYKIAYATTAAERTRMQAVGLSTAMLGQGVPFIHMGSELLRSKSMQRDSYDSGDWYNRVDFTKQDNNWNVGLPREDKDGSNWAIIDAVITGSSDRAMPSATDIDNMDKFFNELAALRASSGLFTLGKGSEIIKRVAFHNTGAEQTPGLIVMSIDNSGDNHDATIDATRDGVVIVVNASPTMVSDFAKFDATGYTLHAVQTNAGNDSLAKNQDKAAQVVNGKLTVPAWSVAVFEKLR

SEQ ID NO: 18037 - protein, 454 aa, Vibrio vulnificus CMCP6
MTITNPFNDEVIGTVPNMGEKETQEVIAGADKAFQQFKALTAQERANLLHRWHQLILEHSDELAHIMTLEQGKPLAEAKGEVLYAASFIEWFAEEARRAYGTLVPSHKANAKILVTKEPIGVVAAITPWNFPAAMITRKCGPAFAAGCPVILKPAPDTPFTALALAVLAEKAGFPAGVFNVITGDAVAIGGELTSNKRVRKLSFTGSTPVGKLLMRQSADNIKKLSLELGGNAPFIVFEDADLDAAVEGAMIAKFRNAGQTCVCANRLYVQRSVYSEFCQKLVAKVSALKVGNGFDQGVHIGPLINDAAVAKVVQHVEDAQSKGAQIECGQLPTAGSRLVQPLVLSGVTDEMLVAQEETFGPMAPLFVFDSEEEVLARANNTDFGLAAYFYTQSLSRAWRMSEALEAGIVGINEGLISTTVAPFGGVKESGLGREGSFLGMDDYMESKYILMGL

SEQ ID NO: 18038 - protein, 449 aa, Vibrio vulnificus CMCP6
MNKYQLPQDSQLRQADFLFGVATSSYQIEGGAQLGGRTPSIWDTFCNQPGAVDNMDNGDVACDHFHLWQQDIALIQGLGVDAYRLSMAWPRILPKDGQVNQQGLEFYERIIDECHARGLKVFVTLYHWDLPQYLEDKGGWLNRETAYKFAEYAKVVSGYFGNKIDSYATLNEPFCSAYLGYRWGIHAPGKKGEREGFLSAHHLMLAHGLAMPIMRKNAPQSMHGCVFNATPAYPYREQDVAAAEYSDAEGFHWFIDPVLKGEYPQSVLERQAHNMPMILDGDLDIIRGDLDFIGINFYTRCVVRFDANGDLESMPQPDAEHTYIGWEIYPQALTDLLLRLKQRYPNLPPVYITENGAAGEDACINGEVNDEQRVRYFQSHLLALDEAIRAGVNVQGYFAWSLMDNFEWAYGYKQRFGIVHVDYATQKRTLKQSAIAYRNTLLARAEEKQ

SEQ ID NO: 18039 - protein, 365 aa, Vibrio vulnificus CMCP6
MARVEFRDIKKSYDDVEVVKHFDFTVEDGEFVVFLGPSGCGKSTTLRMLAGLESITSGEIYVGDKLMNKIDAKDRDLAMVFQSYALYPHMTVYENIAFALKLKGMAKAQIDVEVRKAAKMLELEALLDRKPKELSGGQRQRVAMGRAMVRTPKVFLFDEPLSNLDAKLRGTMREEIKQLHRELKTTTIYVTHDQIEAMTLADRIVILKDGYVAQVGTPTEVFKRPANKFVAQFIGNPSMNMLEAKLVGEEGNWHIALGEVTIPLPERFHAHASKNLALHFGIRPTDIHLRAEQVAHERVLPIEVAIKDKELLGASILLKTEVAGQPLMVETQAAEVDVRQLTLYLDLDAIHLFDALSEKSLASFG

SEQ ID NO: 18040 - protein, 382 aa, Vibrio vulnificus CMCP6
MSDPIIIIGSGFAAYQLVKSVRRLDAHIPIQIFTADDGAEYNKPDLSHVFSKRQTAADLVVKSGEAFAEEYNVQLHAHTQVERVLTQQQQVVANGRCYPYSKLVFATGAQAFVPPMRGDGLAKVMTLNSLQEYQAAEQPLSRAQHVLVIGGGLIGVEIALDLATSGKQVTVVEPNARLLANLLPEFIALPLEQQLMKHGIQLALNSRVESVTEQGQTLAIALHDGREFAVDAVLCAAGLKANTAVAREAGLSVERGICVDHQLNTSDPHIYALGDCAQIEGRMLPYLQPIVLSANVLAKQLVGQEARLTLPPMMVKVKTPSYPIQLAGDFSPESHWQVQLSPEGIVAKAQSPLGDFTGFVVTGEYVTQAFPLLRELSQRANG

SEQ ID NO: 18041 - protein, 1399 aa, Vibrio vulnificus CMCP6
MIQIVIDGKYRIVEAGQTVLQAAKVCGVEIPSLCGMNRSGEKIPCDLCVVEVESGGTRRACELEVYNGLTVNTQSEALSAHRKQALNRIMSDHYADCEAPCKTACPAGVDIQSYLYHIAQNDHQKAIEVIKRTLPMPLSIGRVCPAFCESECRRSLVDDAIAIRQLKRHAADADLAAQEAYTPEKKADKNKRIAIVGSGPGGLTAGYYLTNEGYQVDVFEAMPQAGGWLRYGIPEYRLPKSILDKEIALMCRNGMAIHTDKKLGRDISLSQLSQDYDAVCLAVGASKAVAMDYPGSDLDGCYLGVDYLKDFVTEQRFTTGKKVAVIGGGNTAIDCARTAVRTGADTTLIYRRTRDEMPAEDYEIEEAEHEGVKFHFLTNPAQNIADGDGRVCSVKLEKMALGAPDASGRRRPEATGEYFTEAFDTVIAAVSQQADLSFMQGEALTLPLTRWNTADANPETMHSGTGNIFSIGDFRRGPATAVEAVADGRIAAQAIDRFFDGDMENIPLKPFNSRKEQKLKQVDPLHFSHLQKVARTIMPELTSQQREQSFEEVELGFDNAEAMAEAARCLECGCQVNTSCDLRDYATEYGAEQHFHYSVNIKSHDEWQALRQNDPRHKYPIDHSSEFIVFDANRCISCGQCIQACREQSVQGVLSFMNLEKGRPVVRPDCRPNFGGQGVRMGDSRCVQCGACVQACPVGAMTDARDRSQGRETPLKKVDTICTYCGVGCKLTMHVDEAANRIRYVEGAHSPVNEGMLCVKGRYGFDFVASEERLTTPLIRKDGWLQPASWQEAISLIADKFSTIKQDFGGRALAGFSSAKTTNEDNYAFQKFMRRELGTNNVDHCARLCHASTVTGLEASLGSGAMTNDIPSIKHSDVIFIIGSDTSAAHPVIASHIKQAVRHHGARLIVADPKRIGMADHAELYLAHRPGTDVMLINGVMQQIIKNGWYDMEYIEERVDGFDTMLQEVMSPAYSLDKVELVTGVKANDIFAMARMIGTAKRTAVYYSMGITQHTTGHDNVRSIANLQLLCGNIGIEGGGINPLRGQSNVQGACDMGALPNNYPGYQKVYNPLVREKFVIEWDAPNLSAEPGLTLTEIIDGACRRDVRALYVMGENPVLSDPNQAHVIEGLEALDFLVVQDIFLTETAQYADVVLPSCSFAEKSGHFTNTERRVQRIYPAVNPPGEAKEDWRIIQEIANAMGSDWHYRSVADITNEITRVTPQYAGLKWDNITREGVQWPSNKNNPAGTRIMHQTQFTRGKGQMEAIPFRYAAELPDEEYPLVLTTGRVLEQFHTGTMTRKTQGLNNLAGPRAMISVQDAEALGIGNGDMLKVSTRRGEIEIAAFVTKRMQAGVVFIPFHFVESPVNRLTTTATDPHAKIPEFKVAAVRVEKLHTALVE

SEQ ID NO: 18042 - protein, 343 aa, Vibrio vulnificus CMCP6
MKIKALSKLKPEEGIWMTEVDKPVLGHNDLLIKIKKTAICGTDVHIYNWDEWSQKTIPVPMVVGHEYVGEVVGIGQEVRGFEIGDRVSGEGHITCGHCRNCRGGRTHLCRNTIGVGVNRTGCFSEYLVIPAFNAFKIPANISDDLASIFDPFGNAVHTALSFDLVGEDVLITGAGPIGIMAAAVAKHVGARHVVITDVNEYRLDLARKMGVTRAVNVAEQKLDDVMAELGMTEGFDVGLEMSGNPSAFNSMLKTMNHGGRIALLGIPPSDMGIDWNQVIFKGLVIKGIYGREMFETWYKMASLIQSGLDLTPIITHHFKVDDFQQGFDIMRSGMSGKVILDWE

SEQ ID NO: 18043 - protein, 291 aa, Vibrio vulnificus CMCP6
MDVKKVAFIGLGVMGYPMAGYLSKAGYETRVYNRTFAKAQKWAEQYQGAAFETPREAALGCDVVFVCVGNDDDVRSVVYGEDGVLAGLEPGAILVDHTTTSAELAVELADACQKVSNAFIDAPVSGGQAGAENGVLTIMCGGDESVFAQVSPVMDAYAKQATLLGENGQGQRCKMVNQICIAGVLQGLSEAILLAQKSGLDVAQVVDTLKHGAAGSWQMENRATTMAQDKFDFGFAIDWMRKDLGFCLKEAQRVGLELPLTKQVDQQYAQLQQDGLGRMDTSVLIKAVAKH

SEQ ID NO: 18044 - protein, 459 aa, Vibrio vulnificus CMCP6
MTQNIKPTHFRSEGDVNTTPARQAWNASMDDESTQALLKRDSEVFLHQAMSTPCLDTLEAAEGIYIQDATGKKYMDFHGNNVHQLGYGHPHVINRVQEQIAKLPFSPRRFTNETAIECAEKLTQICGGELNRVLFAPGGTSAVGMALKLARHITGNYKVVSLWDSFHGASLDAISVGGEACFRQGMGPLMAGVERIPPAVSYRGAFPVADGSDVHYADYLEYVIEKEGGVGAFIAEAVRNTDVQVPSKAYWKRIREICDKHNVMLIIDDIPNGMGRSGEWFTYQAYDIEPDMLCIGKGLGGGLVPIAAMVTKDKYNTAEQISMGHYTHEKSPIGCAAALATMEAIEQEGLLDKVKVDSQFMREKLLEMKAKYPVIGDVRGIGMLWGIELVTDHESKARAYDEAEAVLYQCLNNGVSFKVSQGNVIQLSPPLIITREQLTEALAIFEEAIAKVCKDFNYF

SEQ ID NO: 18045 - protein, 486 aa, Vibrio vulnificus CMCP6
MEVTAHYIGGKPFVGDTGESFATLNPATGEVLAHIEQADERVLGHAIESAKLGFSVWSSMSAAERSRCLLKAAQLIRDHNDELAELEVRDTGKPIQEASVVDIATGADVIEYFAGLVNGLGGEQQSLGSNQFFYTRREPLGICAGIGAWNYPIQIAMWKAAPALAAGNAMIFKPSEETPLSALKLAELFTQAGVPDGVFNVVQGDYRVGQMLTAHPEIDKVSFTGESGTGKKVMADSAATLKPVTMELGGKSPLIIFDDADLDDAVSAAMVANFYTQGEVCTHGTRVYVQRAMYDAFVEQLKERTEKLIVGDPMNMETQIGSLISKSHLEKVLGAISSAKESGATLLTGGFQVTERGLEKGCFVAPTVFVDCRDEMPHVQNEIFGPVMSVLVFDDEDEVIARANNTQYGLAAGVFTQNLSKAHRVIHQLQAGICWINTWGNSPAEMPVGGYKLSGIGRENGQETLLHYTQTKSVFVELGAFDSPYA

SEQ ID NO: 18046 - protein, 273 aa, Vibrio vulnificus CMCP6
MNSKINDPKNDEAVVVTGLKMGYGEKILLENASFSVKRGEILVILGGSGCGKSSLMKHIIGLYEPISGDITINGKSIVGAGETEKASIQRQLGVMYQSGALFGSLSILENVRFPLDQFTDLGMAEKNKISRTLLELLEMGYSAELMPSQLSGGMLKRAGIARAMAIGANILILDEPSAGLDPITAANLDQTILNLRESLGYTFIIVTHELQSIFSIADRAIMLDPLSKSIIAEGHPSDLRDQSSDTRVRQFFNRKPDVQKSDEQKEESELSNG

SEQ ID NO: 18047 - protein, 440 aa, Vibrio vulnificus CMCP6
MKVVVVGGSAAGMSFAAKYKRNQPSDEVIVLDKRDYISFGACGLPYFAGGMFDDTERMISRTPEQAIKSGLDVRIETEMVALERIEKQITVRHQGEETILDYDMLVIATGARPIIPSFGEFNPEHVYTLTSMEDGLAVKQALKDSNKQRVCVIGGGFIGLEVFDAAHLLGKHVTIIEREQHVMSRQFSPEMIDVVEGAIRESGAELKTSCSVSAIRDAEQGGYLVETDNGSVAADVVIMSLGFKPNTEAFELPKAANGALLVDEFGATEDEHIYAVGDCAVVHHMALGKTVYVPLATTANKQARMMADKLAGKDTYMNGFLGSSCLKVLDYELACTGVSELLAKEHGLDVRVSTISDKNQTDYYPGQEDIKVKLVYHPETKVLLGGEIVGKKGAVGRINALAVAITAKMTTQQLGYMDFCYAPPFARTWDALNVAGNVAK

SEQ ID NO: 18048 - protein, 214 aa, Vibrio vulnificus CMCP6
MRIILLGAPGAGKGTQAQFIMEKYGIPQISTGDMLRAAIKAGTELGKQAKAVIDAGQLVSDEIILGLIKERIAQEDCAKGFLLDGFPRTIPQADGLKEMGVAVDYVIEFDVADDVIVERMAGRRAHLPSGRTYHVVYNPPKVEGKDDVTGEDLVVRDDDKEETVRARLGVYHSQTAPLIEYYGKEAAEGNTKYLKFDGTKQVAQVSADIEKALA

SEQ ID NO: 18049 - protein, 300 aa, Vibrio vulnificus CMCP6
MSNGKVLAKIEARNPSFSVKCRIGANMIWEAEKEGKLKPGVELVEPTSGNTGIALAFVAAARGYKLTLTMLESMSLERRKLLKALGANLELTEAAKGMKGAIAKAEEIVASNPEKYLLLQQFNNPANPEIHEKTTGPEIWEATDGAIDVFVAGVGTGGTITGTSRYIKGEKGKQILSVAVEPTESPVISQALAGEEIKPAPHKIQGIGAGFIPGNLDLSLIDRVEKVTSEEAIEMARRLMEEEGILAGISSGAAVVAANRLAELPEFEGKTIVTVLPSSGERYLSTALFAGIFTEKENQQ

SEQ ID NO: 18050 - protein, 158 aa, Vibrio vulnificus CMCP6
MANCQRLNKALLADSTATSVGALLGTSNTTSYIESVSGVAAGGRTGLTAVVVGVLFLLALFFSPLAGMIPAYATAGALFYVAILMLSGLVSIDWRDLTEAAPVVVTCLLMPLTFSIAEGISLGFIAYAAIKLFSGKGRDVSLSVWIMSAIFIIKYLVA

SEQ ID NO: 18051 - protein, 376 aa, Vibrio vulnificus CMCP6
MTQDKFIKSRAAVAWGPKQPLSIEEVDVMLPRKGEVLVRIVATGVCHTDAFTLSGDDPEGVFPAILGHEGGGIVEMVGEGVTSVSVGDHVIPLYTAECGQCKFCLSGKTNLCQAVRETQGKGLMPDGTTRFYKDGKPIFHYMGCSTFSEYTVLPEISLAKVNKEAPLEEICLLGCGVTTGMGAVINTAKVKQGDTVAIFGLGGIGLSAIIGARMAGASRIIAVDINDRKFELAKQLGATDCINPKEHAQPIQEVIIEMTDGGVDFSFECIGNVNVMRQALECCHKGWGESVIIGVAGAGQEISTRPFQLVTGRVWRGSAFGGVKGRSQLPAIVEQYLAGEFGLQEFITHTMPLEGINDAFELMHSGESIRSVVHFE

SEQ ID NO: 18052 - protein, 487 aa, Vibrio vulnificus CMCP6
MLRIAKEALTFDDVLLVPAHSTVLPNTADLRTQLTKNITLNIPMISASMDTVTEARLAIALAQEGGIGFIHKNMSIEQQAAEVRKVKKFEAGVVTDPVTVSPDATIADVVALTDKHGFAGFPVVTESNELVGIITGRDVRFVTDLSKKVSSVMTPKENLAAVKEGATRAEVQEKMHEARVEKVLVVNDDFQLTGMITAKDFHKAERKPNACKDAQGRLRVGAAVGAGAGNEERVAALVEAGVDVLLIDSSHGHSEGVLQRIRDTRAAFPNLDIIGGNVATAAGAKALIEAGVSAVKVGIGPGSICTTRIVTGVGVPQITAIADAAEVANQYGVPVIADGGIRFSGDICKAIAAGASCVMVGSMFAGTEEAPGEVILYNGRSYKAYRGMGSLGAMSQGSSDRYFQSDNAADKLVPEGIEGRIAYKGRLKEIVHQQMGGLRSSMGLTGSATIEEMRTKAEFVRITGAGMQESHVHDVQITKEAPNYRLG

SEQ ID NO: 18053 - protein, 171 aa, Vibrio vulnificus CMCP6
MNHFELFGLPPQFSLDGSLLSSQFRELQKRFHPDNFATASERDRLLAVQKAAQINDAYQVLKNPISRAEYLLSQNGLEIRGEQQTMQDPMFLMEQMELREELEEIPHGSDAESALAAFDARVSKMYKQHLATIEQELNDAQWPQAADRVRKLKFIAKLKNEIELVEEKLFG

SEQ ID NO: 18054 - protein, 392 aa, Vibrio vulnificus CMCP6
MTEQPLSLDEIRLRLNDLDDQLLSLLSERRKLSIEVAKSKVETSKPVRDASREQQLLVKLITNGREKYQLDAQYITKLFHTIIEDSVLLQQSYLQNLLNPEQSRKPLARVAFLGSKGSYSHLASREYFSRKNTELIELNCDHFKEVTQTVESGHADFGVLPIENTSSGSINEVYDLLQHTTLYIVGELTQPIEHCLVATKDVRLEEIKVLYSHPQPHQQCSEFLGRLKGVTLKSCASTADAMKKVQELNRDDVAAIGNASSGKLYGLQPIQGNIANQTENHTRFIVVARKPVEVSAQIPAKTTLIMSTSQKAGSLVETLLVLQRYGINMTKLESRPIMGNPWEEMFYVDLEAHLDSEEMQLALGELTKITKHLKVLGCYPSENVKPTQVKLS

SEQ ID NO: 18055 - protein, 172 aa, Vibrio vulnificus CMCP6
MIDGDGYRLNVGIVICNNHGQVFWAKRYGQHSWQFPQGGIDDGETPEQAMFRELYEEVGLTHKDVKIIASSRHWLRYKLPKRLVRWDSKPVCIGQKQKWFLLRLECDESKINMQKGSSPEFDGWRWVSYWYPVRQVVSFKRDVYRRAMKEFASLAMPFRERKLKGKKVKRRG

SEQ ID NO: 18056 - protein, 344 aa, Vibrio vulnificus CMCP6
MQYTKLPHSTLEISKLCLGTMTFGEQNSQQDAFEQLDYAVAQGINFIDTAEMYPVPPKAQSQGLTEQFIGNWLSKSGKREKVLIATKIAGPRNVPYIRDNMSLNRRHIHTAIDDSLTRLQTDYVDLYQLHWPQRQTNCFGQLNYPYPDAQEEVTLIETLEALNELVKAGKVRYIGVSNETPWGVMTLLRLAEKHDLPRIVSIQNPYNLLNRSFEVGLSEISHYEGVQLLAYSPMAFGTLSGKYLDGARPKGARCTLFERFQRYFTPQGLEATKAYVSLARDYGLDPAQMALAFVNQRPFVASNIIGATTLDQLKANIESLNVKLEDEVLNKIQQIGTTYSNPCP

SEQ ID NO: 18057 - protein, 160 aa, Vibrio vulnificus CMCP6
MKDITPDICDQHEDKVTLLNLPLQNFGQKAAFFGEIVTVRCYHDNSKVRDVLSENGKGKVLVVDGHGSCQKALLGDQLAILAIENDWEGVIVFGAVRDVAQMSQMELGIKALGTSPFKTEKRGAGEVNVTLTMHNQMVQPKDYIYADWNGILISKELLQF

SEQ ID NO: 18058 - protein, 489 aa, Vibrio vulnificus CMCP6
MGKPTGFLEFGRELPKKLAPAERIKNNKEFVLNAEFGKKINTQASRCMDCGVPFCHNGCPIGNIIPEFNDAVYRDSWEEAWNILSSTNNFPEFTGRVCPAPCESACVLGINQDPITICNIEKTIVETAYREGYAKPKTPRSRTGKKVAIIGSGPAGLAAAEQLNSAGHSVTVFERDEKVGGLLRFGIPDFKLGMDIIDRKINLMAEAGVEFKVNQHVGVDVNAQQIRQEYDVVLLTGGSTVPRDLPVPGRELKGVYFAMQFLAQNNRRANEMDLKGEEIHAAGKHVVVIGGGDTGSDCVGTSNRHGAASVTQVEIMPVPPEKRPANMPWPQYPMILRTSTSHEEGVDRHWNILTKEFIGNDKGEVTGLRLADIVWQDAQPGERPSFKEVEGSERVIPCDMAFLAMGFLHPEPHGVLAQLNVALDERGNVATQDFQTNQQGVFAAGDMRTGQSLVVRCINEGRECARAIDQYLMGNTNLEAKADSLMLSA

SEQ ID NO: 18059 - protein, 472 aa, Vibrio vulnificus CMCP6
MNMSQNVYQFIDVQRVDPAKKPLQIRKIEFVEIYEPFTKQQATAQADRCLDCGNPYCEWKCPVHNYIPQWLKLANEGRILEAVELSHQTNSLPEVCGRVCPQDRLCEGSCTLNDDFGAVTIGNIEKYITDKAFEMGWKPDMSKVEWTDKKVAIIGAGPAGLAAADILVRNGVKPVVFDRYPEIGGLLTFGIPSFKLEKGVMENRRRIFSEMGVEFRMNVEVGKDVQMQELLEEYDAVFLGVGTYKYMRAGLENEDASGVYDALPFLISNTYKVMGLEHDQPFIDMAGKNVVVLGGGDTAMDCVRTSIRQGAANVVCAYRRDEENMPGSRREVKNAKEEGVNFMFNLQPLSIDVDTRGQVTGVKVVQTALGEPDEAGRRRPEPVAGSEHVLPADVVIMAFGFQPHQMSWLEPYGVELDQWGRIKAAAKQTYQFQTSNEKIFAGGDAVRGSDLVVTAIDEGRKAAEGILDYLEL

SEQ ID NO: 18060 - protein, 470 aa, Vibrio vulnificus CMCP6
MKKTKIVCTIGPKTESVEKLTELVNSGMNVMRLNFSHGDYVEHGTRIANFRQVMENTGKQLAILLDTKGPEIRTIKLENGDDVDLVAGQEFTFTTDTSVVGNKDIVAVTYPGFAADLSAGNTILVDDGLIEMEVIATTATEVKCKVLNNGALGENKGVNLPGVSVNLPALSEKDKNDLKFGCEQGVDFVAASFIRKASDVKEIREVLAANGGANIQIISKIENQEGVDNFDEILELSDGIMVARGDLGVEIPAEEVIFAQKMMIEKCNRARKVVITATQMLDSMIKNPRPTRAEAGDVANAIMDGTDAVMLSGETAKGKYPVEAVTIMAQIANRTDSVLKAELGSRLDSPRLRITEAVCKGAVDTAEKLAAPLIIVATEGGKSARSVRKYFPTANILALTTNKKTAAQLVLTKGVTPVVVDSIDNTDAFYVTGKELALESGLGSKGDIVVMVSGALVASGTTNTASVHVL

SEQ ID NO: 18061 - protein, 267 aa, Vibrio vulnificus CMCP6
MSHNDLVTIHGLTFSRGQRKIFDNIDLRIPKGKVTAIMGPSGIGKTTLLRLIGGQILPESGEIWFDGVNIPSLSRSKLYHARKKMSMLFQSGALFTDLNVFDNVAFPLREHTQLSDSLIRTLVLLKLEAVGLRGAAELMPSELSGGMARRAALARAIALDPELIMYDEPFVGQDPITMGVLVELIRNLNSALGVTAVVVSHDVPEVMSIADWVYLLADGKVIAKGTPEELRNNSDPRVQQFLLGEADGPVPFRFPAQPIEKDLFHDA

SEQ ID NO: 18062 - protein, 186 aa, Vibrio vulnificus CMCP6
MGQQLAGSGLDGLNVAAIAAGIATSLTGDMPAVEVDEINKALHELYTRAESARAEAAKAAAADGEVFLKDNALRPEVTVLESGLQYEIITEGNGEIPTSDKTVRVHYHGELVDGTVFDSSVSRGQPAQFPVTGVIKGWVEALQLMPVGSKWKLYIPHDLAYGERGAGASIPPFAALVFEVELLDIV

SEQ ID NO: 18063 - protein, 469 aa, Vibrio vulnificus CMCP6
MSVENVLSLIQENEVKFVDLRFTDTKGKEQHISIPSHQIDADFFEDGKMFDGSSVAGWKGINESDMVMMPDASSAVLDPFTEEATLNIRCDILEPATMQGYDRDPRSIAKRAEEYMRSTGLADTVLVGPEPEFFLFDDVKFATDMSGSFFKIDDVEAAWNTGSDYENGNKGHRPGVKGGYFPVAPVDSSQDLRSAMCLVMEEMGLVVEAHHHEVATAGQNEIATRFNTLTTKADEIQIYKYVVHNVAHAFGKTATFMPKPLVGDNGSGMHVHQSLAKDGVNLFAGDKYGGLSEMALYYIGGIIKHARALNALTNPSTNSYKRLVPHYEAPVMLAYSARNRSASIRIPVVPSPKARRIEVRFPDPAANPYLAFAAMLMAGLDGIKNKIHPGEAMDKDLYDLPAEEAAEIPKVAESLKQALEYLDNDREFLTAGGVFSDDFIDSYIELKTKEVERVNVAVHPLEFELYYSV

SEQ ID NO: 18064 - protein, 245 aa, Vibrio vulnificus CMCP6
MIKLDNIHKRFGDTEVLKGIDLTINQGEIIVIIGSSGTGKSTLLRCVNFLEQADQGKITIDDISVDSQQHTKAEVLALRRRTGFVFQNYALFAHMTARQNIAEGLVTVRGWKKEDALKRAQQILDDIGLGEKGDSYPAALSGGQQQRVGIGRAMALQPELLLFDEPTSALDPEWVGEVLSLMKKLANQHQTMLVVTHEMQFAREVADRVIFMAEGKIVEQGSPQDIFGNPQDPRLQKFLRQVGME

SEQ ID NO: 18065 - protein, 451 aa, Vibrio vulnificus CMCP6
MATHFDYICIGGGSGGIASANRAAMYGAKVALIEAKDLGGTCVNVGCVPKKVMWHGAQIAEAMSLYAPDYGFDVEVKGFDWSKLVESRQAYIGRIHQSYDRVLGNNKVNVIKGFAKFVDEKTVEVNGEHYTADHILIAVGGRPTIPNIPGAEYGIDSNGFFDLAEQPKRVAVVGAGYIAVEIAGVLNALGTETHLFCRKESPLRSFDPMIIDTLVEVMAAEGPTLHTHSVPKEVVKEADGSLTLHLENGESQNVDQLIWAIGRHPATDAINLSATGVATNERGYIKVDEFQATNVAGIYCVGDIMEGGIELTPVAVKAGRQLSERLFNNKPNAKMDYDLVPTVVFSHPPIGTIGLSEPEAIAQYGEENVKVYTSGFTAMYTAVTQHRQPCKMKLVCAGEDEKVVGLHGIGFAVDEMIQGFGVAMKMGATKADFDSVVAIHPTGSEEFVTMR

SEQ ID NO: 18066 - protein, 466 aa, Vibrio vulnificus CMCP6
MAHANHFDVIVIGSGPGGEGAAMGLTKAGLKVAVVEKESSVGGGCTHWGTIPSKALRHAVSRIIEFNSNPLFCKNNSSLHATFSTILGHAKSVIDKQTRLRQGFYDRNQCQLIFGTARFTDAHTISVTQNDGTEEVYTADKFVIATGSRPYQPADVDFNHERIYDSDSILSLKHDPRHIIIYGAGVIGCEYASIFRGLGVKTDLINTRDRLLAFLDNEVSDALSYHFWNSGVVIRNDETYERIEGTEDGVIVHLQSGKKMKADCLLYANGRTGNTDKLNLPAVGLQGDSRGQLKVDGNYQTEVEHVYAVGDVIGYPSLASAAYDQGRFVAQAITKGKADGYLIDDIPTGIYTIPEISSVGKTEQELTAAKVPYEVGRSSFKHLARAQIAGKDIGSLKILFHRETKEILGIHCFGERAAEIIHIGQAIMEQKGEANTIEYFVNTTFNYPTMAEAYRVAALNGLNRLF

SEQ ID NO: 18067 - protein, 403 aa, Vibrio vulnificus CMCP6
MTVEMKVERGLFDEVMVPCYNPMEMIPVKGQGSRIWDQNGNEYIDFAGGIAVSCLGHCHPVMVNALTEQAGKLWHLSNVMTNEPALRLAKKLTEVSFAERVFFANSGAEANEAALKLARRYAADVYGPEKSEIIAFKQGFHGRTFFTVTVGGQAAYSDGFGPKPGDVTHLPYNDIEALQAHISDRTCAVMMEPLQGEGGIIPPTAEFIQAVRELCDKHNALLVFDEVQTGNGRTGEFYAYQGLGVTPDILSTAKSLGGGFPIGAMLTTAKLAEHLKVGTHGSTYGGNPLACAVAEAVVTEVSKPETLQGVKEREQWFREGLAKLNEKYQIFAEIRGKGLLLGAALNEQWKGRARDVLVAAGKEGLLVLVAGANVVRFTPSLVITKQEIEEGFAKLDKAIASLV

SEQ ID NO: 18068 - protein, 260 aa, Vibrio vulnificus CMCP6
MKSVLKVSLLAATVMLAVGCQKEEAKPAAAPQAEQVQAETGKAVHFKSEDDKAAYAIGVSFANYLSASLDKPSEIGINLNKDLVLKGIEHVFAGNPELNEEETRAALEALDKRVAETMQKKAAEKAEAAKKAGDEFRAEFEKQEGVVKTDTGLLYQVITPAEGEKPKDTDTVQVHYKGTLTDGTQFDSSYDRGEPATFPLNRVIPGWTEGVQLMPVGSKFKFVIPPELAYGAQDTPSIPANSTLVFEVELLKIENGDNAQ

SEQ ID NO: 18069 - protein, 256 aa, Vibrio vulnificus CMCP6
MRRPVVMGNWKLNGSKTMVAELLTGLNAELEGVEGVDVAVAPPALYIDLAERLIAEGGNKIILGAQNTDINNSGAFTGDMSPAMLKDFGATHIIIGHSERREYHNESDEFVAKKFAFLKENGLKPVFCIGETEAQNEAGETEAVCARQINAVIDAYGVEALNGAIIAYEPIWAIGTGKAATAEDAQRIHASIRAMIAAKDAAVAEQVIIQYGGSVKPENAEAYFAQPDIDGALVGGASLDAKSFAAIAKAAAKMKA

SEQ ID NO: 18070 - protein, 161 aa, Vibrio vulnificus CMCP6
MDQVDVVEPMFSNFGGRASFAGQITTVKCFEDNALIRETLEQDGVGRVLLVDGGGSLRRALLDGELAAIAEENEWEGIVVYGCVREVDELEDMNIGIQALASIPVGAAMQGVGEVDVPVNFGGVTFLPEDYLYADTTGIILSQEPLSADLEEDEEEPELLD

SEQ ID NO: 18071 - protein, 222 aa, Vibrio vulnificus CMCP6
MKDFLIAPSILSADFARLGEDVEKVLAAGADVVHFDVMDNHYVPNLTFGAPVCKALRDYGITAPIDVHLMVKPVDRIIPDFAKAGASMITFHIEASEHVDRTLQLIKEHGCKAGVVLNPATPLAHLEFIMDKVDLILLMSVNPGFGGQSFIPHTLDKLRAVRKMIDATGRDIRLEIDGGVKVDNIREIAEAGADMFVAGSAIFGQPDYKAVIDEMRAELAKA

SEQ ID NO: 18072 - protein, 306 aa, Vibrio vulnificus CMCP6
MKPTKELLNEILHEVRPLIGRGKVANYIPALARVPAHKLAIAVYTNQGEVIKAGDADEAFSIQSISKALSLTLAMGLYQPDEIWRRVGKEPSGQAFNSLIQLEMEQGIPRNPFINAGAIVVADLLASRLSAPRQRLLEFVRQLSGETHICYDKVVAASEMMHSDRNAAIAYLMRSFGNFENEVIPVLNNYFHACALKMSCVDLAKTFSYLANKGVSVHTDQRVISPVQTKQLNALLATCGLYDGAGEFAYRVGMPGKSGVGGGIIAIVPGEMTIAVWSPELDPSGNSLAGTKALELLSERIGRSIF

SEQ ID NO: 18073 - protein, 386 aa, Vibrio vulnificus CMCP6
MSVIKMTDLDLAGKRVFIRADLNVPVKDGKVTSDARIIASLPTIKLCLEAGAKVMVTSHLGRPTEGEYAEEFSLQPVVNYLNDALDCEVKLAKDYLDGLELNAGELVVLENVRFNKGEKKNDEELSKKYAALCDVFVMDAFGTAHRAQASTHGVGMFAEVACAGPLLAAELEALGKAMSNPERPLVAIVGGSKVSTKLTVLESLSKIADQLVVGGGIANTFIAAEGHNVGKSLYEADLVETAQKLMKECAIPVATDVACAKAFDENAEAEIKHVSEVQDDDMIFDLGPDSTAALAEIIANAKTILWNGPVGVFEFKNFEAGTKGISEAIAQSPAFSVAGGGDTLAAIDKFGIKADVSYISTGGGAFLEFVEGKVLPAVEMLEARAK

SEQ ID NO: 18074 - protein, 433 aa, Vibrio vulnificus CMCP6
MSKIVKVLGREIIDSRGNPTVEAEVHLEGGFVGMAAAPSGASTGSREALELRDGDKARFLGKGVLKAIEAVNGAIADALVGKDAKDQAAIDAIMIELDGTENKSKFGANAILAVSLANAKAAAASKGMPLYEHIAELNGTAGQFSMPLPMMNIINGGEHADNNVDIQEFMIQPVGAKTLKEAVRMGAEVFHNLAKVLKSKGYNTAVGDEGGFAPNLKSNAEALEVIAEAVAAAGYVLGKDVTLAMDCAASEFFDKEAGIYNMKGEGKTFTSEEFNHYLAGLVEQFPIVSIEDGLDESDWAGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALAGRAPFNGLKEVKGQA

SEQ ID NO: 18075 - protein, 316 aa, Vibrio vulnificus CMCP6
MENKQIVITEFGGPDVLAIRSSQMPEPKPGQVLIKVYFSGINPIDVKTRAGLGWAAAQNKDKLPWVPGYDISGKVVSCGENAERFVIGDTVAGFVGFPLEGGGYSQYLCVDEDALSLVPGSVTLEGAAVLPLAGQTAAQALNKAQVKEGERVLILAGAGGVGHLAVQIAVAAKAEVYTTCSERNLDYMATLGAHAINYQFAPASERLSDVDVLIDLVGGDVALDALKCLKDNARVVTVPTLSAEMICEKAKLLGFEATGMLVEPDPQQLDTLLYMVGVGLLKTEIQRIYPMHEVSDAHKQIETGHTRGKVLLDMQC

SEQ ID NO: 18076 - protein, 487 aa, Vibrio vulnificus CMCP6
MSKEIKAQVVVLGAGPAGYSAAFRCADLGLDTVLIERYNTLGGVCLNVGCIPSKALLHVAKVIEEAKALAEHGIVFGEPQTDIDKIRLWKEKVINQLTGGLGGMAKMRKVNVVNGFGKFTGPNTIEVEGEDGKTVVNFDNAIVAAGSRPIKLPFIPHEDPRIWDSTDALELKEVPGKLLIMGGGIIGLEMGTVYHSLGSQIDVVEMFDQVIPAADKDIVKVYTKRISKKFNLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKAEGINYEVATFPWAASGRAIASDCADGMTKLIFDKETHRVIGGAIVGTNGGELLGEIGLAIEMGCDAEDIALTIHAHPTLHESVGLAAEVFEGTITYLPNAKAKKKKIIFLASRQNKNR

SEQ ID NO: 18077 - protein, 104 aa, Vibrio vulnificus CMCP6
MESSRDVRILKDLDDDIKGKDVLIVEDIIDTGNTLNKIKEILSLREPKSIEICTLLDKPSRREVPVPVKWIGFEIPDEFVVGVGIDYAQKYRHLPFIGKVVPQE

SEQ ID NO: 18078 - protein, 409 aa, Vibrio vulnificus CMCP6
MELTTTVSELRYALDTFFFLISGALVMWMAAGFAMLEAGLVRSKNTTEILTKNFCLYAIACTTYLVVGYNIMYVDNSEGGWLPSIGALIGSQAEGADHSLESDFFFQVVFVATAMSVVSGAVAERMKLWSFLLFSAILTAFIYPVEGYWTWGGGFLSAAGFSDFAGSGIVHMAGAAAALAGVLLLGARKGKYGKNGEVYPIPGSNMPLATLGTFILWFGWFGFNGGSQLMVSDFENATAVGQIFLNTNAAAAAGAITALLVCKTTWGKADLTMILNGALAGLVAITADPLSPSPLYAVAIGAVAGALVVFSIVGLDKLKIDDPVGAISVHGVCGFFGLMVVPISNGDASFLSQLFGAAVIFAWVFGASLAVWAVLKATIGIRVSEDEEMEGMDMHDCGVGAYPEFVTVK

SEQ ID NO: 18079 - protein, 482 aa, Vibrio vulnificus CMCP6
MAYGPFPKGDRIMIKFGTGGWRAFIGEEFTKDNVRLVAQAVANIINNEQVAERGFVIGYDRRFLSDKAGAWFAEVLAANGIVVSFINKFVPTPIVMFKAKEMGCAYSACITASHNPADYNGVKVFIEGGRDADEVITQKIEAQIAHLTLDQVQSVDFEQAVEDKQIVIINPMNEFVDSIINFIDIEAIKKANLRVLIDPMFGVAKNALQTVLINGRCDVDVINDGKNPDFGGLMPSPSAATLYRLKHLVAAQGYDIGIGTDGDADRLGIIDEKGNFIHPNEVLILLYYYLLKYKGWTGSVVRNIATTHLLDKIAADHGEKCFEVPVGFKHISSQMEADDSLIGGESSGGLTIRGHIKGKDGVFASSLLVEMISVTGKKLSELLEEIYSKYGYAYMAEGDCKFKPAAKQSLYDKIYIEKQLPEFGFEIEKVSYDDGAKVYFKNGGWVIARFSGTEPLLRIFAEMQDKETAELVVHQFKEFLAL

SEQ ID NO: 18080 - protein, 445 aa, Vibrio vulnificus CMCP6
MPATWSEQSEEDKPMTKSAELYQKAQQTIPGGVNSPVRAFNGVGGSPIFVERADGAFIFDADGKAYIDYVGSWGPMILGHNHAVIREAVIEAAQRGLSFGAPTEMEIKMAELVSELVPSMEQLRMVSSGTEATMSAIRLARGFTGRDKILKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYIAPTGPVYQAGTLSGNPVAMAAGYACLTLLREEGNEKRLASKTKHLADGFKSLAAQHGIPLVVNQVGGMFGFFFTEQEQITCYEDVTKCDIERFKRFFHLMIDHGVYLAPSAFEASFTSLAHGSKEIEATLEAADRCFAILAAESK

SEQ ID NO: 18081 - protein, 446 aa, Vibrio vulnificus CMCP6
MSDKRRYFGTDGVRGKVGQYPITPDFVLKLGWAAGRVLAKQGTKKVIIGKDTRISGYMLESALEAGLAAAGLKATFTGPMPTPAVAYLTQTFRAEAGIVISASHNPYYDNGIKFFSSEGTKLPDDIELAIEAELDKEIECVESAELGKATRLNDAAGRYIEFCKSTFPSELSLAKLKIVVDCANGATYHIAPNVFTELGADVIAMGVTPNGTNINHEVGATDVRALQQRVVEEQADLGLAFDGDGDRIIMVDHLGNKVDGDQIAYIIARDALRRGELKGGVVGTLMTNLGMENGLKQLGIPFVRAAVGDRYVMEKLLEKGWKIGAENSGHVILLDKVTTGDAIVAALQVLASVVGSELSLNELSKGMTLYPQVLENVRFAGQGNPLEAEAVKKTVEDVEADLGSKGRVLLRKSGTEPLIRVMVEGEDGELVQNSALKIAQAVKDNC

SEQ ID NO: 18082 - protein, 459 aa, Vibrio vulnificus CMCP6
MSKAKRAYVCNDCGADFPRWQGQCNACGSWNTITEVRLAASPSVARNERLSGYAGSATESKVQVLSEIDLQEVPRFSSGFKELDRVLGGGIVPGAAILIGGNPGAGKSTLLLQTMCQLSANMNALYVTGEESLQQVAMRASRLGLPKEHLKMLSETNVDKICQVAEQIQPKIMVIDSIQVMHVSDVQSSPGSVAQVRESATALTRYAKQNNVAVFIVGHVTKDGTLAGPKVLEHIIDCSVLLDGDADSRFRTLRSHKNRFGAVNELGVFAMTGQGLREVSNPSAIFLSRGEEQTSGSSVMVIWEGTRPLLVEIQALVDYSQLANPRRVAVGLEQNRLSLLLAVLHKHGGLQMADQDVFVNVVGGVKVTETSADLALIMALLSSFRDRALPKDVVIFGEVGLAGEIRPVPSGQERLNEAFKHGFKKAIVPLANMPKGGIPGMQIHGVKKLADAISAFDEL

SEQ ID NO: 18083 - protein, 283 aa, Vibrio vulnificus CMCP6
MTNKKHTLFGECLAEFIGTGLLIFFGVGCVAALVLAGAQFGQWEISIVWGFGVSIAIYCTAGVSGAHINPAVTIALAAFHGFDKAKVVPYIIAQLLGAFCSAALVYTLYSNLFTDYEIAHNFVRSSQEALATAGIFSTYPHASLSFFGAFAVEFVITAVLMFAILALGDEHNGAPRGAMNPLLIGILIAVIGGSLGPLTGFAMNPARDFGPKLFAYFAGWDYALSGGRDIPYFIVPILAPIAGACFGGWLYPKAIAAYLPKVGSGCTIPNQCETEEEAKEARA

SEQ ID NO: 18084 - protein, 181 aa, Vibrio vulnificus CMCP6
MLKVICASLVLTSSLALAGPKVEFETSLGNFTVELNEEKAPISVENFVKYVKDGSYVGSQFHRIIPGFMAQGGGFDEKMNRLPSYAPIKNEASNGLKNVTGSIAMARTQDPNSATRQFFINLVDNEFLDYDLQPPGYAVFGQVTEGFDVIQQMASKPTKSQGYMRDIPVEPIVITKATLLP

SEQ ID NO: 18085 - protein, 231 aa, Vibrio vulnificus CMCP6
MNKYLAELFGTFWLVLGGCGSAVLAAAFPDVGIGLLGVSLAFGLTVLTMAFAIGHISGCHLNPAVTIGLWAGGRFEAKEIVPYILAQVIGGVIAGGVLYTIASGQMGFDATSSGFASNGYGEHSPGGYSLTSALVTEVVMTMMFLLVILGATDQRAPQGFAPIAIGLCLTLIHLISIPVTNTSVNPARSTGVALYVGDWATAQLWLFWVAPILGALLGAVAYKLISGSNKD

SEQ ID NO: 18086 - protein, 494 aa, Vibrio vulnificus CMCP6
MNVLARQDRDVHRDQGVMATHDATASELATWFSELQTAYQAEPSASYLVRKHRLLALKKQLSRYQDILAEAMSQDFGGRSHTESIMADVLAPILDINHVLKHLKGWMKPSRRATEWLFKGNQLEVRYQPKGVVGIICPWNFPLYLSIGPMITALAAGNRCMIKMPPNCPQTTRQLRRMLAEIYPTNLVRIVEGTHPEAMDISHLPFDHLVFTGSPTSGKIIMANAAANLTPVTLELGGKSPVVVFDDYEIEKAAQRIAHGKGFNSGQICIAPDYAFVPEGKQEAFIDALKSAHQSMYGDIKANQDYTALVDDAQYQRFHSLLEDARSKGATITQCLEPGEGRKTPLYIATNLTPDMRICQEEIFGPLLPVHTFQAIEEVIDYINQRPRPLACYLFSHHPKQRETLLTQTHSGGVTINGWGWHVLNHSVPFGGVGNSGIGNYHGEEGFRELSHARTVLKMRDWFPIQLFAPPYGNWVQKLVVRVFAGKPDPTLKE

SEQ ID NO: 18087 - protein, 331 aa, Vibrio vulnificus CMCP6
MIKIAFFSAKSYDEASFNKVNGNKEYEFHYHDFRLRLKTSKMAQGCDVVCAFVNDDLSSPVLEQLALGGTKLIAMRCAGFDKVDLQAAKELGLQVVRVPAYSPEAVAEHAVGMMMCLNRRLHKAYQRTRDANFSLEGLVGFNFYGKTVGVIGTGKIGLATMRILKGLGMEILCYDPYENPLAIEMGARYTTLQEIYQSADVISLHCPMSKENFHLLNEHSFEQMKDGVMIINTSRGELLDSAAAIEALKKGKIGALGLDVYDNEKDLFFQDKSNDVIVDDVFRRLSACHNVLFTGHQAFLTHEALNNIASVTLNNVEAFFAGNTSGNELVE

SEQ ID NO: 18088 - protein, 311 aa, Vibrio vulnificus CMCP6
MNDLFTKTDYSLYSNSMSFVRRPYVKDPVAADADLVVFGAPLDMATSGRPGARMGPDAIRRASVNLAWEGKKFPWDFNLFKKVKVIDGGDLVFDCGDAEDFTYRMEAATSAILKSGKTMLGLGGDHFITLPILRAYAKHYGEMALIHFDAHTDTYANGSSYDHGTMFYHAPKEGLISPKHSVQVGIRTEYKQEGHGFNVINAMQANDMSVEEILADIRRIVADKPVYVTFDIDCLDPAFAPGTGTPVCGGLNSDKILKIIRGLKDVNIVGMDVVEVSPPYDQSDLTALAGATIALELMYAWAANKEFESEF

SEQ ID NO: 18089 - protein, 483 aa, Vibrio vulnificus CMCP6
MVFADRKRPNVPRTLSIFIFFLNIGVNVHRYKKEASNLIKLATPVLIASVAQTGMGFVDTVMAGGVSATDMAAVSVAASIWLPSILFGIGLLMALVPVVAQLNGAGKREQVPFEIQQGAVMALLISIPIIGVLFQTQWILGYMNVDAVMATKTIGYIHAVMFAVPAFLLFQTLRSLTDGLSLTKPAMVIGFIGLLLNIPLNWMFVYGKLGAPALGGVGCGVATAIVYWIMFLLLLFYVTTSHRLRQVQLFTTFHPPQLNAQVKLFKLGFPVAAALFFEVTLFAVVALLVAPLGSTVVAAHQVAINFSSLVFMLPMSIGAATSIRVGHMLGEKSTEGARIASHVGILVGLSTAVFTALLTVILREQIALLYTDNRVVITLAMQLLIFTAIYQCTDAIQVIAAGALRGYKDMRAIFNRTFIAYWLLGLPTGYVLGLTDWIVEPMGAQGFWIGFIVGLSSAAAMLGVRLHWLHRQNDEIQLNYEAR

SEQ ID NO: 18090 - protein, 406 aa, Vibrio vulnificus CMCP6
MSDTASQVHGAVQTLTQSSDTLFLLLGAIMVFLMHAGFAFLEVGTVRHKNQVNALVKILADFGISTLAYFFIGYWVAYGAHFFADAETLAQGNGYELVKFFFLLTFAAAIPAIVSGGIAERARFYPVLIATFFTVGIVYPLFEGIIWNGNFGIQAWFEATFGVGFHDFAGSVVVHGVGGWIALVAVIFLGMRRGRVRAGKHTNFAPSNIPFLALGAWILCVGWFGFNVMSAQTLNGISGLVAMNSLMAMAGGIVAALIAGKNDPGFIHNGPLAGLVAVCAGSDLMHPLGALVTGSVAGVLFVYLFTYLQNKTKIDDVLGVWPLHGVCGAWGGIAAGIFGQSSLGGLGGVSFTVQLLGTLLGISVALIGAGIVYGAINRLSGLRLSQEDEFNGADLAIHKISSVNAE

SEQ ID NO: 18091 - protein, 482 aa, Vibrio vulnificus CMCP6
MKGDIGVIGLAVMGQNLILNMNDHGFKVVAHNRTAAKVDEFLEGPAKGTNIIGAYSLEELVEKLETPRKVMLMVRAGAVVDQFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEPLVEKILDTAGQKGTGKWTGINALDLGIPLTLISESVFSRCLSALKDQRVEAEKLFGKTITPVEGDKKEWVDALRQALLASKIISYAQGFMLMREASNENGWDLNYGNVALMWRGGCIIRSAFLGNIRDAYEANPDLAFLGSDDYFKGILQNSLVAWRKVAAKSLEAGIPMPCTTSALTFLDGYTTARLPANLLQAQRDYFGAHTYERIDRERGEFFHTNWTGTGGNTASTTYDV

SEQ ID NO: 18092 - protein, 249 aa, Vibrio vulnificus CMCP6
MTQQQDYMIQLKDMNKWYGEFHVLKNINLNVKKGEKIVICGPSGSGKSTMIRCINRLEEHQAGQILVSGTELTEDLKNIEAVRREVGMCFQHFNLFPHLTVLENCTLAPIWVKKMPKEEAEAIAMKYLERVKIPEQADKYPGQLSGGQQQRVAIARSLCMSPKVMLFDEPTSALDPEMVREVLDVMVELAEEGMTMLCVTHEMGFAKEVADRVIFMDAGEIIEENNPKEFFENPQSDRTQNFLAQILHH

SEQ ID NO: 18093 - protein, 211 aa, Vibrio vulnificus CMCP6
MSFKTAEVSSLAERINWEKVDGLVPAIVQDFQSSQVLMMGYMNQEALVKTGETGQVTFFSRTKERLWTKGETSGNVLQLVNMSLDCDNDTLLVKVNPIGPTCHTGTTTCWDGDPQEESQMVWLHQLEQLLAARKSAGPDSSYTASLYARGTKRISQKVGEEGVEVALAATSGDKAELVCESADLIYHLLVLLQDQGLSMNDVINKLKERHK

SEQ ID NO: 18094 - protein, 472 aa, Vibrio vulnificus CMCP6
MTTLGPSTDKDNVLEEIIRAGANVVRMNFSHGSAEDHKTRAEKVRNIAARLGRQVAILGDLQGPKIRVSTFKEGKIFLSVGDLFTLDSDLPKGEGDQKSVGLDYKALPQDVGPEDILLLDDGRVQLQVLTVDGNKVNTRVIVGGPLSNNKGINKKGGGLSADALTEKDKQDILLAAEIKVDYLAISFPRNGADMDYARRLARDAGLEAKLVAKVERAETVRNDENIDDIIMASDVIMVARGDLGVEIGDPELIGVQKKLIKRAKELNRVVITATQMMESMIENPMPTRAEVMDVANAVLDGTDAVMLSGETAAGKYPVETVRSMAEVCIGAEKTWEPGSQNYRIDKSFVTAEETIAMSTIYAANHMEGVKAMVTLTESGRTALMTSRLNSTLPIFALSPNERTLNRCSLYRGVTPVFFDTKVETGFDVAMAALSTLRKKKLLDFGDLVIITQGDIMDVEGSTNCMRILPVFD

SEQ ID NO: 18095 - protein, 268 aa, Vibrio vulnificus CMCP6
MDRYQATFERLAAQKQGAFVPFVTVCDPNPELSLKIMDTLVKAGADALELGIPFSDPLADGPTIQGANIRALDSGATPDICFDLIGQIRAKYPDLPIGLLMYANLVYSRGIENFYQRCAQAGIDSVLIADVPTNESAEFVAAAEKFGVHPIFIAPPTASDETLKQVSQLGGGYTYLLSRAGVTGAETKANMPVGDMLAKLEQFNAPPALLGFGISEPEQVKQAIDAGAAGAISGSAVVKIIESHLNEPDAMLTALANFVSNMKSATQK

SEQ ID NO: 18096 - protein, 361 aa, Vibrio vulnificus CMCP6
MCTDHNWINNAIRKIEADFQRSADTHLFKLDLPSLEGIDIYLKDESTHPTGSLKHRLARSLFLYAICNGWIGPETTVIESSSGSTAVSEAYFARLLGLPFIAVMPKCTARKKIEQIEFYGGKAHLVDRSDQIYAESHRLAKELNGHYMDQFTYAERATDWRGNNNIANSIFSQMTLEEHPEPSWIVMSPGTGGTSATIGRFIRYQKLDTKLCVVDPENSVFFDYFQNGDKTITGNTGSKIEGIGRPRVEPSFIAGVVDEMRKIPDAASVACTHWVSKLIGRKVGASTGTNLYGVLQLACEMKQRGERGSIVTLLCDSGDRYLDTYFNEEWVKTNIGDIQPYLEQLEIIERDGCVAPICCPA

SEQ ID NO: 18097 - protein, 404 aa, Vibrio vulnificus CMCP6
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLVPAPDYPLWTAAVALSGGKAVHYLCDEQADWYPDLDDMRKKITPKTRGIVLINPNNPTGAVYSRDFLLEVIEIARQHKLMIFADEIYDKVLYDGAVHTSVATLTDDVLVMTFNGLSKAYRVCGFRGGWMFMTGPKHLAQGYVNGLDMLASMRLCANVPMQHAIQTALGGYQSINELILPGGRLLEQRDRAWELINQIPGVSCVKPKGAMYLFPKIDTKKYSIKDDQKMVFDFLVQEKVLLVQGSGFNWPKPDHFRIVTLPHIEDLETAIGRFERFLHGYSQ

SEQ ID NO: 18098 - protein, 151 aa, Solanum brevidens
  misc_feature (7)..(7): Xaa can be any naturally occurring amino acid
RKSFYYXAENNVVFEGILLNPSMVTPGAEHKEKATPDTIAKYTLTMLKRRVPPAVPGIMFLSGGQSEVEATLNLHAMNQSPNPWHVSFSYARALQNTVLKTWQGRPENVDAAQRALLIRAKANSLAQLGKYSAEGESEEAKKGMFVKGYTY

SEQ ID NO: 18099 - protein, 1113 aa, Hebeloma cylindrosporum
MAALTTYTLQGGRSSSYGGLGMVGIAFIEKLLNLDDKQKYFIITCGERVHFAYNRVGLTEYFEHRNVENLYLNPPSWYAAQQPDRFRYHLSETVTYLSPRDHLVYTSKGRSFKYDRCVLATGSTASLPLYTSFKDIATTDGVFVYRNISDLDAIIAYAARAEVKHAVVVGGGLLGLEAAKAVYDLETISHVSIINRQAYPLSRQLDADAGEMVLRKIEGMGVQVLTNCSPAQQLTRPATDGSGNKVFTGFTLQDGTTHEADLVIYAIGIKPRDELAQASGIECHPRGGIVVDDNLQTSAPDVYAIGECASWKGNYYGLIAPGIEMADILSFNLTETDSHAPRKMNAPDLSTKLKLMGVDVASFGDFFADKRMTIKTQAATAAFDGTFPGKVVDPAQALVEITTAAGTSATPLIPKRGGRNGNEPIKCLVYNDPFSSTYKKYIFTADGKYLLGGMMIGDVSDFVKLVAIVKKKKALDVPPSQFIIGAKKEGDDDGGDLDDDAQVCSCHNVSKGDIVKRVKGGDCTTIGDLKKKTKVGTGCGGCMPLVTNIFNAEMKRAGYVLNTNICPHFAMARVDLFNVIKVRKLRTFGEVMTTVGIDKNAIGCEICKPAIGSILSSLYNEPIMKPEHHQNQDTNDRFMANIQRNGTFSVVPRIAAGEITPEGLIAIGQVAKKYNLYTKITGGQRIDMFGAMKDDLPSIWEELNDAGFESGQAYGKSLRTVKSCVGTTWCRYGVGDSVGLAVQLEQRYRGVRSPHKFKGGVSGCVRECAEAQSKDFGVIATDKGWNIFVGGNGGANPRHAELFAKDVPPSRVIRILDRFLAYYIMTADRLQRTARWIENMEGGIEKLRQVILEDSLGICAELDAIMTNIVNTYEDEWANAVKDPAKRQQFKQFVNTTERRPQAELIAERGQYRPADWPKSSAGLKITPDQLKTPKSEWTWVTVAQKGDMALSELGTTSVAVKYGDTQLAVYHVPKRGFYATQQMCPHRRAFVLDHGIIGDTPSGELYVSCPLHKRNFTLTDGTCLSDPDYEILAFEARANDADDIEVLLPPVNDIDAVLGTDKWLVRQAESEALGLNEATQVEMVGINGHSVASHEEQGGCASSACGDKRLEW

SEQ ID NO: 18100 - protein, 393 aa, Nicotiana benthamiana
MDGSGQQSDTMMSDAGAEQPPPAAQPVAGMDNIPATLSHGGRFIQYNIFGNIFEVTAKYKPPILPIGRGAYGIVCSALNSETIENVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVHPDAIDLVETMLTFDPRRRITVEGALAHPYLNSLHDISDEPICMTPFSFDFEQHALTEEQMKELIYRESLAFNPEYQHM

SEQ ID NO: 18101 - protein, 370 aa, Bradyrhizobium japonicum USDA 110
MSALFSPIKLRGLTLKNRVVVSPMCQYSAEDGVPTDWHFTHINNLSLSGASMFCIEATHVEAIGRITPGCLGLYSDAAEAALKQILASVRKHSTTAVAMQLAHAGRKASSARPWDGGQLIPVSEGGWQTVAPSALPHKEGEAAPLALDAAGLTRIREAFVEAAKRAERIGIDAIELHGAHGYLLHQFLSPISNRRTDEYGGSLQNRMRFPLEVYDAVRAVFPHDKPIGMRVSSTDWVEGGWDLAQTIEFASALKARGIDWIDASSGGVSPLQKIPLGPGYQVHFADAIRRETGLPTIAVGMISDAKHAEEIVASGKADMVALGRGMLYDPRWGWHAAAELGGEVEAPPQYWRSQPSTQKALFGKTTFGAR

SEQ ID NO: 18102 - protein, 311 aa, Bradyrhizobium japonicum USDA 110
MPLDPLAKRLLTMMAAAGPQVRNRPSVEARRQSLAKLMQFARTDAPDVTVSDGTLPGPGGELPYRLYSPATAAERAPGFVFFHGGGLVAGSVATHDRIAAALAHATGCRLVSVDYRLAPEHKFPAAVDDAIAATEWVAREASSLGIDAGRLVVGGDSAGATLAAIVCQEALQNAGLSIVAQCLICPVLDFEETSPSREAFAEGHLIDRITIEADLADYLPGGIDAADPRISPLRATRFAGLPTAIIHTAEFDPMRDEGNAYARKLLAAGVTVEHVCHDGMVHNFHAMGAILPQAQLVLSQIGEQVRRAVEK

SEQ ID NO: 18103 - protein, 337 aa, Bradyrhizobium japonicum USDA 110
MLEKFARYPLTFGPTPIEKLERLSKHLGGNVEIYAKREDCNSGLAYGGNKLRKLEYIIPDAIASNADTLVSIGGVQSNHTRMIAAVAAKIGMKCRLVQEAWVPHEDAVYDRVGNIMLSRIMGADVRLVDDGFDIGIRKSWEQAIEEVKAAGGKPYAIPAGASVHKYGGLGYVGFAEEVRKQEAELGFKFDYIVVCTVTGSTHAGMLVGFAADGRARKVIGIDGSFTPAQTKAQVLSIAQNTAKLVELGKDIVADDVVLIEDYAYPAYGVPSEETKEAIRLTARLEAMITDPVYEGKSMQGLIDLTQKGYFEKGAKVLYAHLGGAPALNGYGYAFRNG

SEQ ID NO: 18104 - protein, 167 aa, Bradyrhizobium japonicum USDA 110
MARYEDLPYRTCVGVMLINAKGLVFIGRRAGGIEHIDDTHVWQMPQGGVDPGEDTWAAAKRELYEETSVRSVERLGEVPDWLIYDIPRTVAGRAWKGRYRGQRQKWFAVRFTGKDSEINVENPGGGHKAEFVSWRWEPMKNLPGLIIPFKRPVYERVVKEFSALAEE

SEQ ID NO: 18105 - protein, 167 aa, Bradyrhizobium japonicum USDA 110
MSNDNKPYRPNVGIALFNAEGRVLIGHRFKGDGPEIILPGLDWQMPQGGVDEGEDLRDAAMRELWEETNVVSASYLGETDWLTYEFPPYDGPQTHRLAKFRGQRQKWFALRFTGKDDEIDPLTPQNGQPAEFDAWRWEQLDRVADLVVPFRREVYRAVAQQFAPFAS

SEQ ID NO: 18106 - protein, 466 aa, Bradyrhizobium japonicum USDA 110
MATYDLVVIGTGPGGYVCAVRAAQLGMKVAVVEKNATLGGTCLNVGCMPSKALLHASEMFEEAAHSFAKMGVSVSEPKLELPAMMNFKQQGIDGNVKGVEFLMKKNKIDVLKGTGKILGTGKVEVSADGKSQVVETKSIVIATGSDIARLKGIEIDEKRIVSSTGALSLDKVPGKLLVVGAGVIGLELGSVWKRLGAEVVVVEFLDRIMPGMDGEIAKQFQRILEKQGFAFKLGAKVTAVDTSGKTLKATIEPAAGGAAETLEADVVLVCIGRVPYTDGLGLKEAGVALDNRGRVQIDPHFATSLKGVYAIGDVVAGPMLAHKAEDEGVAVAEIIAGQAGHVNYDVIPGVVYTTPEVSSVGKTEEELKQAGVAYTVGKFPFTANGRSKVNQTTDGFVKILADAKTDRVLGVHIIGREAGEMIHEACVLMEFGGSAEDLARTCHAHPTRSEAIKEAALAVGKRAIHM

SEQ ID NO: 18107 - protein, 240 aa, Bradyrhizobium japonicum USDA 110
MDTRIESSSLAGTTPDTIAISNVNLSLGTGAARVHILKDISLRVASGETIGLIGPSGSGKSTLLMVMAGLERPDSGEVVVNGTPFNALDEDALARFRGRQVGIVFQSFHLIPTMTALENVAVPLELAGNPDAAKRAAQELQSVGLGDRLHHYPTQLSGGEQQRVALARALAPDPAILVADEPTGNLDEATGKQIVDLLFTKHAERGMTLVLVTHDSSLAHRCDRVIRLRSGRIDTQSAPA

SEQ ID NO: 18108 - protein, 509 aa, Bradyrhizobium japonicum USDA 110
MNRAANANLFSRLFDGLDDPKRLAIETHDGARISYGDLIARAGQMANVLVARGVKPGDRVAVQVEKSVANIVLYLATVRAGAVYLPLNTAYTLNELDYFIGDAEPSLVVCDPSKAEGLAPIAAKVKAGVETLGPDGKGSLTEAADKASSAFTTVPRENDDLAAILYTSGTTGRSKGAMLTHDNLASNSLSLVGYWRFTDKDVLIHALPIYHTHGLFVATNVTLFSRASMIFLPKLDPDLIIKLMARATVLMGVPTFYTRLLQNAALSRETTRHMRLFISGSAPLLAETHREWSARTGHAVLERYGMTETNMNTSNPYDGERVPGAVGFPLPGVSLRVTDPETGKELPREEIGMIEVKGPNVFKGYWRMPEKTKAEFRPDGFFITGDLGKIDGKGYVHILGRGKDLVISGGFNVYPKEIESEIDAMPGVVESAVIGVPHADFGEGVTAVLVCNKGAEVSEASVLKALDGRLAKFKMPKRVFVVDELPRNTMGKVQKNVLRDTYKDIYAKK

SEQ ID NO: 18109 - protein, 377 aa, Bradyrhizobium japonicum USDA 110
MSTSTKRCYYETLEVERDADESKLKSSFRKLAMKFHPDRNPGDDTSEVKFKEINEAYEVLKDKDKRAAYDRFGHAAFEQGGPGGGAGFGAGFASSFSDIFEDLFGMAGQRGRGGRERGADLRYNMEITLEEAFGGKTAQIEIPVSVTCEACSGIGAKAGTKPKTCSTCGGAGRVRQSQGFFTLERTCPGCQGRGQMIEDACPSCSGQGRVTRERTLSVNIPQGVEDGTRIRLAGEGEAGVRGGPPGDLYIFLSLAQHQFFQRDGADLHCRVPISMVTAALGGEFEVPTIEKGKAKVKVPAGTQSNRRFRIASKGMPVLRSRQTGDMYVQVVVETPQNLTKKQQELLAEFEKLSSGNTQPESEGFFTKVKDFFGSRAN

SEQ ID NO: 18110 - protein, 207 aa, Bradyrhizobium japonicum USDA 110
MSERLLVLVRHGQSEWNLKNLFTGWKDPDLTEQGVAEAREAGRKLKAQGLVFDVAYTSVLTRAQHTLDLILGELGQKGLPTEKNLALNERDYGDLSGLNKDDARKKWGEDQVLIWRRSYDVPPPGGESLKDTLARALPYYVQEILPSVLNGKRTLVAAHGNSLRALIMVLEKLSPEGILKRELATGVPIIYRLNADSTVASKLDLAG

SEQ ID NO: 18111 - protein, 481 aa, Bradyrhizobium japonicum USDA 110
MRSAHLGEDTMSVVGIDTGFELGAAPSVPDEISRRLEAMPGSPYVWRLVILLSLGGCFEIYDLFLTGYIAPGLSRSGLLSTTTQAFFGFAGIGAFVAATFAGLFVGTFFLGFLADRFGRRAIFTYALLGYTAASVIMACQTSPEGLLFWRFLAGIGIGVEVITIDAYITELVPSRMRGRAFAVNQSIMFVAVPVVAFLAWWLVPLAPYGVEGWRWVVLIGAAASMIIWVLRLFLPESPLWLARHGRNEEALRILTTLEAASGGAGSRPATSPARQAVRSTTNVSFADLFRPPYLSLVVLFMVFNLCQAFGFYGFANWVPTLLVEKGINVTKSLQYSFIVAFAYPIAPLLASSFADKFERRWIIAGACVAIIVFGMAFAQLTEPALLIVCGVLLTACNTTMSYAYHAYQTEVFPTQIRARASGLVYSMSRLSATFSGFIVAYMLKEGGVTGVFGLITAAMLIVVIAMALFGPNVRGKPLDAV

SEQ ID NO: 18112 - protein, 278 aa, Bradyrhizobium japonicum USDA 110
MTTRIDIRFAELAKQGRSAFVTFLMAGDPDPATSLEIIKALPKSGADVIEIGMPFTDPMADGPSIQAAGLRALKAGMTLKKTLELVRGFRKDDNATPIVLMGYYNPIYIYGVDKFLVDAKSAGVDGLIIVDLPPEEDDELCLPAMKAGLNFIRLATPTTDDKRLPAVLANTSGFVYYVSITGITGAAAADSSAVSEAVARIKRHTKLPVCVGFGIRTPETARAIASHANGAVVGTALVDALKNSLDADGRATAKTVNAVAELTASLAQGVKGAQQAAE

SEQ ID NO: 18113 - protein, 497 aa, Bradyrhizobium japonicum USDA 110
MTPTAAARAQHATATLRDRLKDPSLLKEACYIDGAWVGTPVFAVNNPATGVELAKVPQLGADDTTKAVEAAERAFPAWAKHTAKQRSNILRKWFELIIANREDLALILTSEQGKPLSEALGEVDIGAAYIEFFAEEARRVYGETIPTQRPDARLLAIKQPIGVCGAITPWNFPNSMITRKVSPALAAGCTVVLKPANETPLSALALAVLAEKAGIPKGVLNIITGDAPPIGKVLCEHPAVRFVGFTGSTAVGKILYQQASVGVKRLGLELGGNAPFVVFDDADIDAAVEGAIVSKYRNMGQTCVCANRLYAQDKIYDEFVQKLSKKVAVMKIGDGTEAGVTQGPLINLKAVDKVERHIADAVKRGAKVVTGGKRSELGRSFFEPTVLADVKPDSLVAQEETFGPLAPVIRFKDEADVIAMCNASPFGLASYFYSRDLGRVWRVAEALESGMVGVNTGLITTEVAPFGGVKESGLGREGSRHGMEEYVEIKYVMMAGV

SEQ ID NO: 18114 - protein, 466 aa, Bradyrhizobium japonicum USDA 110
MTMLDTVQHHSQPQSGVPQNHLADEFVETLRLAVPMMLTQLGQIAMITTDLALIGRLGEDAVAAAALAHTVYFVSFTFGLGLMAAVSPLVAQAFGAGDVRRIRRALRVGLWVALLISLPMMASPLYGEHILIALGQVPQSAALAQRYLNGLAWGIAPALGFIALRGMMSAVNRPQPPLWITVAAIPVNAALVYVLIHGLFGLPELGLFGAGLATTLVNLGTFLAVLAIAAWRKPFSDYRPLAHLWRIDWPLVRQLIALGAPISSSLLLEYGLFSSAALLMGLISTTALAAHQIALQVTAVLFMVPLGIGMAATVRVGHAFGRNDPAAVRRAGLVAAVLGVALVSALTVAIILGRYELGRLFFGGSEASAATVELTATLLLVGATFFIADGLQTIMGGALRGINDTRMTLAFAAIGYWCVAFPVAWVLAFHTGLGAVGVWIGFSIGTFVYAGLLVLRFRMLARRLVG

SEQ ID NO: 18115 - protein, 486 aa, Bradyrhizobium japonicum USDA 110
MLPRSAGAGRNKVAVARCPFGQPTGALVMSMQNVAAPALQFTAPRRNELTHIPGDEGWPVIGKTFQVLADPKGHIEANGAKYGPVYRTHVFGETNVVLLGPEANELVMFDQQKLFSSTHGWNKVLGLLFPRGLMLLDFDEHRLHRKALSVAFKSGPMKSYLSDLDRGISARVAQWKAKPGEMQLYPAMKQLTLDLAAASFLGADIGPEVDEINRAFVDMVAAAVAPIRRPLPGTQMARGVAGRKRIVAYFRQQIPLRRGNHGGDDLFSQLCRATHEDGALLSEQDIIDHMSFLMMAAHDTLTSSLTSFIGELAANPDWQDRLRAEVLALGLAPGAPSSFDDLEKMPLSEMAFKEALRIKPPVPSMPRRAMRDFTFKGFRIPAGTAVGVNPLYTHHMKDIWPEPDRFDPLRFTEEAQRNRHRFAWVPFGGGAHMCLGLHFAYMQAKCFARHFLQNIEVSLAPGYKPDWQMWPIPKPRDGLKVRVKAV

SEQ ID NO: 18116 - protein, 487 aa, Bradyrhizobium japonicum USDA 110
MAQGEVNWWRDGIFYQVYPRSFQDSDGDGVGDLAGILRRLPYVKSLGVDAIWLSPIFPSPMADFGYDISDHTGIDPLFGTMADFDALLTAAHEHGLKLILDLVPNHTSDQHPWFVESRSSRDNPKRDWYVWRDPAPDGGVPNNWLSEFGGSAWQFDETTGQYYYHAFLAQQPDLNWRNPDVRAAIYDAMRFWLDKGVDGFRVDVIWHLIKDAEFRDNPLNPHYVEGRPPNEKILTQYSTDQPPFNFALLSTFWSARSIETIIDDYEKALPKGAWPNWVLGNHDRPRVASRVGPEQARVAAMLLLTLRGTPTLYYGDEIGMHQLAIAPEDVRDPFEKNVPGIGVGRDGCRTPMQWDSSNFAGFSNVRPWLPLPEDHIHENVVNLEADTRSILSLYRRLIVLRKSSPPLVAGNYHPIAAQGDLLIYRREAEGRAVIVALNLGPDPIAVTTSAIRFGSEILLSTFLDREGERLEGVLDLRGNEGVIVQPP

SEQ ID NO: 18117 - protein, 270 aa, Bradyrhizobium japonicum USDA 110
MLCAHDHAQKPNVTFPSTPRRFAAPTVREKYLIGALFVLALAALLAPTLPPGAWHIPHFVDARSWLGVPNAGDVLSNLAFLAMGVWGSERLRARHDAPVGASWFFVGLILTCLGSGFYHLDPDMPQRLVADRLGMAVAFAGFLGIAASERISVRAGEAVLVLMMVAGLLAAWVARDNLTPWVVVQFGGMALAVGLALTRPRPGALGVPLGGVIFFYVLAKLFELGDEAVFEATGHIVSGHTLKHLAAALAAWPVIRALAPAAIGPAQSRH

SEQ ID NO: 18118 - protein, 478 aa, Bradyrhizobium japonicum USDA 110
MTFVARHALWSDEQKDAAQRMRRIVEEKNLEVIRLAFPDQHGILRGKTIIAAEAIASLESGCSITTTMLAKDTSHRTVFPVFTSGGGFGMKEMEGAADVLMVADPTTFRVLPWAPTTGWVLCDLHFNDGRPVPFATRGLYRKVLDELAGRGHDFVAGLEVEFHIFKLDDPHMRAEDAGQPGTPPSVSLLSHGYQYLTEQRFDQMEPVLEILRRDVVALGLPLRSVEVEFGPSQCEFTFAPRKGLEPADNMVLFRSAVKQIARRHGYHATFMCRPKLPNLFASGWHLHQSIVSRTSGENQFMAQAGGEPLSAFGRAYLAGLLDHARASAVFTTPTINGYKRYRSYSLAPDRAIWGRDNRGVMIRVLGAAGDAATRLENRIGEPAANPYLYMASQILSGLDGVDRKLDPGPSADTPYETKAPLLPKSLRDAVAALKEDPFFREKFGAEFVDYYTHIKNAEIDRFLAEVTDWEHREYFEMF

SEQ ID NO: 18119 - protein, 513 aa, Bradyrhizobium japonicum USDA 110
MSEGSYNAVTWLLDRNVEEGRGNKLAFDDTVSRLTYGELQRESRRAANMLRRLGVRREERVAMIMLDTVDFPIVFLGAIRAGIVPVPLNTLLTADQYAYILADCRARVLFVSEALYPVIRDVVGRMPDLEHVVVSGAKQNGHKQLAEELADESDQFTTAATHPDEPAFWLYSSGSTGMPKGVRHLHSNLQATADTYARQVLGIRESDVCLSAAKLFFAYGLGNALTFPMSVGATVVLNSERPTPARMFDLMNRYNPSIFYGVPTLFAAMLNDETMKSERGGKSLRICTSAGEALPESVGNSWKARFGVDILDGVGSTELLHIFLSNAPGDIKYGSSGKPVPGYAVRLVNEAGQDVADGEVGELLVDAPSAGEGYWNQRHKSRRTFEGPWTRTGDKYVRDAEGRYTFCGRADDMFKVSGIWVSPFEVESALITHPAVLEAAVVPEADPEGLLKPKAFVVLRQGAKTANLQEMLKEHVKQKIGPWKYPRWIDVVDSLPKTATGKIQRFKLREGAN

SEQ ID NO: 18120 - protein, 405 aa, Bradyrhizobium japonicum USDA 110
MIVMTNSAAPHLLPVFARSDLGFERGEGCWLIATNGDRYLDFTSGVAVNALGHAHPALVKALQEQATKLWHMSNLFQSPDGEKLATRLCNESFADFVFFCNSGAEALEGVIKLVRHHHFSKGHPERYRIITFEGAFHGRTLATLAATGSAKYLEGFGPPMDGFDQVPHGDIEAVKKAIGPQTAGILIEPIQGEGGVRSATPAFLKALRQLCDEKGLLLAFDEVQTGMGRTGDLFAHRRTGVTPDVMSLAKALGGGFPIGAILATADAAAGMGPGSHGSTFGGNPLAIAAANAVLDVMLKPGFFDHVQKMSLLLKQKLASVIDRHGDVVSEVRGEGLLIGIKAVVPSGDLVAALRNEKLLTVGAGDNVVRFLPPLIVTEAEIEDSVGRLERACAAISSSQTKRAAS

SEQ ID NO: 18121 - protein, 417 aa, Bradyrhizobium japonicum USDA 110
MDISRPVFFVTVFDETVMSEVPMSKSPATYRPETRLVHSGTLRSQFGETSEALFLTQGYVYNSAEECEARFKGEDPGFIYSRYSNPTISMFERRMIELEGAEAARSAATGMAAVTTAILAPLKTGDHVVASRALFGSCLYVIQDLLPRYGIETTLVDGLDLDQWQRALRPNTKTFFLESPTNPTLDVLDIPGIAEIAHKGGARLVVDNVFATPIWQSPLALGADVVVYSATKHIDGQGRCLGGIILSSEAFVAEHLHNFMRQTGPSISPFNAWVLLKGLETLAVRVRAQTDTAASVAEVLAGHPKISRLIYPGRADHPQAALVKKQMRGGSTLVGFEVKGGKAAAFRVLNELKLAKISNNLGDAKSLVTHPATTTHQRLKPEDRAALGISEGFIRFSAGLEHADDLIEDLTAALEKA

SEQ ID NO: 18122 - protein, 312 aa, Bradyrhizobium japonicum USDA 110
MTDWTTADIPSLSGRTAVVTGATGGLGYETAMALAGAGAIVILTGRNDAKGLRAIEGICERFPDALIAYEHLDLASLSSVADFAKRFAAGNEQLDLLVNNAGVMALPKRQQTEDGFEMQLGTNYLGHYALTARLLPQLRRAKASRIVNLSSLAHRSGAINFDDLQGKRSYRPWRAYCQSKLAMLMFALELQRRSLAAGWGVTSVAAHPGYARTDLIANGPGANTLQWRVGRWLQPFISQSAAEGALPTLFAATSPAAEPGGYYGPNRFYELKGPPAPAKITPQARDFAAAAMLWDVSATLTGVSFDDIAVAA

SEQ ID NO: 18123 - protein, 413 aa, Bradyrhizobium japonicum USDA 110
MCRTCITVHRNPRLRHRAHCAGVQSANDASRSPALPRSLRPRLFVTTRLRPPSCLSIGQTSLRLGARRCAALASVAVMASFFGLSGAARAATLVVTSTADSGAGSLRGEIVSATSGDTILFQVSGTITLLSELPIITKNITIDGNGNNPTISGAGTYRPFFIGDAGTTGSTYSVTLKSLTIANAVAQGGAGLGSGAGAGLGGAVFVSSNGALTLSNVAVSNTQAKGGGVVDNFGEVGGGGGMGGKSYPLTPAGGGGLFVGSDANSSGTAGGSSGGVHNGGSGPQTGGAGGFASGGGGGSSGGGPVAGGAGGFGGGGANAGGATTGGSGGYGGGGGSAAGLSTSTGGAGGFGGGGGGGITAAGSGGFGAGNGGSGGTGSNSGGGGLGAGGAIFVQSGGTVAVQGDLSNALTHSR

SEQ ID NO: 18124 - protein, 487 aa, Bradyrhizobium japonicum USDA 110
MSADFSRRHFAKLAGLAALGAATGVGAAESETPASAGRGAPFPKDFLWGTATSSYQIEGAVNEDGRGKSIWDVFSHTPGKIEDGSTGDRANEHYHRYREDVALIKALGVRAYRFSIAWPRVFPDGTGQPNPKGLDFYNRLVDELLASGIEPYATLYHWDLPQALQDRVGGWQSSDTSKAFADYAAYVAARLTDRVKNVFTVNEVGRFVNFGYGWGIDAPGLKLPAVQLNQARHHVALAHGLAVQAIRASGRAGTRVGAAENIAACVPAIATAENIRAAEIATRELNAGFLGVVLEGRYTDGFLAYAGADAPKFTAEELKIIGAPTDFVGLNIYAPQFYVTASDRAPGFHVLPFPTSFPHMNSEWLRVGPEVIYWAPRLAAKIWNIETIYISENGTSSEDRIAADGQVYDLDRIMFLRNYLTQMQRAVAEGVPIRGYFLWSLMDNFEWIFGYGKRFGLYRVDFETQARVAKLSAAFYRDVVARNAIGV

SEQ ID NO: 18125 - protein, 356 aa, Bradyrhizobium japonicum USDA 110
MWLAGLGVTAFALRLLLGLWVPDLRALEARLSGTTPGIERGFSRQQRIINTRNTMDIGFIGLGNMGFPMARRLIEAGNRLVVFDTRKEVVDKLVARGATPATSPKDVADQVETVMASLPSLQASLEVATGTNGVIEGSRVKRFIDLSTVGSTMASKIHGLLAKRDIVQIDCPVSGGVGGAEKGTLAVMVSGPKAEFELLKPALDVIGKVFFIGEKPGAAQTMKLANNFLSATAIVATSEAVVMGVKAGLDPAVMIDVINAGSGMNTASRDKFPRSVLPRTFDFGFATGLMVKDVRLALEEMKQLGLSMEVADAVGRLWETVISAEGADSDFTAAIKPIEKKAGVVVGGKTGGLAGK

SEQ ID NO: 18126 - protein, 286 aa, Bradyrhizobium japonicum USDA 110
MSKLKIAFQGEPGANSHIAIVEAYPDAEPMPCATFEDALSAISSGEADLGMIPIENSVAGRVADIHHLLPASGLFIIGEWFLPVRHQLMAVKGAKISDIKSVESHVHALGQCRRIIRKLGIKPIVHADTAGSARDISERKDKTVAAIASRLAAKIYGLDILAEDIEDEAHNTTRFVVLAREPKWAAQGSGPLVTTFVFRVRNLPAALYKALGGFATNGVNMTKLESYMVDGNFFATQFYADVDGHPEDKGLAFAIEELKFFSREFRIVGVYPGHPFRATFSETQQD

SEQ ID NO: 18127 - protein, 344 aa, Bradyrhizobium japonicum USDA 110
MTIEVRNLVKKFGSFAALDGVNLKVDNGELLALLGPSGSGKTTLLRIIAGLDWPDSGEVSFNGEDALAQGARERHVGFVFQHYALFRHMTVFENVAFGLRVQPRAVRKEEARIRARVKELLDLVQLDWLADRYPSQLSGGQRQRIALARALAIEPRILLLDEPFGALDAKVRKELRKWLRSLHHEINVTSIFVTHDQEEALEVANRVVVMDKGRIEQIGSPEDVYESPATAFVHGFIGESIELPVRIDDGVVRLGERPLRLAADGLAPGASRLFVRRHDMLVGPPGTGAFEGAVRHVRNFGPVQRAEVALFGGETIEIDAPRDRELRAGDRVGLEPRRYRIFAG

SEQ ID NO: 18128 - protein, 332 aa, Bradyrhizobium japonicum USDA 110
MDKLPAQMTVVAISKPGGPEVLVPEQRALPQPGPDEILVKVQAAGVNRPDVAQRSGAYPPPPGASDLPGLEIAGEVVAVGGNAKRHKIGDKVMSLVAGGGYAQYCIAQDAQAMSVPPALSIKEAGALPETLMTVWHNVFERGGLKAGETLLIHGGSSGIGTMAIQLAKAFGAKVFVTVGSQDKIDACLKLGADRAINYKTEDFVAVVKTETGNAGVNLILDMVAGEYVDRNYDAAAVDGRIVQIATLNGPKVSVNIAKVMVKRLTHTGSTLRPRSNADKAAMVAAIEAKVMPLLREGRVKPVMDSAFPLEKAADAHRRMETSAHIGKIVLEA

SEQ ID NO: 18129 - protein, 341 aa, Bradyrhizobium japonicum USDA 110
MDLTELNRIATAMVAPGKGILAADESSGTIKKRFDAIGVESTESNRRDYREMLFRSREAMSQYISGVILYDETIWQDAKDGTPLVKLIESSGAIPGIKVDEGTQGLPMCPGELVTVGLDKLAERLKKYYERGARFAKWRAVIDIGSGIPSMTAISVNAHALARYAALCQAAQIVPIVEPEVLMDGDHDIDRCYEVTQRVLNKTFQELRVQRVALEGMVLKPNMAISGKKCAKQAPVEEVAEKTIRLLKACVPAAVPGIAFLSGGQSDEEATAHLNAMHKLGPLPWGLTFSYGRALQAAPQKAWSGKAENVAAGQRAFSHRARMNGLASKGEWQSSLEKKAA

SEQ ID NO: 18130 - protein, 398 aa, Bradyrhizobium japonicum USDA 110
MANKFRTLDDVDVKGKRVLLRVDLNVPMENGRVTDATRLERVAPTITELADKGGKVILLAHFGRPKGRDAKESLKPVTEALSKVLNKPVAFADDCIGEPAATAVAALKDGDILCLENTRFHKEEEKNDPAFVAELAKLGDIWVNDAFSAAHRAHASTEGLGHKLPAYAGRTMQAELDALEKALGSPTKPVIAIIGGAKVSTKIDLLENLVSKVDALVIGGGMANTFLHAQGVGIGKSLAEKDLAPTALRIIEKAEAANCAIILPVDATVAYHFAANAPSHAYGLDAIPADGMILDVGPQSVARVHAAIDDAATLVWNGPLGAFEMQPFDRGTVAAAKHAAERTKAKKLISIAGGGDTVAALNQAHVAGDFTYVSTAGGAFLEWMEGKPLPGVEVLRIK

SEQ ID NO: 18131 - protein, 463 aa, Bradyrhizobium japonicum USDA 110
MTPTMLPSSQQARDVAYQLHAYTNARSHQRAGPLIIERGEGPYVFDTAGKRYLDAMAGLWSAGLGFSEKRLIEAAHRQMQILPFYHTFASRSNGPSIALAEKLVKMSPVPMSKVFFTNSGSEANDTVLKLIAYRSNAAGQPQRKKVISRLRGYHGVTIGAASLTGFPDNHRSFDLPLPNIMHTGSPHFYKDSRAGESEETFATRRAEELESLIQREGADTIAAFFGEPVMGAGGVIVPPPTYWDKIQSVLKKHSILLVADEVICGFGRTGKMFGCETYNIAPDVIVVSKQLTSSYFPLSAIIMNDYMFEPIADESNKVGLLAHGFTGGGHPVGAAVALENLKLIEERGLIANVGRIGAYMQERLRTLVDHPLVGEVRGVGLIAAIELVLDKKRKVAATTPGDVGSIASRLLHERGIIVRNVDDALSICPPLIVNKDQIDELIDGITGMLHDLKATVVNCREPH

SEQ ID NO: 18132 - protein, 510 aa, Bradyrhizobium japonicum USDA 110
MSRLTLRSCWIFVLSQNASSFSRIGKVLLRDLKSRRLLRRINVILCAPVTHAATRSSQRSIPEKARDNDARDKSTSRSMTKRFRNWALLSILASMVVGPAAKAQDRRTIAEPVAPDTVCDRPVPSGKNDTVSLQEAIEHCPDGAAVYLGRGEFHSGPLEMKSGVTLWVGRGATLIAIPEPAAYDKGLGQCGRIAEKGDGCRPFISFSKTRGGGIYGEGIIDGQGGALIGGGAETWWQLARRAQAQGGNQNAPRLIQVDHAQDITFSGVTLRNAANFHVAMNRVEGATFWALTIDSPADARNTDGIDLGASQDVTITHSWIRTGDDNVAIKAGDNGSSSHISIIDNYFGWGHGMSIGSEVNSGARDILVRNLTLDGTTSGLRIKSDVGRGGLVENVTYEYVCLRGNRWPLAFDAKYDPRAQGTRIPVYRQIVLRHVHGDTGVLLMRGIDERHALDVTLEDVRFANSATWQLEHANVSANHSDVWPPLPGRATQPPLRGSEVCSKAFRDGNR

SEQ ID NO: 18133 - protein, 445 aa, Bradyrhizobium japonicum USDA 110
MPTDPRFTGANPARAAMVGVSDFDGVLRGKHVLGEDLSDGDKVIKFSEAVLAWDCTDRVIPASFTQKPLSAFGDADLRILSGTGRSVSHLGSQYLYLAEFTGAHENICPRGVLRKVLRRAADHGYDCTAGFEFEFILFKENADTIEEKPFGEWAPLTRGPFGYSIARSIAQHELFGEILALCEKARIPLSGLHFETGPGVVEASLRHCDALEAADRATIFKSMIKAWAQTRGMMATFMAKVSEKWPGQSGHIHISMSSDSQNAFYDGDAFGNVSDLMRQFIAGQLEYMNEFCVLAAPNFNSYKRLVPGSWAPICPSWGVDNRSCAVRAIPGEPSAHRLEYRLPGADANPYLALACAIGSGILGVETGPALPASIVGDASVEMCRPSARLPQSLSEATSRFAESAAASDVFGERFVGAFSCSRHWEWQAVQHRVTDFERRRYFEII

SEQ ID NO: 18134 - protein, 421 aa, Bradyrhizobium japonicum USDA 110
MKTAKRSPIWHPFTQHALQRDMTKVVRGEGAYLYTEDGRRLIDAISSWWVVTHGHCHPCIVNAIREQAGKLNQVIFAGYTHDPAEQVATELLKVTSPALEHVFFSDSGSTSVEVALKMALGYWRNTGRERTKIVVMQHSYHGDTIGAMSVGSRGIFNAAYGALMFEVTSIPFPARDCEQRALDALENACRNEHPAAFIVEPLILGAGGMLMYSPSVLREMKRICEAFDVLFIADEVMTGWGRTGTLFACEQADVTPDIACYSKGLTAGALPLAVTLCRADIFDAHYSEDRTRTFFHSSSYTANPVACAAAKANLDLWQDQEYRWRLASLARMQEQALAPFRLDSRFANVRRTGTVTAVELNTRDAGYLADIGPRLLAFFQARDLLLRPLGNTIYVMPPYCVTAADLDEIYTAIRDAADLLM

SEQ ID NO: 18135 - protein, 454 aa, Bradyrhizobium japonicum USDA 110
MPLLSRQQRSAAVTLHQIPNTIKTDSFWMPFTANRQFKKAPRLFSSAEGMHYTTVDGRKVIDGSAGLWCVNAGHGRKQIAAAVERQLMTLDFAPTFQMGHPLAFDFAERLAEIAPKGLDRIFFTNSGSESVDTALKIALAYHRATGQSSRTRLIGRERGYHGVGFGGTSVGGMVANRRAFATLLPGVDHIRHTHDLSRNAFAKDQPEHGAELADDLERLVGLHGAETIAAVIVEPVPGSTAVLPPPKGYLQRLREICDKHGILLIFDEVITGFGRLGTPFAANFFGVTPDLMTTAKGITNGTIPCGAVFASRKVHDGMMVGPENQMELFHGYTYSAHPTACAAGIATLDIYKDEGLLTRGASIAEYWRDALHSLKGLPNVVDIRNCGLMGAVELAPRAGVVGARGYDVMVDCFNTGLYLRMSGDSFAMSPPLIVEKSHIDQMVSILGDAIKKVA

SEQ ID NO: 18136 - protein, 243 aa, Bradyrhizobium japonicum USDA 110
MIELTDVHKSFGKVEVLKGITAKVEKGEVVCIVGPSGSGKSTILRCINGLESYDRGEINVEGLKVDRDAPSIVNVRTQVSMVFQRFNLFPHRTVLENVVEGPLYVKKEARAQVLERGRALLAQVGLAEKADAHPPQLSGGQQQRVAIARALAMQPKAILFDEPTSALDPELVGDVLGVMRKLADDGMTMVVVTHEMGFARDVADRVLFIDGGVIVEQGPAKSVLNQPQHPRTQDFLRRVLHPL

SEQ ID NO: 18137 - protein, 2154 aa, Bradyrhizobium japonicum USDA 110
MALSDIASGAGSVGASGETKIFSHIGGLLDFYARRTPAAPALLAPGRPALTYGALGERTQDLVRTLRGLGIAPADRIAVALPRGADSALALIAVASSCACIPVNPDLTADELQRYFSELKLTALVTRADMNSASRDVARALDIAVIDFVPGPNDDLGGCAFVGPAVGPASTSGASRGDDDAFILLTSGTAARPKMVPLTHRNVCLSATNAGRVLSLTSHDRLLNVLPLFHAHGLISGLLTALAAGSSVICTEGFDASSFFGWMRELQPTWYTAVPTIHRALLTAAEANPDRARASSLRVIRSASASLAPAILGGLEATFGVPVLETYGMTEAASQIAANPFELRKLGSVGRAAGPEIAVMDETGRALASGAHGEIVLRGANMSRGYYNDEAATQAAFRDGWFRTGDLGYLDADGYLFIVGRIKDVINRGGQKISPLEVEEVLLSHPAVLEAGVFAVPHPKLGENVAAVVVLRANSEATSDQLRKFARKRLAAYKVPSLIRSVAALPKGASGKVKRNALADLIATAEDADAARLPRTTLETQLAEIWAGLLELPQVGIDQDVFALGADSLAVTQMRSRLRERFNVDFSFEDIFDCATVAALATRLETAATHREAALPAWRRAGAATADAPLSYQQQRMYLLSRLDPTRYNYNVVEVALLKGLVDVAALSASLTAICARHEALRSVFVERQGEPAQLVLQSPPKFERIKLKLKPCPADKQVAVVRRETLKLAQYPFDLAHEPPLKVTLLSFDKSSHALVVNLHHLVTDGWSQRLFWEELAAHYAAARKKGVAALPSSTFQYRDFALWQQSWARTPVAKEQLDYWRTQLDGVTTLPLRTDRPRPEIWSGHGARHYFEFSRALSGDVRALSQDQGVTPFMILLAVFQCLLFRHTSHEDVATGSLIANRNQIESERLIGLFANTLILRNDFGGDPSFGEMLRRVRQVTLDAYRNQDLPIEEVLRALQIARRSDGNPLFRIMFILQNASIEAARFPGLSTRRLEVDPNVARFDITLELVEADGRFTGFFEYATDLFDAATIEDMAAQFKTLLKAVIANPEQRISRLPLLTEAERRQLLAKGHGVPANFTTRGNLSERFDRQARTTPNAVAVSDGHTSLSYRELARRSQAAARWLAREGVGAESVVALLAERGPDLLAAMIAVQRVGAAFLNLDPDQPPARLATILGSSCARVLLIGRAQSAMVEALLEPLVERIQVAELDDAIAPRATKPARAARRAASSLAYLIYTSGSSGAPKGVMIEQRGLSNHLASLISELKLSARDVIAQTAPQSFVISVWQFLAGPMVGARVHVCGNAIVQDPILLAREIEREGITVLEIVPSLLRVIVDRMDEAPILRAFARLRLLISTGEPLPVDLCRAWFARCPKVPLINAYGASECSDDVSLHRLTKPPATATSNVPVGAPLPNTQLYVLDANLEPQPVGVTGELCIGGAGVGRGYINDPAQNKQRFLPDPFLRQAASRLYRTGDLARRRADGTIECLGRADHQVKVRGYRIELKEIENALADHPSVRAGIVEPRREASGDVRLIAHIVARPGSRVSASELRDFLKSRLPGHAIPSAFLFMDQVPLNAHGKIDRSMLLAPAQQEASEPDAAVPARRFTEKVLSDIWIDLLKVENLSVTDNFFDLGGHSLLAGQAMARVARALGVSLPIKTIFEAPTIEELARRVDEAVAAKPHKPAASLPRLTETRLAENGPPTLSIAQDQMIRIEQSLPGLPLFNLPFAFRLQGPLDPATLAQAFGDIVRRHESLRTAFGWSGGEPVSRIATPSELGPVLTVEVIGDGRPHNNKRRQALELRKIDLLIEQETYTPFDTARPPLLRARLLRLHADDHVLLLTLHHAVADGWSIGVLFEELSSRYAALAGRPSAPLPKLPPAFSDVARWQRWWCGTDAARRQAADWTENLRGAAPIFDGDANPGASTGHHPLRLEPDLIARLTAFAGQHNATLFMCLLTGLKALLLARTGRTDISVATAMANRAQPDTDRIVGPFENTVIVRTKITPDLSFAQALVRVRQSVLDAHARQELPFNMLADHLEQQGIDPAALLQVYFTLQNPLRQPLDLPEIAVQSIGNIAREGQPVLPIDQTWLSLMLKERPTGITGSCNYKGELLEARMVGEWIEDFVALLGAAAAQPNTPLDRLLDRRAA

SEQ ID NO: 18138 - protein, 225 aa, Bradyrhizobium japonicum USDA 110
MSAGFRVLPRKRKVGEDVVAGFARLPVANVSDSMSRLTAAGARLRPMHQGGGLAGPALTVKAPPGDNLMVHKAIALAEPGDIIVVDAGGDLTNAIIGEMMLMQMAKRGVAGVVINGAIRDAGHIRGQELPVFAAGVTHRGPYKNGPGEINVPIAIDGMVIEPGDLIIGDDDGLLCVPFDQTGAVFKAATAKFEAEQKQIVNIEAGTHDASWVDRQLRELKCENID

SEQ ID NO: 18139 - protein, 367 aa, Bradyrhizobium japonicum USDA 110
MSRSTKLFETYKLGPITLANRLVMAPLTRNRAVPGTFVPGALAADYYGQRASAGLLITEASQVSQQGQGYQDTPGIYSKDQVAGWRKVTDKVHERGGKIFIQLWHVGRISHVALQANGAAPVAPSAIRAKGKTFVNGTFADVSEPRALELSEIRGIIDDFKRATKNALEAGFDGVEIHGANGYLLDQFAKDGANKRTDAYGGSIENRARLMLEVSRAVAAEAGTERTGIRISPVTPANDVSDSNPQALFDHIVDGLSALKLVYLHVVEGATGGPRDFAPFDYASLRKRFSGAYVANNGYDFDLATKVLDANAADLIAFGKPFISNPDLVERLKQGAALNDWDKNTFYGGSAKGYTDYPTLEAAEAAQ

SEQ ID NO: 18140 - protein, 245 aa, Bradyrhizobium japonicum USDA 110
MTSEILIAPSILAADFARLGEEIAAIDAAGADWIHCDVMDGHFVPNISFGADVIKAIRPVTKKVFDVHLMIAPVDPYLDAFAKAGADVITVHAEAGPHLDRTLQAVRALGKKAGVSLCPATSEGAIEYVLDRIDLVLVMTVNPGFGGQSFLESQLEKIKRIRTVIGDRPIRLEVDGGITRENAAAVAAAGADTLVAGSAVFRGKSSADYAGNIAAIRVAAEAGRVSKLQDISVQPMRAGESARLR

SEQ ID NO: 18141 - protein, 404 aa, Bradyrhizobium japonicum USDA 110
MSVRPQTKDKPAAASFQWDDPFLLDEQLTEDERMVRDTARAYAQDKLLPRITKAYLEETTDREIFNEMGELGLIGITLPEEYGCANASYVAYGLVAREIERVDSGYRSMNSVQSSLVMYPIYAYGDENQRKKYLPKLASGEWVGCFGLTEPDAGSDPAGMKTRAEKVSDGYRLTGSKMWISNAPIADVFVVWAKSAAHDNQIRGFVLEKGMKGLSAPKIGGKLSLRASITGEVVMDGVVVPEDALLPNVSGLKGPFGCLNRARYGISWGALGAAEDCMHRARQYTLDRKQFGKPLAATQLVQKKLADMETEIALGLQGSLRVGRLMDEGKFAPEMISIMKRNNCGKALDIARVARDMHGGNGISIEYHVMRHVHNLETVNTYEGTHDVHALILGRAITGIQAFF

SEQ ID NO: 18142 - protein, 320 aa, Bradyrhizobium japonicum USDA 110
MRDPYEVLGVPRSANAAAIKSAYRKLAKKHHPDSNKDDPKAAERFAELNSANEILGDEDKRKQFDRGEIDADGKPRFQGFPGGGGPRGRAGPGGFESYTFRSGGGPGQGGGAFEDILNSMFGGGVRGARPGAGGAGQFEFDTGGIGLDLDVNVAMSVSLEESVKGGEKRVRLPTGKELNVKIPAGVTEGQQIRLRGQGESAQGHPPGDLLITIGIAPHPYFKVEGADLRIDLPVTLYEAVLGGKVRVPTLGNAVELSVPKNTSSGRTFRLKGKGLPKAGGTGDLFVTVRIMLPDGNDAELEALMEKWRDQHPYNPRSGLG

SEQ ID NO: 18143 - protein, 309 aa, Bradyrhizobium japonicum USDA 110
MSTLLLSHKACLDHVTPPGHPERPDRLRAVEEALSHERFQFLVRDQAPEGDLDLVTLCHNEHYVTELRHIAPSSGLVYIDGDTSMSPGTWEAVMRGVGGAVAATEAVMAGEHRNAFVAVRPPGHHAEIGKPMGFCFFDNVAIAARHAQRKYGITRAAIVDFDVHHGNGTQDIFWSDPTVMYCSTHQMPLFPGTGAKGERGDHDTIVNAPLASEDGGPEFRSAFENLILPQLEKFSPELLIISAGFDAHYRDPLASLNLRAEDYAWVTRKLMDLADRTAGGRVVSVLEGGYDLQGLKESVTAHVGALMGA

SEQ ID NO: 18144 - protein, 482 aa, Bradyrhizobium japonicum USDA 110
MDVNLLISGRDQAASTGKVFERRNPLSQEVASRAAAATVSDADAAVAAASAALAAWSALGPNARRALLLKAADALEAKRDAFIRIMMAEIGTTEVWSAFNVKLATGMLREAASLTTQVAGEVIPSDKPGCLAMAVRQPAGVCLGIAPWNAPIILGVRAVATPLACGNTVVLKASEICPGTHRLIGEVFRDAGFPPGVVNVLTNAPADAPAVVERLIANPAVRRINFTGSTRVGRVIAELAGRHLKPVLLELGGKAPLVVLDDADLDAAVAAVAFGAFINQGQVCMSTERVIVDESVADQFVAKLAKKAGALPAGDPRSGPVVIGSMIDEAPARHVVALIDDAIGRGAVKLAGGERAGTVVPATVLDRVVPGMRIYSEESFGPVVSVIRARGVDDAVRLANDTEYGLSAAVFGRDVARALTVAQRIESGICHVNGPTVHDEAQMPFGGVKGSGYGRFGGQAGIAEFTDLRWITIETQPQHYPF

SEQ ID NO: 18145 - protein, 355 aa, Bradyrhizobium japonicum USDA 110
MKSFKVADFKAPLQEFDEPTPQPSGTQVLIKVKAAGVCHSDLHIWEGGYDLGHGRKPLSLKDRGINLPLTMGHETVGEIVAFGPDVKPTDQGDLRLGDVGLVYPWIGCGKCATCLGGDENMCLTPRSLGVYCDGGYSDHMLVPHPRYLLNLKGLDPATTAPYACSGVTTYSALKKVEQHFDTPIVMFGAGGLGLMALSLLKAMGGKGAIMVDIDARKREAAEKAGALATVDPKAPDALEQLAKKAGGPIRAVIDLVGNAATTQLGFDCLTKGGKLVIVGLFGGGATWALPLIPIKAVTIQGSYVGNLRETQELLDLVRTKNVPPIPVTRQPLAKANDALVQLQQGAVVGRTVLTP

SEQ ID NO: 18146 - protein, 418 aa, Bradyrhizobium japonicum USDA 110
MALRRRPPNRRCLVSEPLVIVGNGMAAARLVDELAKTSLGRYAVAVIGDEPRLAYNRVLLSSVLAGETGSHEIELRPADWWRHRGVTVRYGYRVTEIDTGRRELKIEGEESMEYSKLVLATGSTPLRLNVPGADLAGVHTFRDTRDVDLLLTLAAAKKRVVVVGGGLLGLEAAYGLAKAGAPVTLLHLMDRLMERQLDGPAADLLKTLVERKGIRILLNASTKCIHGDGHVEAVELADGSRIEADAVIFAAGIRPNIALAKDAGIAVNRGIVVNDVMQTASPDIFALGECAEHRGTCYGLVEPAYEQARVLARHLAGRPAAYQGSVVSTNLKVSGVSVFSAGDFIGGEGSESLVLSDRRRGTYKKLVIADGRLTGAVLIGDTVDALWYLELIRNRDKVAAIRTDMMFGRALARPSKAA

SEQ ID NO: 18147 - protein, 503 aa, Bradyrhizobium japonicum USDA 110
MAGSIAGAFVQGCLPKRPHHAPKKRLTMVNRMQFYIDGAWVDPAVKKSTAVVNPATEEAMYEVALGSKADVDKAVAAAKRAFATFSQTSREERVALLTKIIEIYKGRLKEIGAAVSDEMGAPLPMAEKLQAGAGLGHLMTTLDVLKNYHFEEPVGTAMVLREPIGVVGMITPWNWPLNQIACKVAPALAAGCTMILKPSEFTPTSALIFAEILHEAGVPKGVFNLVNGLGPEVGAAMSEHPDIDMISFTGSTRAGIDVAKRAAPTVKRVSQELGGKSPNVILEGADLTKAVTGGVMHMFNNSGQSCNAPSRMIVPLSKMKEVAAIAKAVADKTKAGDPRAEGTTIGPVVNRGQWDKIQGLIKKGIDEGATLVAGGPGLPEGVNKGFYVRPTIFADVTPDMTIAREEIFGPVLTIIGAKNEADAVQIANDTPYGLAGYVSADTVESAKRVARQIRAGNVNLQGVPNDRTAPFGGYKQSGNGREWGKYGLEDFLEVKAVAGFNAA

SEQ ID NO: 18148 - protein, 406 aa, Bradyrhizobium japonicum USDA 110
MTGGPVIIVGAGHGGYQVAASLRQAGFSDRVCLINDEAHLPYQRPPLSKAYIKGSAGPESLMFRPEKFYADQKIELIAGRAVSIDRAGRRLHLASGEMLDYGHLVLATGARNRLLDLPNANLPDVKYLRILDDSEALRKIMPSRTRVVVIGAGFIGLEFAATARIKGLEVDVLELAPRVMARAVTSEVSAYFQARHREAGIRIHLGVQATSIEAEDGRVTGVSLSDGRHLPADLVVVGVGVLPNIELAAEAGLPVAAGIIVDEYLSTADPDISAIGDCALFASPRFGGSLRLESVQNATDHARCLAARLTGDRKPYDSHPWFWSDQGDDKLQIAGLTTGYDRVVLRGDPAKKAFSAFCYRGDKLVGIESINRAGDHMFGRRLQGMDRSITPEQAADESFDLKSALA

SEQ ID NO: 18149 - protein, 404 aa, Bradyrhizobium japonicum USDA 110
MSSSVIDYLATETRLGAHNYEPIGVVLSRGEGVWVWDTDGNRYLDCLSAYSAVSQGHCHPKILAAMVEQAHRLTLTSRAFHNDQLAPFYEEIAALTGSHKVLPMNSGAEAVESAIKSVRKWGYEVKGVPDDQAEIIVCADNFHGRTLGIVGFSTDPETRGHFGPFAPGFRIIPFGDAAALEQAITPNTVAFLVEPIQGEAGVIIPPAGYFTKVRELCTANNVMLVLDEIQTGLGRTGKLLAEQHEGIEADVTLLGKALAGGFYPVSAVLSNNEVLGTLRPGQHGSTFGGNPLACAVARAAMRVLVEEGMIENAARQGARLLEGLKDIRANTVREVRGRGLMLAVELHPEAGRARRYCEALQGKGILAKDTHGHTIRIAPPLVITSDEVDWALEQFATTLTQDFS

SEQ ID NO: 18150 - protein, 1078 aa, Bradyrhizobium japonicum USDA 110
MSSKNRLDPIPQPPTKPVVGNMLSLDSAAPVQHLTRLAKELGPIFWLDMMGSPIVVVSGHDLVDELSDEKRFDKTVRGALRRVRAVGGDGLFTADTREPNWSKAHNILLQPFGNRAMQSYHPSMVDIAEQLVQKWERLNADDEIDVVHDMTALTLDTIGLCGFDYRFNSFYRRDYHPFVESLVRSLETIMMTRGLPFEQIWMQKRRKTLAEDVAFMNKMVDEIIAERRKSAEGIDDKKDMLAAMMTGVDRSTGEQLDDVNIRYQINTFLIAGHETTSGLLSYTLYALLKHPDILKKAYDEVDRVFGPDVNAKPTYQQVTQLTYITQILKEALRLWPPAPAYGISPLADETIGGGKYKLRKGTFITILVTALHRDPSVWGPNPDAFDPENFSREAEAKRPINAWKPFGNGQRACIGRGFAMHEAALALGMILQRFKLIDHQRYQMHLKETLTMKPEGFKIKVRPRADRERGAYGGPVAAVSSAPRAPRQPTARPGHNTPMLVLYGSNLGTAEELATRMADLAEINGFAVHLGALDEYVGKLPQEGGVLIICASYNGAPPDNATQFVKWLGSDLPKDAFANVRYAVFGCGNSDWAATYQSVPRFIDEQLSGHGARAVYPRGEGDARSDLDGQFQKWFPAAAQVATKEFGIDWNFTRTAEDDPLYAIEPVAVTAVNTIVAQGGAVAMKVLVNDELQNKSGSNPSERSTRHIEVQLPSNITYRVGDHLSVVPRNDPTLVDSVARRFGFLPADQIRLQVAEGRRAQLPVGEAVSVGRLLSEFVELQQVATRKQIQIMAEHTRCPVTKPKLLAFVGEEAEPAERYRTEILAMRKSVYDLLLEYPACELPFHVYLEMLSLLAPRYYSISSSPSVDPARCSITVGVVEGPAASGRGVYKGICSNYLANRRASDAIYATVRETKAGFRLPDDSSVPIIMIGPGTGLAPFRGFLQERAARKAKGASLGPAMLFFGCRHPDQDFLYADELKALAASGVTELFTAFSRADGPKTYVQHVLAAQKDKVWPLIEQGAIIYVCGDGGQMEPDVKAALVAIRHEKSGSDTATAARWIEEMGATNRYVLDVWAGG

SEQ ID NO: 18151 - protein, 449 aa, Bradyrhizobium japonicum USDA 110
MSTRTSRVLHRSLRETPPKAIGGEGIYLFAEDGRRVIDASGGAAVSCLGHQHPRVIAAMAKQASTLAYAHTAFFSSEPAEALAETLVGHEPGGLAYAYFVSGGSEAIEASIKLARQYFIERGEPQRQHFIARRQSYHGNTLGALAAGGNAWRRAPYAPLLSAAFSHVTPAFAYHEKHDGESDAQFVARLAAELEAEFQRLGPNSVAAFLAEPVVGATAGAVTAPDGYFRAVREICDRHGALLILDEVMCGMGRTGTTHAWEQEGVAPDIQAIAKGLGGGYQPIGAMLASGRIIDTIRSGSGAFQHGHTYLAHPLACAAALAVQDVIREDGLLDRVKERGKQLEQRLTERFGNHRHVGDIRGRGLFWAIELVADRASRTSFDPALKLNQKIKAEAFANGLGCYPGGGTVDGVRGDHVLLAPPYIASVAEIDLIVDKLGTAVDNVLRSVNH

SEQ ID NO: 18152 - protein, 512 aa, Bradyrhizobium japonicum USDA 110
MDKPTPKADVFQANRDRVAPLLKTLRADGIGHMIDGKIVPSISGETFETKSPVDGAVLASVARGNAEDIDRAATAAALAFKSWREMGPAMRKKLLHRVADAIEDNADDIAVLECIDTGQAYRFMAKAAIRAAENFRFFADKCAEARDGQNTPSDEHWNVSTRVPIGPVGVITPWNTPFMLSTWKIAPALAAGCTVVHKPAEWSPATAAILARLVKEAGVPDGVLNTVHGFGEEAGKALTEHPAIKAIGFVGESATGSAIMVQGAPTLKRVHFELGGKNPVIVFDDADLDRALDAVVFMIYSLNGERCTSSSRLLIQQSIAEKFVEKLTARVKALKVGHPLDPSTEIGPLIHERHLAKVCSYFDVARKDGATIAVGGKAYDGPGGGHYVEPTLVTGAHGKMRVAQEEVFGPFLTVLPFKDEADAIEVANDIRYGLTGYVWTNDVGRALRVADALEAGMIWLNSENVRHLPTPFGGMKASGIGRDGGDYSFDFYMETKHVSLARGTHKIQKLGI

SEQ ID NO: 18153 - protein, 507 aa, Bradyrhizobium japonicum USDA 110
MTMSEESKPSGPDLTEGVALTAFRDGKLLGHVGAEDVLLVQAGGEVFAIEPACSHYHGPLAEGLVVDDTIRCPWHHACFSLRSGEATRPPALSALAVWEVTRDQDRIIVQRKREAPKPTARSAPAPEKFVIVGGGAAGFAAAEMLRREGFAGAITMLSDDGAMPVDRPNLSKDYLAGNAPEDWLPLRGEDYYRDAGIDLRLNTNVSAIDAKTRSVTLGNGDRLPFDRLLLATGAEPVKLQIPGADQPHVHTLRSVADSRAIIKAAGSATRVLVIGASFIGLEVAASLRARKLEVHVVAPEERPMQRVLGPEMGDFVRALHEENGVNFHLGDTVERLDGTRATLKSGGVIEADLVVVGIGVKPRLALAEKAGLAADRGVSVSEYLETSIAGIFAAGDIARWPDPHSRQTIRVEHWVVAERQGQTAARNMLGRRERFDAVPFFWSQHYDVPINYVGHAESFDDIVIDGSIAGRDCLLKYRKAGRVLAVASIYRDLDSLKAELDMERRGL

SEQ ID NO: 18154 - protein, 463 aa, Bradyrhizobium japonicum USDA 110
MHSPNPDMSQLFADRQAQRSALHNRYLNEQFVRVLKTIGYDVGFQKGQGQYLYDRDGARYLDLLSGFGVFAIGRNHPVMRDALKSVLDADLPNLVQFDVSTLAGVLAERLLKYVPYLDKAFFANSGAECVEAAIKFARGATGRPGIVYCAHGYHGLTYGALSLTGDSNFRTGFEPLLPGCTPVPFNDLAALEKALASREVAAFVVEPIQGKGVNMPTDEFLPGAAALCKKYGTLFVADEIQTGMGRTGRFLAVEHWNVEPDMVLLSKSLSGGHVPVGAVLTRKGIFDKIFNQMDRAVVHGSTFSKNDLAMAAGIATLDVMESEKLIESAAKRGAELRLALTRMVPGYELMKEVRGKGLMIGVEFGPPKSLRLRASWNVLEAANKGLFCQLITVPLFKDHKILTQVAGHGSHTIKLLPPLTITEEDCGWIERAFDDVIAGSHKVPGAIWSLGKTLVDNAVRRSA

SEQ ID NO: 18155 - protein, 322 aa, Bradyrhizobium japonicum USDA 110
MKAYVYGPEGARISDVAQPKPKGTQVLVRVRACGLNRADTGMRKGHAHGAAGGVGTVLGMEWAGEVAELGPDAKGVKVGDRIMGSGGAAFAEYTLADHGRLFRAPSNMNFEEAATLPVALATMHNAVVTVGGVQAGQSVLIQGASSGVGLMAMQIAKLKGARLVIGSSTDAYRRGRLTEYGADLAVDSSDPKWVEEVLKATNGEGVDLIVDQVSGKVANQNLAATRIKGRIVNVGRLGGTHADFNFDLHAARRIDYVGVTFRTRTIEEVREIFEEVRKDIWGAVESRKLQLPIDRVFAFADIDKAFEHMEANKHLGKIVVTV

SEQ ID NO: 18156 - protein, 295 aa, Bradyrhizobium japonicum USDA 110
MIDIGFIGLGTMGRPMAGHLLAAGHRVLLHDVAPVSPELIAAGGIACKSGREVAEEADAVIIMVPDTPHVEAVLFGKDGVASGISKGKIVVDMSSISPLATKEFAKKIEALGADYLDAPVSGGEVGAKAASLTIMVGGPERAFGTMKPIFDRMGKNITHVGANGDGQTTKVANQIIVALTIEAVSEALLFASKAGANPALVRKALMGGFASSRILEVHGERMVKRNFDPGFRIELHQKDLNLALEGARSLGLSLPSTAVAQQLFSSCTAHGGKGWDHSAMVRALELMAGHEIAAA

SEQ ID NO: 18157 - protein, 497 aa, Bradyrhizobium japonicum USDA 110
MINLSSFIAFHARRTPERPALKYRGEEISYAVFDARIRKAAGWLAAQGIGAGDVVAVLMKNSAAFLELVFATSHLGAVFLPINFRLSRDEVGYIAGNAGARLLMVDEELAANAAGAKIVVLDEAAQQSVTRLAGGAAAAPMHVRAPSDLMRLMYTSGTTDRPKGVMLSYDNFYWKSADQTIALGLSAETRLLVVGPLYHVGALDLPGIAVLWHGGFIRIERNFEPETALAAIAEDRLNAAWFAPVMTTAMLTCPTRDRYDVSSLTWAIGGGEKTPELRIRAFSEYFRNARYIDAYGLTETVGGDTFMEAGREIEKIGSTGRAIAHVEIEIRDEEGRTLPPNVNGEICLCGPKITRGYWKDSEKTAAAFFGDWFRSGDVGYLDDEGFLYLTDRKKDMIISGGENIASSEVERVIYELSEVREVAVIGLRDARWGERPVAIVVLAEGASLELPALTEHCRARLASFKVPKQLVVRDSLPRNPSGKILKRVLRAELETSE

SEQ ID NO: 18158 - protein, 311 aa, Bradyrhizobium japonicum USDA 110
MLIASGDALIDFVPTRNADGREAVMPAVGGSCLNVAIGMARLGAPTGFVGGISTDLFGQMIADHATASHVELGLATRSDHQTTLAFVRIVAGESHYAFYDAETATRNWTYRRGSVAFDTVEVLHVGSTTLVNDEGAAETKALIADARMSSTISFDPNCRPNLVRDKPAYLARMAEFAQSADLIKMSDVDFAYLFGDEPYQQRASTLLGQGTSLVVVTRGNNGAIAWHAGAGRIEVQAPRVEVADTIGAGDSFQAALLFALHKQGRLARQQLKVINADELRRALSFAANCAGLTCTRPGADPPWSHEITWSP

SEQ ID NO: 18159 - protein, 263 aa, Bradyrhizobium japonicum USDA 110
MSEISMNAASGVEGATQLRDVPAVRMEAVYKHYGDFTALNEVDLKVAKGEKIVVCGPSGSGKSTLIRCINHIEKHDEGLIYVNGVELDRQRKNIDAVRRDTGMVFQSFNLFPHMTVLENCILAPMTVNSMSEAEAKDLAMHFLTKVRIPDQAEKFPGQLSGGQQQRVAIARALCMRPKIMLFDEPTSALDPEMVKEVLETMKKLAEEGMTMLCVTHEMGFAREVADRIVFMNEGKVVEQAAPEEFFQHPKSERARTFLDQIIH

SEQ ID NO: 18160 - protein, 513 aa, Bradyrhizobium japonicum USDA 110
MLPETSGIYGIAAGEITYRAMLERVERWRAAFAGRGYGEGHRVGLLLQNRPVFVELWFALNALGVSVVPINPDLRLSELEYIIAHSEMNAAFVLVERRDEVETAARQAGRPIPVVTSEDDVPAPFGGVRPASTGDGATECALLYTSGTTGQPKGCVLTNTYFLHSGNWYRDVGGLIALKPDGERMITPLPLFHMNAMAVSLMAMLSVGGSLTMLDRFHPRSWWASVRDSRATCLHYLGVMPSMLMSAPPSEQDRAHTVRFGFGAGVDKLLHAPFEDRFGFPLLEAWAMTETGSGGVIAANVEPRKIGTSCFGRPAPEVDVRIVDDGGNDAPIGTPGELLVRRAGADPRYGFFREYLKNPEATAEAWEGGWLHTGDIVSRDVDGDLHFVDRKKNVIRRSGENIAAVEVESVLNRHPAIRQAAVAATPDQVRGDEVAAVIIAEEAGAGRALAEDIVRWSLEQMAYYKAPGWICFTDSLPLTATEKIQRGGLKDFVARLMCDGAFFDLRDLKRRQV

SEQ ID NO: 18161 - protein, 216 aa, Bradyrhizobium japonicum USDA 110
MDAQEIIARRVAQELHSGDLVNLGIGIPTLVANYVSPDLKVFFQSENGLIGTGPIPEQGLSDPLLTDAGGRPISALPGASTFDSAMSFGFIRGGHVDVSVLGGLQVDALGHLANWMIPGKMVPGMGGAMDLVSGARRVIVAMQHAAKGKSKIVAKCSLPLTSARPVHLVVTDMAVIAFPDGRATLLETAPGISVGEVMAVTDAELVVHDKIPEMKI

SEQ ID NO: 18162 - protein, 217 aa, Bradyrhizobium japonicum USDA 110
MRAVSVEEAVAMIPSGASIMVGGFMGVGTPERLLDEVVRQHKTGLSVISNDAATPGKGVGKLFDAALVSRLIATHIGLNPKAQQQMLANQIAVDLIPQGTFAERIRAGGCGLGGVLTPTGVGTLVAEGKRQIEIDGRPFLLETALRAQFALVHAFLADYLGNLSYALTARNFNPVMAMAADTVIVTAEHIVPVGVIAPDHVLTPAPLVDYLITNPNG

SEQ ID NO: 18163 - protein, 408 aa, Bradyrhizobium japonicum USDA 110
MPGLNRTRDTTLRARAEKVVPGGMWGHLHAAKLPDGYPQFFRRGEGGVLWDVDGNRYVDFMCSWGPNLLGHHHPEVEEAAERQRREGDCLNGPAEVMVELAELVVDMVGHADWTQFQKNGTDATTTCVTIARAATGRRKILVAKGAYHGAVPWCSPSLLGVTAEDRAHLAYFTFNDVESLEVAAKAAGDDLAGILVSAYRHDLGLDQELPTVEFAHAARRICDDRGAALIIDEVRAGLRLNAAGSWEGLGVRPDLSAWSKAIANGYALAAVTGANWLRGAASQVFVTGSFWAGAVAMAAAVATLKIVRRDNVPSRLAQLGQMLREGLETRSRQFGVSIRQSGPAQMPTLLFDQDPAYRKGSAFCSAMLARGVYFHPKHNMFLCAAHTEADIAEALQAAEHGFAVVAGL

SEQ ID NO: 18164 - protein, 412 aa, Bradyrhizobium japonicum USDA 110
MPGSIGLFQHGDLSSSRCAAAGLLARIQQWLLAPRHKSAGTKNAEAEIADGAPKFAGETEEMMRAQVLRAYDEKLSNDLWVGEEKVPDPKLTKSTDVIVRIGGAGVCRTDLHIVEGVWKPHMDPSGDKLLPLIMGHENAGWIEEVGKEVEGLKKGDPVIVHPKISGGTCLACRRGFDMHGPGTFPGLDCNGGYAEFLCTSERNIVPLPRTLAPKDVAPYADAGLTAYRAVKKATRHLLPGESCVVIGAGGLGHIGIQCLKAMCAADIIVVDKSEASLKLAEKSGADHLVKADGNEVEAVLGLTGGNGAEAVIDFVGEKGTTSKGLAMTRPMGSYYVVGYGEDIRVPTVDMVITEKNIIGNLVGTWAELTELMALADRDLVELATTEYRLADANKALHDLNAGEIHGRAVLIP

SEQ ID NO: 18165 - protein, 290 aa, Bradyrhizobium japonicum USDA 110
MAKVAFLGLGVMGFPMAGHLVKKGGHEVTVYNRTAAKAKEWADKFGGKTAATPKAAAEGQDFVMCCVGNDNDLRAVTIGPDGAFAGMKKGATFVDHTTASAEVARELDAAATKAGFKFIDAPVSGGQAGAENGVLTVMCGGAEDAYAGAEPVITGAYARMCKLLGPAGSGQLTKMVNQICIAGLVQGLSEGIHFAKKSGLDVAAVIETISKGAAQSWQMENRYKTMNEGKYDFGFAVEWMRKDLSISLAEARRNGATLPVTALVDQFYAEVEKMGGKRWDTSSLLARLNR

SEQ ID NO: 18166 - protein, 462 aa, Bradyrhizobium japonicum USDA 110
MAEFDVDLFVIGGGSGGVRAARIAAGHGARVMIAEEYRMGGTCVIRGCVPKKLFVIGSHVRHEIEDAAGFGWTIPSMSFDWATLIANKDKEIARLEAAYTTNVEKSGAQIVKSRAVIEDKHTVRLLENDRKITARYILIATGGAPNHGASIPGIEHVISSNEAFHLKTLPKRIVIQGGGYIALEFAGIFAGYGSDVTVIYRGDNILRGFDEDVRTHVRSEMEKQGITILTGCTVAKVDRHGEEFTTHLSNGSSVASDQVMFAIGRHPSVANLGLEKACVAINPKNGGIAVDHFSKSSVDSIYAIGDVTHRHNLTPVAIREGHAFADTVFGKREVRVDHAYIPTAVFSQPEVGTVGLTETEARAQFSHVDIYKTTFRPIKATMSGRDTRVLMKLVVDGTSDRVLGCHIVGDAAAEITQAVAIAVKMKATKADFDATIALHPTAAEELVTMRTPTARHVRQAAE

SEQ ID NO: 18167 - protein, 495 aa, Bradyrhizobium japonicum USDA 110
MMSVAYDFAHSPASEFMARPQHLLIDGRRVPASSGRTFKSLNPATGQVIATVAEGNEADVDHAVAAARRAFEGPWRTMRASERGQILLRWAELLKANAEEIIELESIDAGKPISATLRQDFPAAVDTLIYYAGWADKISGDVVPVRDDALTYTVREPVGVVAAIVPWNFPLMIGMWKLAPALACGCTIVMKPAELTSLSALRIAELALQAGLPAGVFNVVTGPGRVVGDALVNHPDVDKVTFTGSPGVGRGIMKGAAGNFKRVSLELGGKSANVIFDDADLEAASKAAASGIFFNAGQVCSAGSRVLVQEKAYDEVVERLAARAKSLKIGDPLDRKTALGPVISEKQMKSILDYVDIGQKEGASLVTGGTRVGERGYFISPAVFANVEHEMRISQEEIFGPVVSIIKFRDEADALRIANGTAYSLAAGVWSRDIGKLQRFAKRARAGTVWMNTYGYTDVRLPWGGERDSGLGREHGTAALDNFTEPKAVWMNLAV

SEQ ID NO: 18168 - protein, 285 aa, Bradyrhizobium japonicum USDA 110
MWPRAAVGGPAMQMNDKTVLITGSTDGVGRYVARRLAAECAKVLIHGRDAARAKTLIDEIVKAGHAAPIFYQADLSSMSGTRALAEAVKRDHQRLDVFVSNAGIGSQSDGPQRQVSADGHELRFAVNYLSGFLLAHLLLPLLKAAAPSRIVNVASLGQHPIDFDDVMITKGYSGSRAYAQSKLAQIMFTIDFAEEVKGAGVTVNSLHPATYMNTTMVRAGGITPISTVEQGGAAILRLVEGDDVAGKSGLFFNGINEARANPQAYDADARKRLRALSLELVGISS

SEQ ID NO: 18169 - protein, 509 aa, Bradyrhizobium japonicum USDA 110
MNIPSKPASIDVETHGNFIDGREVEAGNGAMLDVRNPATGDVIARIPNSTAEDIDRAMKSARAAFEGKAWGGMDTRARARLVNKLADAFEANLDSLYRLETLNNGRPVNETRAQLSRLPDFFRYFAGVALARRDSVIPVEGAYLNYTLRTPIGIVANCTPFNHPLMILCKSLAVVLATGCVTVVKPSEYTPLTTLKLAQIFTEAGLPPGVFNIVLGHGQSAGKMLAEHGDIDKLVLTGGTEAGRIAGSAAARVFAHQTMELGGKTPVMVFDDFDVDRAVNYAAFGAFIGAGQTCVCASRHIVQASIYDEFVEKLQAKTRTIRVGDPFDASTQMGPVISARQRDRVLTYAGYGHEDGARLVTGGVAAKVPGHDNGYFVEPTVFADVTSDMRIFQEEVFGPFTSVTPFKDEADALRLANDSPFGLAAAIRTRDVARAHRVAASVKAGIVWINDHHRLDPASPWGGVDDSGIGRECGTESFNDHFNTKSVMVATHEQPFDWYRDTANQKRLN

SEQ ID NO: 18170 - protein, 468 aa, Bradyrhizobium japonicum USDA 110
MEAARVFDSKPNSAEARDIAFHLHSQTNPQRHAEIGPLIMARGEGVHVYDASGKRYLEAMAGLWCTSLGFSETRLKAAAATAYDKFGFYHSFNHKTPDNTIELAEKLVEISPIPDAQAYFATSGSEATETMVKLAWVYHAVRGKPGKRKIIARDRGFHGSTIVAASMCGLPRMHREFGLPLDGFLHTHCPDAYRGTRPGESEAAFVDRLAADLEALIMAEGPDTIAAFIGEPINAGGGIVVPPKGYFAAIEAVLRRHDILVLGDEVVCGFGRTGNWFGCETVGMKPDMVALAKGITSSYFPMSAVLLGRPIRDALSEMNKGGELFGHGFTNSGHPVGAAIALETLNIYHEMDVVPHVRRMGSRLRAGLEQIARDSRIVGQVRGEGLMIGVELVAAPATRQAFDPALKVGAMFDALAIENGLIIRAMGDTIGFCPPLIIDEAGVDEALDLFGRTLFSAEAKLAEKRPSA

SEQ ID NO: 18171 - protein, 295 aa, Bradyrhizobium japonicum USDA 110
MATIAFIGLGNMGGPMAANLVKAGHKVVAFDLVEASRAQAKADGAGIADSASGAVKGADVVVTMLPAGKHVLGVWNEVVPVMTKGALIIDSSTIDVESARQAHALAAKNGVLSVDAPVSGGTGGAKGATLTFMCGGEDKAFAAAKPVLENMGKKIVHCGGAGAGQAAKICNNMILGISMIAVSEAFALGEKLGLSHQALFDVASTSSGQCWSLTTYCPVPGPVPSSPANNDYKPGFASALMVKDLTLAQDAAKAAGAATPLGQHAQEIYQAFDKAGQGGVDFSGIIKHVRGLAGK

SEQ ID NO: 18172 - protein, 497 aa, Bradyrhizobium japonicum USDA 110
MATVQVQGIREALTFDDVLLKPGLSDVMPGEVDIRSRVTRAIPLNIPIMASAMDTVTEARMAIAMAQAGGLGVIHRNFDPEGQAAQVRQVKRYESGMVVNPLTISPEATLDDALKLMSDHGISGIPVVTGAGKSTPGKLVGILTNRDVRFATDRRQKVSELMTHEGLVTVRENVSQDEARRMLHQHRIEKLLVVDEQYRCVGLVTVKDMEKAVAHPLACKDAQGRLRVAAATTVGDTGFERTERLIDAGVDLVVVDTAHGHSRHVLHAVNRIKRLSNSVQVVAGNVATSEGAQALIDAGADCIKVGIGPGSICTTRIVAGVGVPQLTAIMDAVEAAKKADIPVIADGGIKFSGDLAKALAAGADIAMVGSLLAGTDETPGEVFLWQGRSYKAYRGMGSVGAMARGSADRYFQQDIKDTLKLVPEGIEGQVPYKGAVGHVMHQLAGGLRAAMGYVGAKDMKELHDKAQFVRITGAGLRESHVHDVTITRESPNYPGGG

SEQ ID NO: 18173 - protein, 242 aa, Bradyrhizobium japonicum USDA 110
MALVEIRDVHKTFGKVEVLKGVSLDVEEGEIVTIIGRSGSGKSTLLRCINALESVDSGEIRVEGERVHAKMPGLKKFRQRVGIVFQAFNLFPHLKVERNITLAPLLTGRIDKARARTLAQDVLTRVGLAEKIDAWPEQLSGGQQQRVAIARCLAMAPHLMLFDEVTSALDPELVGEVLKVMEAMAKQGMTMILVTHEMGFARNVANRIVFMHQGRVWEQGPPAKLFANPETPELASFIASAK

SEQ ID NO: 18174 - protein, 481 aa, Bradyrhizobium japonicum USDA 110
MAKNTLSFVCQNCGAAYNRWQGKCESCGEWNTLAEEDTSGSVPVSIRSKRKGRTFALESLAGKSPDAPRLSSGMTELDRVTGGGFVRGSVLLVGGDPGIGKSTLLTQATSLMARAGHRIVYISGEEAIAQVRLRAERLGLSDAPVQLAAETSVEDIVSTLSEGAVPRLIVIDSIQTMWTDTVESAPGTVTQVRASAQALIRFAKKTGAAIILVGHVTKDGQIAGPRVVEHMVDAVMSFEGEGSQQFRILRAVKNRFGPTDEIGVFEMTGLGLREVTNPSELFLSERDLGTPGTAVFAGIEGTRPVLVELQALVAPTSLGTPRRAVVGWDPSRLSMVLAVLEAHCGVKLSGHDVYLNVAGGLRIHEPAADLAAAAALVSSLVNAQLPTDAVYFGEISLSGVVRPVAQTPARLKEAAKLGFQRAVLPESARGEAGGDAGLSLNAVNSLTTLVAEIAARGSRRGESGGSAEKNATPARFRRGEG

SEQ ID NO: 18175 - protein, 352 aa, Bradyrhizobium japonicum USDA 110
MALMRRQSLVKFDAPLCETIVDTPKPKGAEVLVRIERCGLCHSDLHIQDGYADLGGGKKLDTTRGMTLPFTLGHEIAGVVDEVGPDVPGGLVGSKKAVFPWIGCGQCRDCANGDENLCVKQRFLGVSIDGGFATHVLVPDAKYLLDYDPLPVNQAATLMCSGVTAYGALKRLVDRPRQRNLLLIGLGGVGMMGLSFAQATFKQPITVADLSPAARDTALKNGAANAYDPAEPDVIKRILKETEGGFDEIVDFAGNEKSMAFAVAVAARGGKIVVSGLMGGQFTLPMVQWVYKRMTIEGFMVGTLAEAKELMALARAGKIKPTPMREEPMGDVQKWIDELRAGKVVGRIVLKN

SEQ ID NO: 18176 - protein, 460 aa, Bradyrhizobium japonicum USDA 110
MSMLPNSQEARDVAYQLHPYTNARAHQQAGPLVIERGEGPYVFDASGKRYFEAMAGLWSVGLGFNEKRLVEAAHKQMLALPFYHTFSAKSHGPSIDLAEKLVALAPVPMSKVFFTNSGSEANDTVLKLIAYRSNALGQPQRKKVISRMRAYHGVTIASASLTGLPNNHRSFDLPLPNILHTGSPHFYKDGAPGESEEAFATRRAEELDALIQKEGPDTIAAFFGEPVMGAGGVIVPPATYWDKIQAVLKKYDILLVADEVICGFGRTGKMFGCETYGIKPDAIVVSKQITSSYFPLSAILMNDRMFEPIADESNKIGVLGHGFTAGGHPVGSAIALENLKIIEERGLVAHAAELGGYMQGKLRELAGHPLVGEVRGVGMIAALELVLDKQRKTAAATPGAVGGIASRMLQERGVISRNMLDAIAICPPLIVNKTQIDELVAAISGVLEDMKAEVAKLTPA

SEQ ID NO: 18177 - protein, 189 aa, Bradyrhizobium japonicum USDA 110
MMNRRTMLIAALAGAVAPVTRAVAGGGMSRISAYAFSFPALSGDDIRLAAFTGKPLLVVNTASLCGYTPQYAGLQELWSEFGERGLTVIGVPSNDFGGQEPGGTSEITETAHHQYGVTFPIAAKATVIGARAHPFYKWAADARPKDVPRWNFHKYLIGRDGYIAEVFASNIEPTDTRIKTAIAKTLADT

SEQ ID NO: 18178 - protein, 325 aa, Bradyrhizobium japonicum USDA 110
MEGPAMAAPLDPVIAQIIPLLPLRDPTTMTPQSARDSLRALAAARAAVPPPPVDTVQDIKVKGGAGPLDARLYRIGSDPAPTVVFFHGGGWVAGDLETHDRQARNLAIETGAVVVSVDYRRPPETRFPGAFEDAFAAARDIFNRVAEFGGDAKRLGVAGDSAGGNLAAATAIACRDAGIKLAAQLLVYPVTDVAGHYADARENARFPSRAENADGYFLSRAVMEWFCGHYLADPGHGADWRVSPLRAASLAGLAPAIVATASFDPLRDEGAAYARALEAAGVRVKHHEGPGLIHGYFGLGDASDVARAEAQRARADFKALLARGI

SEQ ID NO: 18179 - protein, 315 aa, Bradyrhizobium japonicum USDA 110
MPVVLDPDAAAVYMAFQEAGRPAYETLTAAEARAYYAQARFATNPEPPELARVAPLAIPAPHGTIPARIYVPNDPRRHDGLSPALVFFHGGGWVIGDLDSHDVVCRQLAVEAALIVISVDYRLAPEHKFPAAADDAIAATKWVAANACELGIDASRLSIGGDSAGGNLAAVVALAARDDSGPAIAGQILIYPAVDFAMTHGSHSEPETSVLLTHSVIRWFRDHYLNGAADIHDWRASPARAENLAGLPPAYVLTAGADPLRDEGDEYAARLKQAGVSVTYKHFPGQFHGFFTMGKLLREANVAVSEIGAWLKGLG

SEQ ID NO: 18180 - protein, 293 aa, Bradyrhizobium japonicum USDA 110
MPRVAFIGLGRMGHGMAGRYLDAGFTVTLWNRSKTKAEDLIARGAHWATSPEDAAIDADAVVTMVADDEASRAVWLGPKGAAKTAKAGTIAIECSTVSYDHAREMGRELNARGLIYIDCPVTGLPDAAAAGKLTLLVGADAADLERARPYLEPIGSTIRHFGAVGSGTVYKLINNLMGAIQIAGLAEGLAIAEQAGLDMTLVLESIQAGVAASPQVQRHSKRMVARDFSGATFTSALRHKDAAYAVKLAESLLADKPLVARAAVESYARAKAAMPDDDEGKMIELVSRPKKPS

SEQ ID NO: 18181 - protein, 413 aa, Bradyrhizobium japonicum USDA 110
MPGAQRAMEEFYRIRRLPPYVFEQVNRAKAAARNAGADIIDLGMGNPDLPAPPHVLEKLKETLGKPRTDRYSASRGIPGLRRAQAGYYARRFGVKLNPDTQVVATLGSKEGFANVAQAITAPGDVILCPNPSYPIHAFGFLMAGGVIRSVPSEPTPQFFEAVERAIVHSIPKPLALVVCYPSNPTAYVASLDFYKDLVAFAKKHEILILSDLAYAEVYFDENNPPPSVLQVPGAMDVTVEFTSMSKTYSMAGWRMGFAVGNERVIAALARVKSYLDYGAFTPVQVAATAALNGPDDCIKEMRDTYRKRRDALVESFGRAGWEIPPPEASMFAWVPLPEAFRSVGSMQFATLMVEKSGVAVSPGVGFGEHGEGYVRIAMVENEQRIRQAARGVRRFLESGIETLHNVVPLANRR

SEQ ID NO: 18182 - protein, 398 aa, Bradyrhizobium japonicum USDA 110
MTTATHPYDALMDITARPKAVFVRGAGSYLWDDSRKRYLDFVQGWAVNCLGHSPSAIADALAAQAKRLLTPSPAFYNEPSLKLAQALVANSAFDQVFFANSGAEANEGAIKLARKYGSLHKGGAFEIISFEGGFHGRTLATMSASGKKAFEPLFEPKVAGFKKAKLNDIASVEKLINDNTVAVMLEPIQGESGVWPATDQFLQELRALTKAHGLLLILDEIQTGMGRTGKLFHYEHTGIAPDIMTLGKGIGGGVPLAALLATERAACFEHGDQGGTFNGNPIMCAAGLAVLDEVGKPDFLKSVTETGLLLESELQKVSARHGLGGVRGRGLLLALDLKLPIAPGIVAQAFEAGVLLNAPQVDTLRFMPALNVTRAEIAEMIDCLDAILTKAGAARRVA

SEQ ID NO: 18183 - protein, 337 aa, Bradyrhizobium japonicum USDA 110
MTRRPNMQMRKLGDSGLAVSAIGLGCMGLNYHRGPAPERHEMIALVRAAVERGVTFFDTAEVYGPFTNEELVGEALQPVRKDIVIATKFGHDLGPADARRSGGLDSRPERIRQAAEGSLKRLRIETIDLYYQHRVDPNVPIEDVAGAVKDLIAAGKVRHFGLSEAGAATIRRAHAVQPIAAIQSEYSLWWRQPETEVLPACEELGIGFVPFSPLGRGFLTGKIDETTSFGGNDNRAGLPRFTPEARKANRPVVDLLAQIGARKRATPAQIALAWLLAQKPWIVPIPGTTKLGRLDENIAAAAVALTPDDIRHIDAAVAQITITGDRYPQAEAARTQR

SEQ ID NO: 18184 - protein, 444 aa, Bradyrhizobium japonicum USDA 110
MPTTQLPNTASLRPGFIWGVSTSSFQIEGATKEDGRGLSIWDIYCRSGEIKNHDTGDVACDHYHRYREDVGLMKTLGVQAYRFSVAWPRVLPLGLGSANEAGVSFYDRLIDELVAAGIEPWLCLYHWDLPQALEERGGWLNRESAAWFADYVTLIAARFGDRVKRFATFNEPSIFSLFSRSLGKREHSSEDKFHRMIHNVNLAHGAAVDVLRANVIGASIGCIHNRQPCRPSSASEADEAAAARLDVYWNAAFPDPQCRGEYPPSMRAAIEPHMQPGDLTRICRPLDWFGLNHYSPVYVKARADSMLGYDFGDKPASVPLTPIGWPIDPEAFSETLQAVRTRYGLPIYVLENGYGDSGQPDQTGAVIDPGRIEFLKAYINAMNNAAAHGVDVRGYFVWSLLDNFEWASGYSIRFGLTYVDYASLRRIPKSSFGWYAGLIRAVQP

SEQ ID NO: 18185 - protein, 325 aa, Bradyrhizobium japonicum USDA 110
MDASSATRAAHQPGRGRIYDSIVEAFGDTPIVRLRRLPGMHGVNATILAKLEYFNPAASVKDRIGAAMIIAMEKAGIVKPDTVLIEPTSGNTGIALAFVAASRGYRLKLVMPESMSIERRKMLAFLGAELVLTPAAQGMKGAIAAAEELVKTTPNSVMPQQFKNLANPEVHRRTTAEEIWNDTDGNIDFFVAGVGTGGTITGVGQVLKPRKASLRVVAVEPEESPVLSGGQHTPHKIQGIGAGFVPDILDRSVIDEIVKINSTTAIETSRALARHEGIPGGISSGAAIAAALQIGQRPEAAGKTILAVVPSFSERYLSTALFEGI

SEQ ID NO: 18186 - protein, 287 aa, Bradyrhizobium japonicum USDA 110
MSSAASSPDSVAFCADLVRSHDFPRYVATLFAPAAERRALLALYAFNVEIVRVRDQVSQPLPGEIRLQWWTDMLAGHVHGSAEGNPVAAELLRAIRDFDLPVEPLSLLADEHQFDLYNDPMPTMAALEGYLAATSSALFMLAARIMGPPSEAVEHLARHAGLAQGIVQVIVNLPRDAAHRQLFLPQQVLASHNCNMEDVFASRQTPNLHAVLEQLAGEARQHATTASSLLAQAPSSVRPAFLPLSQAQADLKRLARPGRNPFAPQPSSRLRTLWTLWRASRSREFTK

SEQ ID NO: 18187 - protein, 473 aa, Bradyrhizobium japonicum USDA 110
MADTSFDIIIIGSGPGGYVTAIRAAQLGFKVAIVEKSYLGGICLNWGCIPTKALLRSAEIYHYMQHAKDYGLSAEKVSFDPKAVVQRSRGVSKRLNDGVGFLMKKNKVTVIWGAASIDAPGKVTVKKSDVEAPKGALGEGTYQAKHIIVATGARPRVLPGLEPDKKLIWTYFEAMVPERMPKSLLVVGSGAIGIEFASFFHTMGSDVTVVEVLPQILPVEDAEIAGLARKRFEKQGIKILSSTKVTKLEKKADSVVATIDDGKGKPVTTEFERVISAVGVVGNIESLGLEKLGVKTDRGCIVIDGYGKTNVPGIYAIGDVAGPPMLAHKAEHEGVICVEAIKGLHPHPMDKNLIPGCTYCQPQVASVGLTEAKAKENGREIRVGRFPFVGNGKAIALGEDQGLVKVIFDKKTGQLLGAHMVGAEVTELIQGYVVAMNLETTEEELMHTVFPHPTLSEMMKEAVLDAYGRVLNI

SEQ ID NO: 18188 - protein, 505 aa, Bradyrhizobium japonicum USDA 110
MNKVEFLSVTKVPFAERYDNFIGGKFVAPISGKYFDNASPVNGQIVCKIARSDAQDVEAALDAAHAAKAGWGSTSVAERAAILNKIADRMEENLERLAIAETWDNGKPIRETRAADIPLAIDHFRYFAGVVRAQEGSIGEIDHDTIAYHFHEPLGVVGQIIPWNFPLLMACWKLAPALAAGNCVVLKPAEQTPASIMVWAEIIGDLLPPGVLNIVNGFGLEAGKPLASSPRIAKIAFTGETSTGRLIMQYASQNLIPVTLELGGKSPNIFFKDVTAEDDDFFDKAIEGFVMFALNQGEVCTCPSRALVHADIYDRFMERALKRVAAIKQGDPRAADTMIGAQASGEQLAKILSYIDIGKQEGAKVLAGGGRAELGGDLSGGFYVQPTVFEGHNKMRIFQEEIFGPVVSVTTFKTDDEALAIANDTLYGLGAGVWSRDANRCYRFGRAIQAGRVWTNCYHAYPAHAAFGGYKQSGVGRETHKMMLDHYQQTKNLLVSYSPKKLGFF

SEQ ID NO: 18189 - protein, 427 aa, Bradyrhizobium japonicum USDA 110
MTAIIDIIGREILDSRGNPTVEVDVVLEDGALGRAAVPSGASTGAHEAVELRDGDKARYLGKGVTKAVGAVNGEIFEALSGLDVEQQAQIDQIMIDLDGTPNKSRLGANAILGVSLACAKAAANSLDMPLYRYVGGTSARLLPVPMMNIINGGVHADNPIDFQEFMILPVGASSFAEGLRYGAEVFHTLKSELKKAGHNTNVGDEGGFAPNLPSADAALEFVMNAIGKAGFKAGSDIVIGLDCASTEFFKDGKYVYEGEGKTRSISEQAKYLADLVARYPIVTIEDGMSEDDMDGWKELTDLIGKKCQLVGDDLFVTNVKRLAEGIKAGRANSILIKVNQIGTLTETLAAVEMAHKAGYTSVMSHRSGETEDSTIADLAVATNCGQIKTGSLARSDRTAKYNQLLRIEQQLGKQALYGGKAALKALA

SEQ ID NO: 18190 - protein, 251 aa, Bradyrhizobium japonicum USDA 110
MTDAIRPLIAGNWKMNGLKASAAEFDAMLNGAADVATKADLLVCPPATLIAAFADKARGKKVAVGAQDCHPKASGAHTGDIAAEMLANAGATAIIVGHSERRADHGEGDALVRQKAEAAWRAGVTAIVCIGETQAQRDAGQTLDILRGQLDGSLPDGSTAANLVVAYEPVWAIGTGLTPTVQDVEQIHGFIREFLTSRFSVDGAKMRILYGGSVKPSNAAELMAVKNVNGALVGGASLKAADFLAIAKGCP

SEQ ID NO: 18191 - protein, 476 aa, Bradyrhizobium japonicum USDA 110
MVAKCTTAEDLVKAITDEKVQMIDLRFTDLPGVWQHFSVPPSAVNADALNEGIGFDGSSIRGFQEIQESDMLVVADPTTAFVDPYSPAKTLVLICNIRDPVTGQSYSRDARYIAQKAEIHLKGTGRADTSYFGPEAEFFVFDEVRYAQGINYAMHAVDSSEGSWNTGSEEGPNLGHKPRPKEGYFPVPPTDSMQALRTEMVLTMESLGIQIEAHHHEVATGGQNEIDMRFTTLTRMADNLMIYKYVVKNTAHQHGKTATFMPKPLFEDNASGMHVHQSLWKGETNLFYDKGDYAELSQLGRYYIGGLLSHAWALCGLCAPTTNSYRRLVPGYEAPINLVYSQRNRSACCRIPMYSPNPRAKRVEFRSPDPSCNPYLAFAAMLMAGLDGIDKQIDPGSPIDKNLYDLPPTEAKEVKSTPGSLDQALDALERDHAFLLRGDVFTADVIETWLDYKRKKEVDPIRLRPHPYEFHLYYDI

SEQ ID NO: 18192 - protein, 511 aa, Bradyrhizobium japonicum USDA 110
MPVEEAFVQGSGMEVLTNAEMQRADQLSIAAGTPGFKLMLSAGQAVAEAANALVEEGPILIVAGPGNNGGDGFVAAAELAAQGREVSVILMCERDQLQGDAASAARGWKHPVLPFNPQAIGKPALIIDALFGAGLSRPVDGEARAMIEAVNANGALVLAVDLPSGINGTSAAVLGAAVNATETVTFFRKKPAHLLLPGRMHCGRVRVADIGIDAQVLDEIRPQTFENDPDFWGAAFPVPRIDGHKYARGHVLAVSGDAAATGAARLAARGALRAGAGLVTLASPRDALAINAAALTAVMVRPVDTAIEFGELLGDKRYNTCIIGPGTGVGDRTCDFVHTALGAQRHLVLDADALTSFAANPERLFESIKASHDNAVVLTPHEGEFPRLFSDLSNKHPGRSKLERVRAAAERSGAVVLLKGPDTTIAAPDGRATIAANAPPWLATAGAGDVLSGIIAGLLAQGVPAFEAASIGVWMHGEAASEAGPGLIAEDLTETLPAVHRRIYNALGIEY

SEQ ID NO: 18193 - protein, 469 aa, Bradyrhizobium japonicum USDA 110
MKTAKDVLKSIKDNDVKYVDLRFTDPRGKWQHVTFDVSMIDEDIFAEGTMFDGSSIAGWKAINESDMCLMPDPVTATIDPFFAETTMVITCDVLEPTTGEPYNRDPRGIAKKAEAMVKSMGVGDTVFVGPEAEFFVFDDVRFSSSPYNTGFRLDSSELPTNTDTEYEGGNLGHRVRTKGGYFPVPPQDSVQDMRSEMLGAMAKMGVKVEKHHHEVASAQHELGMKFDTLTLMADHLQIYKYCIHQVAHIYGKTATFMPKPVYGDNGSGMHVHQSIWKDGKPVFAGNKYADLSETCLHYIGGIIKHAKAINAFTNPSTNSYKRLVPGYEAPVLLAYSARNRSASCRIPYTASPKAKRVEVRFPDPLANPYLGFAAMLMAGLDGIKNKIDPGPAMDKDLYDLPKEELKQIPTVCGSLREALENLDKDRAFLKAGGVFDDDFIDSYIELKMTEVERFEMTPHPVEFDMYYSG

SEQ ID NO: 18194 - protein, 454 aa, Bradyrhizobium japonicum USDA 110
MSTMAMPQPTASEAAVRYLITNYSPKGNKVGWLMMASILVEAWDLYSIAFVLIFIKEQYNPDPLMLGLAAAGTQGGALIGALLGGWLSDKIGRRVMFLVTMVLFIVLALAQAFVPTVGWLVVIRFLLGIPLGSDISTGYTYIMESMAKGEREVMGNRWQFMFAVGEVLTIGVIVIFLLIDMQHEMLWRVTLGLGAVPALIILIMRHDVPETAVWLVQKGRYREAKQVAREMFNDNLDMLPDQDVVVPKTSTRAFLADLKKDPIRWRATVYGWIACFTQASEFSTFAFYLPVLFVMVGVSSVLGINLVTMALFSFAALSGWVGPLLTPKIGHRGIAIAGFSIVMASLLVAAFALYTDNKILLPFAAAAMLWGHYWDASNCMTIPTMVAKPKYRGTASGFAYMFVKLPSFLAIFLFPTVFAAIGQANATLMVAIFPLIGLLAAIFILPEVYGYEND

SEQ ID NO: 18195 - protein, 510 aa, Bradyrhizobium japonicum USDA 110
MKHILDALEDRRAGAKLGGGEKRIEAQHARGKLTARERIELLLDKGSFEEFDMFVEHRSTEFGMEKTKVPGDGVVTGWGTVNGRKTFVFAKDFTVFGGSLSETHALKITKLQDMAMKARAPIIGLYDAGGARIQEGVAALAGYSYVFRRNVLASGVIPQISVIMGPCAGGDVYSPAMTDFIFMVKNTSYMFVTGPDVVKTVTNEVVTAEELGGASVHATRSSIADGAFENDVETLLQMRRLIDFLPSNNTDGVPEWPSFDDIGRVDMSLDTLIPDNPNKPYDMKELILKVVDEGDFFEIAESFAKNIVTGFGRIAGRTVGFVANQPMVLAGVLDSDASRKAARFVRFCDAFNIPIVTFVDVPGFLPGTAQEYGGLIKHGAKLLFAYSQCTVPLVTIITRKAYGGAFDVMASKEIGADMNYAWPTAQIAVMGAKGAVEIIFRSDIGDPDKIAARTKEYEDRFLSPFIAAERGYIDDVIMPHSTRKRIARALAMLKDKKVEMPAKKHDNLPL

SEQ ID NO: 18196 - protein, 297 aa, Bradyrhizobium japonicum USDA 110
MRIILLGPPGSGKGTQAQLLVERYGIVQLSTGEMLRAAVAAGTPVGLKAKEIMASGGLVPDDVVVGIISDRIDQPDAKNGFILDGFPRTVPQAEALDELLRQKHLKLDAVIELRVNESALLSRVETRVAQMRERGEEVRLDDTPEVLTKRLASYRSQTEPLIHYYSERRKLSTIDGMMAIDEVTRAVHRQLLALGAVEPKTHGKGTAKGTAQSAAKTAPAKKGAAKAKTAKKSAKTAKKPAKSAKKATKKAVKGTKKAVKKTAKKTVKKAAKKTARKAVKKGAKKAAKKVAKKRAKR

SEQ ID NO: 18197 - protein, 452 aa, Bradyrhizobium japonicum USDA 110
MSMISARIERLPFARFHKHLLLMGGLGYMFDAMDAAVLAFILPVLRTAWNLSSVQIGVLGSSTYIGFLFGALLAGTLGDLIGRRAVMMSALALYCAASIVSAMVDTWPSFFAARVVAGMGTGAESAIVAPYLAEFVARRYRGSFTGALAGFFSFGFVAAALLGYFIVPAYENGWRIVLVITAVPVVMLLWWRRALPESPRWLESRGREKEAEALLDTIEAGFARQGHVLPHPVVEAVAPQGATGTLLANFAALLAGRQARITIMTWIMWLAITFSYYSFFVWIPGLLVQNGMSITKSFAYSIAIYCAQIPGYFSAAYFNERIGRQATIATYMVLGGASALGLAFAQSDQQIMAAGIFLSLFMNGTYAGVYAYTAEVFPTPVRTTGAGLASAIGRIGAIVSPILVGYLYPNFGFAGVFGVTTTVLLLGAVTVVLMGVPTRGRSLEEIAAGEVA

SEQ ID NO: 18198 - protein, 140 aa, Bradyrhizobium japonicum USDA 110
MSAHSHEIEEGLSFQPRFDASGLVTCVATDVATGDVLMVAHMNDEALRKTIATGEAWYFSRSRNALWRKGETSGQTQRVVEMRTDCDQDAVWIRVEQIGAACHTGRRSCFYRKVEAEDGGAKLVFVDADRLFDPDAVYKK

SEQ ID NO: 18199 - protein, 327 aa, Bradyrhizobium japonicum USDA 110
MRMRKLGKSGLEVSALGLGCMGLSYGYGPATETSQAIALIRTAFERGVTFFDTAEAYGPFVNEELLGEALAPFRDKVVIATKFGFKGGKVEDGLDSRPANVKAVAEAALKRLKTDRIDLFYQHRVDPDVPVEDTAGAVKDLIRDGKVLHFGMSEAGAQTIRRAHAVQPVTALQSEYSLWWREPEQEILPTLEELGIGFVPFSPLGKGFLTGAITESTTFDKSDFRNIVPRFSSSARKSNQTLVDLLGEIATAKKVTPAQIALAWLLAQKPWIVPIPGTTKLHRLEENVGAAAVTLSDADLAAIAAVLAKVAVQGDRYPAHLQARVGR

SEQ ID NO: 18200 - protein, 341 aa, Bradyrhizobium japonicum USDA 110
MPTMKAAIVRQFGKPLVIEDVPVPQPGPGEVLVKVKACGVCHTDLHAASGDWPVKPVPPFIPGHEVAGIVAALGSGVKNLKVGDAVGVAWLHDACMSCEYCETGWETLCEHQHNTGYSVNGGFAEYVIASAAFAAKLPATIDFAGIAPILCAGVTTYKGLKETEAKPGEWVVISGVGGLGHVAIQYAKAMGLKVAAVDIADDKLELARETGADLAVNALAADAVDKVLAVTGGGAHGVLVTAVSTAAFAQALKMVRRKGTVSLVGLPPGEFPTPIFDVVLKRITVRGSIVGTRRDLDEAIAFAADGKVKAEVTKVPLAEINDVFDRMKAGKIEGRMVLDFG

SEQ ID NO: 18201 - protein, 233 aa, Bradyrhizobium japonicum USDA 110
MTQAFTPRPLAIAPSILASDFSRLGEEVRAVDAAGADWIHLDVMDGHFVPNISYGPDVIKAMRPHTKKVFDAHLMISPCDPYLEAFAKAGCDHITVHAEAGPHLHRSLQAIRALGKKAGVSLNPGTPIGVLEYVIDLVDLVLVMSVNPGFGGQAFIPSAIGKIRDIRAMTAGRPIDIEVDGGVGPDVAGALAAAGANAFVAGTSVFRGGTQDAYRTNIAAIRNAAAGARGEAI

SEQ ID NO: 18202 - protein, 342 aa, Bradyrhizobium japonicum USDA 110
MSIVLVTGGSGFVGIHVVLQLLAAGHTVRTTVRRPERQADVLAMLREGGAASPESLSFFTADLVRDEGWREAVAGCDYVLHVASPLSTSVPKDEDEMIIPARDGTLRVLRAAREAGVRRVVITSSLGAIGYGHKPREKPFDETDWTNLGGADVQAYIKSKTLAERAAWDFVAREGGGLELSVVNPAGIFGPVLGPDFSGSIEIVKSLLDGAMPAVPRVYFGVVDVRDVADLHLRAMTAPEAKGERFIAVSGEAMSILDIARVLRRELGPRARRVPRLQAPDWLVRLAANRIPLLRAVVPMLGRVRHSTSAKARSLLGWQPRSNDEAILATAESLIRLGLVRA

SEQ ID NO: 18203 - protein, 482 aa, Bradyrhizobium japonicum USDA 110
MTAILKNFIGGEWVDGSGVTRNINPSNTNDLVGEYAKADKAQTEKAIAAAKAAFPGWAQSTPQVRYDALNKISLEILARKEELGRLLAREEGKTLPEGIGEVARAGQIFAFFAGEALRLIGEKGASVRPGLDVELTREPMGVVGMITPWNFPIAIPAWKIAPALCYGNTVVFKPAELVPGSAHALSEIITRSGIPAGVFNLVVGSGSVVGQTLLDHPDVAAISFTGSVQTGRKIAQACVLSNPMKKFQLEMGGKNPLVVLDDADLKTAVEVAVNGSYFSTGQRCTASSRLIVTEGIHDRFVAAMAERLKGLSVDDALKAGVHIGPVVDQSQLDQDLRYIKIGQDEGAKLAFGGELLQRETPGHYLQPALFTEANNNMRIAREEIFGPVAAVIRAKNYEEALAISNDTEFGLASGICTTSLKYASHYKRNSESGMVMVNLPTAGVDYHVPFGGRKGSSYGAREQGSYAREFYTTVKTAYTYPG

SEQ ID NO: 18204 - protein, 262 aa, Bradyrhizobium japonicum USDA 110
MTMAQETQNGIQNPIIRVRDITVQFGATRVLDGLNLDVKRGEILGFVGPSGAGKSVLTRTIIGLVPKVAGSIEVFGVDLDSSNTSQRRNVERRWGVLFQQGALFSSLTVRQNIQFPMREYLRVSQRLMDEITMAKLTMVGLKPEVAERFPSELSGGMIKRVALARALSLDPDLVFLDEPTSGLDPIGAGDFDELVRTLQRTLGLTVFMVTHDLDSLYTACDRIAVLGNGKIIAAGSIADMQASQHPWLRQYFHGKRARAVMG

SEQ ID NO: 18205 - protein, 427 aa, Bradyrhizobium japonicum USDA 110
MVKPFPSKTHIGNHMLHPETLMLTYGYDPQLSEGAIKPPVFLTSTFVFRTAEDGQDFFDFVAGRREPPEGMGAGLVYSRFNHPNSEIVEDRLAVYERTESCALFSSGMAAIATTILAFVRPGDVILHSQPLYGGTETLLTNTLARLSIGAVGFADGIDEAAVKQASEEAMGKGRVSMILIETPANPTNGLVDVAMIRRIADAIGKAQGHTPIIACDNTLLGPVFQRPIEHGADLSLYSLTKYVGGHSDLIAGAALGAKAIMKGIKALRGAIGTQLDPHSCWMINRSLETLSLRMEKADANARLVAAYLRDHPKVAKVHYLGHHEEASPAGRVFARQCLGAGSTFSFDIAGGKEAAVKFLNALQILKLAVSLGGTESLASLPATMTHSGVPADIRQKIGVLDSTIRLSIGIENPSDLIADLAQALNAA

SEQ ID NO: 18206 - protein, 472 aa, Bradyrhizobium japonicum USDA 110
MTMDKRIIPLIMCGGAGTRLWPASREVRPKQFLPLFGSRSTFQDTLLRVSDASLFDRPIVITNASYRFMVLEQLAEIGIEADVILEPMRRDSGPAIAAGAVFAQNRASEAIVLALAADHVVQDKAAFVAACREGLTAASAGRIVTFGVKPERPATEYGYISLGEVISGEVHAVARFVEKPDAVKAADYVNSGYLWNSGNFMFPATVLLDEYRKVDAASVEAVSNAVTNAGRDLGFVTLEPEAFGSAKAISIDYAVMEKTSRAAVVPVSCGWSDVGSWHAVWELSEKDAQGNAAHGAAVFEDSRNCNVTTDSALVALEGVDDLVVVATADAVLVSRQKDANGLKRLVTKLKAVAPKVTEEHLKVHRPWGSYQSVDNGERHQVKRIVVKPGGRLSLQKHHHRAEHWIVVRGAARVTVNETVKTVHENESIYIPMGAVHRMENPGKIMLELIEVQTGSYLGEDDIIRIEDDYQRS

SEQ ID NO: 18207 - protein, 261 aa, Bradyrhizobium japonicum USDA 110
MTMGEPQEQFAIRVRDLVVGFGRQTVLDHLSLDVRKGEILGLVGASGGGKSVLMRTIIGLIPRRSGTIEVMGHEIGGTQDRGTRGAAATWGILFQQGALFSSLTVRQNVQFPLRENLVLSQELMDEIAIAKLEMVGLRAQDADKYPAELSGGMTKRVALARALALDPPILFLDEPTSGLDPIAAGDFDALIKTLQKTLGLTVFMVTHDLASLTTVCDRVAALADGKIVAIGPMRDLLQSEHPWVRAYFHGKRSQMLQHEMR

SEQ ID NO: 18208 - protein, 327 aa, Bradyrhizobium japonicum USDA 110
MRAMVLAAPRARLRMEERPDPIPGEGQIRVRVSACGVCRTDLHVVDAELPDIRYPIVPGHEIVGRIDLVGPDVATHALGDRVGIPWLGFTCGNCRFCREGMENLCDRPLFTGYTRDGGYATHVVADARYAFPLGEAGDDVALAPLLCAGLIGWRSLVLAGQAERLGIYGFGAAGHIVAQVAVWQGRSVHAFTRRGDLAAQDLARRLGAVWAGASDEMPDTPLDAAIIYAPAGELVPAALRAVRKGGRVVCAGIHMSDIPSFPYDLLWQERQLISVANLTRQDGLDFLRIAPQAGVRTETTAFPLDQANEVLDMLRNGQILGAAVLRP

SEQ ID NO: 18209 - protein, 511 aa, Bradyrhizobium japonicum USDA 110
MDLCSLIDRNAAFAPDKTAIAFGRERLSYAAFAARIEQTATALKQELDVGRGDRVAILSLNRPDYLVLLYACARLGAMLVPLNWRLAIAEQLFILTDAGAKVLVLEQAFEGVLSELVRTAPGTSVVGLDFVPPRGTTFESLLANSDLTSRNPHTDLSCPLLIVYTSGTTGRPKGAVLRQEALFWNGVMSQHMHNMTSDDHVLTVLPLFHVGGLNIQTTPALQLGATVTIHARFTPDTALAAIAHDRPTLTVMVPAIIQAASEHPAWTTADLSSLKAVATGSTIVPPHLIDRFVARGVPVLQVYGSTETCPIAIYTRLGGDLSREGSTGLAGLCCEAQVIDEAGREVPAGTPGEIAVRGPNVFFEYWGNADATHDALSDGWYRTGDIGLCDADGYFWIRDRKKNLIISGGENVYPAEVERVLLEHPDVSECAVIGRPDPRWDEVPIAYVIRRPGCRLEAEELRAYLQAQLARFKVPRDIVFVTDLPRTALGKVQHFLLKQLDAQSRARGETS

SEQ ID NO: 18210 - protein, 313 aa, Bradyrhizobium japonicum USDA 110
MTLCCDRRRQPMADASKANPQRDERFGYLGLGLMGTPMTRRLLKAGYQVSVWNRSEGKVVPIVEAGARHGASPRDVMAGSDIVFMCVTDAAAVEEVIFGAEGLSTAPGAGKLVVDFSSIHPDAARDLATRLKAANGAGWIDAPVSGGTKGAEEGTLAIMAGGDASDIERVRPYVLTMARRFTHMGPTGAGQTAKLCNQVIVGCAMAVLAEATRLAVNAGIDANRLPEALAGGFADSIPLQLFVPRMVQGIHSPPLGHIATMLKDLDTVADVAQTTSTPVPMATLAGQLFRLAKAARGADADALEIYKLSATEY

SEQ ID NO: 18211 - protein, 463 aa, Bradyrhizobium japonicum USDA 110
MNEMTKPQAASAEPAPRAAAGLLDRIFGLTERGTSVGREVMAGATTFAAMAYIIAVNPAIMSNAGMDRGDLVSATALAAIFGSMMMGLWANLPLAVAPAMGSNVIFTYVIVKQMGMPWQGALAMVAFTGVLFLILSLSKLREKVAKDVPEALKIGIQAAVGTLIVFIALRGAGFVVQNPSTYIAMGSLRSPPVLLTLFGLLLTPVLVARRVPAALMLSIAVLTLIGFFVPGGNGKMVTSVPSAIMSWPRWPSSTFMALDFGYLFSHFVVALPLLFYFLCAEFFSTLGTLIGVTGAANLRKPDGSIPNATAAFATDATASIVGPLLGTSVVTAYIESITGVQAGGRTGLTSLTVAGLFFLALFFWPIFVIIPPQATAPALVLVGVLMMQGLARIDMTDLGNAVPIVLTLLVTVLTNNLINGMALGTLSYIALEVTVGRRSQIPAMVWGLGAVFIAYAIVIAQIF

SEQ ID NO: 18212 - protein, 373 aa, Bradyrhizobium japonicum USDA 110
MEGPSPFSVVFEKEPAMNSLFSPVRIGGLELSNRLVMAPMTRSRADAGGVPGGLAAEYYAQRAGVGLIVTEGTQPSDDGQGYMTTPGIYTPAHVAGWRKVTDAVHGKGGHIFIQLMHAGRMSHPDNTPHHRQGVAPSAIAPDTPIFTPKGMQDIPQPRSLATDDVRRTVADFRDAARHAIAAGADGVEIHGANGYLVQQFIAPSANTRTDAYGGSIENRARFAIEVATAIAGEIGADRTAIRLSPGITMWGIDEGAEGPDLYRHLVGELDKLSLAYLHIMHQGDERLLADLRRLWRGKLIVNRPGRPRDRIGSDVAAGLADLEAYGQMILANPDFIARLKSGALLNEADRTTFFGGTARGYTDYPALDAIAAV

SEQ ID NO: 18213 - protein, 369 aa, Bradyrhizobium japonicum USDA 110
MKTRAAVAFEAKKPLEIVEVDLEGPKAGEVLVEIKATGICHTDAYTLDGFDSEGIFPSILGHEGAGIIREIGPGVTSVKPGDHVIPLYTPECRQCKSCLSQKTNLCTAIRATQGKGVMPDGTSRFSYKGKPIYHYMGCSTFSNFTVLPEIAVAKIREDAPFDKSCYIGCGVTTGVGAVVNTAKVEPGANVVVFGLGGIGLNVIQGAKMAGADKIIGVDVNDSKEDWGRRFGMTHFVNPKKITGDIVPHLVNLTDGGADYTFDCTGNTTVMRQALEACHRGWGTSIIIGVAEAGKEIATRPFQLVTGRNWRGTAFGGARGRTDVPKIVDWYMNGKIQIDPMITHVLKLEEINKGFDLMHEGKSIRSVVVY

SEQ ID NO: 18214 - protein, 493 aa, Bradyrhizobium japonicum USDA 110
MTKAEIRFPLDGRARKMFVDGAWVEARSGKVFETRNPATGEVIGRVPRGEAADISVAVAAARRAFVGPWSRFKPFERQALLLRIADLFEKHWEEISQSDTADMGMPIARTRANKLRVIGMLRYYAGMATALHGQTVDNSLPGDIVSFTRKEPIGVVGAIIPWNAPTAASVWKIGPALATGCTIVLKPSEEAPLTPLLIADLMNEAGVPPGVVNVVTGTGVEAGAPLAEHPDVDKIVFTGSTATGQAIIRASAGNLKRVSLELGGKSPVIVCADADLDKAVPIAAMAAFANSGQICIAGSRLFVERKIHDELVERLGKFASALKIGDGADPTTEIGPLVSQRQLDKVEGFLQSGREEGAKVVAGGRRVREGNLAKGNFVEPTVFAGVSDDMQIARDEIFGPVISALPFDTLDEAVERANATPYGLAAGVFTRDVSKAHVISRSLRAGSVWVNTYHALDPAMPFGGYKMSGYGREGGTEHLDEYLHTKGVWIKLD

SEQ ID NO: 18215 - protein, 465 aa, Bradyrhizobium japonicum USDA 110
MTEITCQLLVVGAGPGGYVCAIRAGQLGLDTVLVERGKLGGSCLNVGCIPSKAMIHVAEEFEKLVEAADGKTPFGLTAAQPALDFKQAIAWKDGIVHRLNNGVAALLRKAKVKIVQGHGRFRDGKTIVVETETGPKTIKAETVVIATGSAPVELPTLPFGGRVISSTGALSLAEVPKSLVVVGGGYIGLELGTAFAKLGSKVAVVEAQDNILPLYDVELTAPIARRLTALGVEVLTGARALGLTAQGDGLRVETPDGQERSLTADKILVTVGRTPVTEALGLEQLVLDMDGRFIRIGQHCETSMRGIYAIGDVTGEPMLAHRAMAQGEMVAEIAAGMPRAWDKCCIPAICFTDPEIVSAGLSPDEARRAGINIKVGQFPFAANGRAMTRHGEPGFVRVVARADNQRVLGIQALGQGVSELSAAFGLAIEMGAVLQDIAGTIHAHPTLGEAIQEAAFKALGHAIHV

SEQ ID NO: 18216 - protein, 483 aa, Bradyrhizobium japonicum USDA 110
MNTISMLVGGEQRAATGNATFERLNPLDGQIATRAPAATADDAVAAVEAAAAAFPSWSATGPSERRALLTKAAHALEAKAPAFAASIAAETGGSGIWAGFNVHLAAGMLLEAAAMTTQISGEIIPSDVPGSFAMAVRQPAGVVLGMAPWNAPVILGVRAIALPLACGNAVVLKGSELCPATHGLIVEAFKEAGFPKGVVNYVTNAPSDAGPVVEAMIAHPTVRRVNFTGSTRVGKIIAATCAKYLKPAVLELGGKAPLVVLDDADIDSAVNAAAFGAFANSGQICMSTERIIVDEAIADEFVRRLADKASKLPLGDPRKGPVVLGSVVDMTTVKRCNDLIEDALAKGAKLLCGGKAETTLMPATLIDHVSSAMRIYSEESFGPIKPIVRVKGEDAAIACANDNAYGLSSAVFTRDTSRGMRVASRIQSGICHINGPTVHDEAQMPFGGVKDSGYGRFGGKSGVAEFTDTRWMTIQTSERHYPF

SEQ ID NO: 18217 - protein, 158 aa, Bradyrhizobium japonicum USDA 110
MSAIYDFKANSLLGEEVPMRRFEGQVLLIVNTASKCGFTPQYRGLEDLYRDLSPRGFAVLGFPCNQFGAQEPGQASEIQEFCSTNYDVTFPLFEKIDVNGANAHPLYEYLKRQQSGLLGASIKWNFTKFLVDRAGRVIARYAPTARPEGLRQQIETLL

SEQ ID NO: 18218 - protein, 332 aa, Bradyrhizobium japonicum USDA 110
MQLGMIGLGRMGGNIVRRLMRHGHSTVVYDKDAKAVAGLAADGAVGSATLEEFVAKLERPRTAWVMLPAGRITETTIDTIAGVMQEGDVIIDGGNTFWQDDVRRGKALKARGIHYVDVGTSGGVWGLDRGYCMMIGGEKQVVDRLDPIFAALAPGAGDIPRTEGREGRDPRIEQGYIHAGPVGAGHFVKMIHNGIEYGLMQAYAEGFDILKNANIDALPADHRYDFDLADIAEVWRRGSVIPSWLLDLTSTALADSPALAEYSGFVEDSGEGRWTVNAAIDEAVPAEVLTAALYTRFRSRKEHTFAEKILSAMRAGFGGHKEPKQPGASKPK

SEQ ID NO: 18219 - protein, 1098 aa, Bradyrhizobium japonicum USDA 110
MNVLSSVDTKKIEAAEVVDELWYKDAIIYQLHVKAFADSNNDGIGDFAGLTEKLPYLQELGVTALWLLPFYPSPGRDDGYDIADYGSVNPDFGTMKDFKRFIQEAQKRGLRVITELVVNHTSDQHKWFKRARRSHPGSSARNWYVWSDTDQKYQGTRIIFTDTEKSNWTWDHEAGAFYWHRFFSHQPDLNFDNPRVVSALIQVMKRWLDAGVDGFRLDAIPYLCEREGTSNENLPETHAIIKRLRQELDSYSKGKLLLAEANQWPEDVQEYFGRGDECHMAYHFPLMPRIYMAIAQEDRFPITDILRQTPDIPASCQWALFLRNHDELTLEMVTDVERDYLWTTYANDPRARINVGIRRRLAPLMDNDRRKIELMNSLLLSFPGTPIIYYGDEIGMGDNIYLGDRNGVRTPMQWSPDRNGGFSRCDPARLYAPLIMDPVYGYESVNVEAQSRSLSSLLSATKRLISVRKSTLAFGRGTMTFIRPANRAVLAYVRQYHDEVILCVANLSRAAQATELDLSPWKDRIPQEMLGRTRFPPIGELPYMITLGPYGFYWFHLMERDKSEPVTPRAVPEFETLVVPVNSTWVSLARERGVFEHDVLPGFLSRTRWYPEHDPKHIKPTLTSAVPFCDIGDNRPWIAFFEAAQQDAVATRYVLPMQIEWVRFDRERFNPKALAAVRQGAREGTLLDVATDQIFIGLFLRNLSQNLVVEENNLRLEFKATSRFADYTIKEPGRIRAIEQSNSTALVDNQYVAKIYRQLEGGTNPEIEIGHYLTEVARFANTPALLGSVELVEGDQRSTLGVLHAYVENQGDGWAVTTGYLDRYIDEQRVLSAGEAPRETQEQSPYLHFVMQIGRRLAELHVALAAARPDDLAPEPIGSAHIRHWVSDLKARAGRVFERLADSRDGLREADRPLIDQLTALRTSLPDRLNALLPSDIDGLNIRHHGDFRLGQILIVKDDICIIDFDGDPRLPLADKRRKLPAARDVAGLIRSIDLSVNVALGRALSGGTDEQSRLVAALSEWRERATTTFLSAYREAMTDRRLWPEDPQSAEGLLRFFLLDQAFDEVEYELSHRPEGLHAPLTGLLRILSNAESEAHA

SEQ ID NO: 18220 - protein, 256 aa, Bradyrhizobium japonicum USDA 110
MPGVAAIETAPEPMIAMRDVCKWYGTYQVLTEISLTVRPGEKIVLCGPSGSGKSTLIRCINALEAYQRGEVVVAGTRLNDAAGSVDAVRREVGMVFQQFNLFPHMTVLENCMLAPMRSRGVPRVKAEETARRLLDRVRIGNQAEKYPAQLSGGQQQRVAIARALCMEPKVMLFDEPTSALDPEMVKEVLDTMIGLATDGMTMICVTHEMGFARQVADRVIFMADGRIVEEAEPESFFRNPQHDRTRKFLGEILAAH

SEQ ID NO: 18221 - protein, 235 aa, Bradyrhizobium japonicum USDA 110
MNKVYPDAKSALDGILKDNMMIMSGGFGLCGIAEELSDAIRESGVKGLTVVSNNAGVDGIGLSRLLETRQIKKMISSYVGENKLFAQQFLAGELELEFNPQGTLAERIRAGGAGIPAFYTKTGVGTLIAEGKEVKEFDGEKYLMERGLFADLAIVHAWKGDTAGNLIYRKTARNFNPMMATAAKITVAEVEHLVPAGELNPDHIHTPGIFVKRIVEVGTAKKRIEFRNTRPRTAA

SEQ ID NO: 18222 - protein, 390 aa, Bradyrhizobium japonicum USDA 110
MAEELPGTDVAADTAAGAAFPVAGQPLLRIEGVTKTFGTFRAVDGVSLDIKAGEFFALLGPSGCGKTTLLRMLAGFEAPDEGRILLGGKDIAQALPHERPINMMFQNYALFPHLSVRDNIAFGLKRAGLARADIATRVAEMLALVKLEGLEKRKPDQLSGGQRQRVALARALARRPQLLLLDEPLAALDKKLRESTQGELMELQRRLGMTFIIVTHDQEEAMTMASQIGVMKAGKLAQVASPRELYEAPRSRWIAEFVGDINLFDAESRLRDGHRLVIGTRDAGTLVVAEPREPVGAGKLSVAIRPEKVKLSRRGPVSEAGYETAINRLDGVIADICYLGGTTTYKVKLDTGGMVQASVANSARLDVDAYSLNQHVVAWFTPDDCVVLPS

SEQ ID NO: 18223 - protein, 240 aa, Bradyrhizobium japonicum USDA 110
MDMKKYAAEAIGTFWLTFAGCGSAVIAAGFPQVGIGLVGVSLAFGLSVVTMAYAIGHISGCHLNPAVTVGLAAGGRFPAGQILPYVIAQVCGAIVAAELLYIIASGAPGFDVTKGFASNGYDAHSPGQYSMMACFLTEVVMTMMFLFIIMGATHGRAPAGFAPLAIGLALVMIHLVSIPVTNTSVNPARSTGPALFVGGWAMAQLWLFWVAPLIGGALGGVIYRWLSEEPTGVVAGAKAA

SEQ ID NO: 18224 - protein, 265 aa, Bradyrhizobium japonicum USDA 110
MTIVKWIAILLAAVYCAGLVVLYVRQREMLFPIPPVGRTAPDAAGLPEAEEHVLNTSDAEKVIVWHVPARPGRPVILYFPGNGDFLAGGVSRFKAMTADGTGLVALSYRGYAGSSGAPSEEGLLRDAAAAYAFTTARYAAERIVAWGFSLGTGVAVAIAAEHPVRKLVLEAPYTSTVDVAAAAFRFAPVRLLMRDQFRSDERIARVTVPLLVMHGTNDLAISIMFGERLFALAHEPKQFVRFAGGGHDNLDAFGAIETAKRFIAS

SEQ ID NO: 18225 - protein, 478 aa, Bradyrhizobium japonicum USDA 110
MRRLRRIKILATLGPASSDLAMIRRLFEAGADLFRINMSHTPHDKMRELVATIRNVESSYGRPIGILVDLQGPKLRLGAFAEGSVQLQNGQTFTLDSDKAPGDATRVNLPHPEILAALRPGHALLLDDGKVRLIAEETSKEHAVTRVVVGGRMSDRKGVSLPDTDLPVSAMTPKDRADLEAALVTGVDWIALSFVQRADDVIEAKKMIRGRAAVMAKIEKPQAIDRLADIIEASDALMVARGDLGVELPLERVPSLQKQMTRMARRAGKPVVIATQMLESMIQSPVPTRAEVSDVATAVYEGADAIMLSAESAAGKFPVEAVSTMNRIGEEVERDPIYRSVLTAQRPAPESTAGDAIADAARQIAETLDLPALICWTSSGSTAVRVARERPKPPIVAITPNIAAGRRLAVVWGVHCVVAEDARDQDDMVSRAGQIAFRDGFVRAGQRVIIVAGVPLGIPGTTNMVRIASVGPEGGADI

SEQ ID NO: 18226 - protein, 365 aa, Bradyrhizobium japonicum USDA 110
MDQALESRSRTLIVRGGDSVMAYLELDRVAKQFGAQTVVDDVSLSVGKGEFISFLGPSGCGKTTTLQMIAGFLDPTRGAIRLEGKDLTAIHPARRGLGIVFQSYALFPHMTAAENVAFGLEMRKVPRAERAERVRAALAMVGLAGYEDRHPRRMSGGQQQRVALARALVIKPSVLLLDEPLSNLDAKLREEMQIELRQIQRTIGTTTILVTHDQNEAMSLSDRIVVMSQGKIEQIGTPQETYEKPASAFVSQFLGKTNDFAATIDRATAPAKLVAGSWSAPAPVGLSGPVTVSIRPERIGFGDTGLSAKIVTRIFQGNHWLFQCDSECGPAIVIRQNDGQSQPAEGETVRLAWRPEDMSVRGAAA

SEQ ID NO: 18227 - protein, 389 aa, Bradyrhizobium japonicum USDA 110
MSVFWLALGAFAIGTEGFVIAGLLPAIATDLSISVSAAGQLVTAYALTYAVGSPILAVALNNIDRRTVLALALTTFIAGNLAAMVASSYPLLLASRMLMALGSGLCMPTALAVSVAVASPERRGRAVALVTSGLTVATVIGVPLGNLVGSLLGWRATFAMVALIGAVALAGLLLGLPRGLPRNTASLGERLAVARHGNVLVALLITILWGLGGFTVFTYFAVPLRGLGFDASQISLALLVFGGAAAIGNMLGGVLADRLGTLATAALGLAGMATALILHSLVLKLMPGQAHYAVLGTIFLWGISGWAFYPAQIASIIRIEPQASMIALSLNASSMYLGFAIGGALGGAVLATLSPNDLGWIGGTSVAASLLVHLARGWQARPKPVKIAG

SEQ ID NO: 18228 - protein, 375 aa, Bradyrhizobium japonicum USDA 110
MKFPALFKPLQVGPYELAHRVAMAPLTRMRAERDSFSPRPLNAEYYGQRATPGGLLIAEASPVLSHGRGNPATPGIYSEAQIAGWRKVTDAVHAKGGIIFLQLWHVGRVSHSSFHGGELPVSASAIAIKAEGMKAMTAEGKIADYETPRALETDEVKGIVEAFRQGAKNALAAGFDGVEIHGANGYLLEQFLQSRSNQRTDQYGGGIENRARLLLDVTQAAIDVWGANRVAVRLSPHGIANDSGEPDPMPLYTHVVKALDKLGLAYLHFIEPRSSGAGRADVHWENVPSAMVLFRPLYSGVLMTAGGFTGETANAAIADGHADIIAFGRIFISNPDLPRRLRHDYPITPYNRATFYGGEEKGYTDYPAYDELTPA

SEQ ID NO: 18229 - protein, 329 aa, Bradyrhizobium japonicum USDA 110
MIPSSMIRDATEERTLSTMMAWRVREFGPPEIMKFERVPRPEPGAGEVLVKVKAAGVGPWDGWIRAGKSALPQPLPLTLGSDLSGEIVAMGHDVAELAVGDQVYGVTNPQFVGAYAEYAVASAGMVSTKPTSLTHVEAASVPVVAVTAWQALFDHAQLKAGQTVVIQGAAGNVGSYAVQLARQAGVQTIASVSTEDISAVRDLGANTVIDCRTQRFEKEVQDADAVIDLVGGETQERSFQVLRRGGKLISAVSRPGQDLAKRYGVEAAFFLVNVRSEFLTKVARFIDGGKLRTNVGTVLPLADAREAHLMLERVRPQPKGKIVLDVGAS

SEQ ID NO: 18230 - protein, 483 aa, Bradyrhizobium japonicum USDA 110
MGKITGFLEIERHDRKYTPVAERVKHFHEFVVPLTERETRDQAARCMNCGIPYCHGTGSVAPGTPGCPVNNQIPDFNDLVYQGNWEEASRNLHSTNNFPEFTGRICPAPCEASCTLNIDDNPVTIKTIECAIVDRAWDNGWLKPEVASVKTGKKVAVIGSGPAGMACAQQLARAGHDVHLFEKFAKAGGLLRYGIPDFKMEKGIIDRRVKQMEGEGVTFHYNSHVGADGNVDPREMLNEYDAVALTGGAEAPRDLPIPGRDLQGIHYAMDFLPQQNRRVSEEPLNGVTEILAGGKHVVVIGGGDTGSDCIGTSLRQGALSVTQLEIMPAPPERENKGLTWPNWPLKMRTSSSQAEGAIREFAVLTQKFSGENGQVKKLHCVRVDDKFKPIAGTEFELDAELVLLAMGFVHPVHEGLLKLLSVELDPRGNVKANTLDYQTSRPNVFTAGDMRRGQSLVVWAIREGRLCARSIDTFLMGKTDLPR

SEQ ID NO: 18231 - protein, 362 aa, Bradyrhizobium japonicum USDA 110
MKAAVLYEVNKPLVIEDVSLPKPGPREVLIRTSVAGLCHSDLHFMEGLYPHPLPAVLGHESAGVVEQVGSDVTYVKPGDHVVTCLSVFCGTCDNCTTGRTVLCTDTTVKLLPGVSDRMQWSRSEKLHQFLNLSSFAEQMLVHENAIVKIRKEMPLDLAALIGCGVITGYGAVVNTAKVTAGETVAVIGCGGVGMAAINGAQIAGAGRIIAIDTNPAKLQLATKLGATDIINPADGDVVKQVRDLTNGGVHHSFEVLGRKETAEQAFAMLASGGTATIVGMIPFGQKIELHGFDFLRERKIQGSSMGSNHFRVDMPRLVDFYLRGRLHLEDWISAKLKLSEINEGFANMKAGKTLRSVIVFDS

SEQ ID NO: 18232 - protein, 466 aa, Bradyrhizobium japonicum USDA 110
MTMRPDPTFHASPKLAMEAPAENFAYTLLLSPDFSKPDALAVIDVKPGSPTYGQIVHTVTMPNKGDEFHHFGWNACSSALSPLAGHAFIERRYLIIPGLRSSRIYIIDTKPDPTKAKIHKIIEPEEVFKKTGYSRPHTIHCGPDGIYVSTLGGGGKDGTNGPPGVFIMDCETFEVLGRWEIDRGPQTLHYDFWWNLPRDYMVTSEWALPPQFENGIVPEDLLSNKYGHRLHFWDLRARRNVQTIDLGANHQMALEVRPAHDPVREYGFVGVVVDTTNLEASIWTWWREGGKFHAEKTATIPPEPAPKEKLPPLLQGFGAVPPLVTDIDLSMDDRFLYVSCWGTGEMRQYDVSDPRKPKLAGSVHIGGIARRTPHPNGKAFAAGPQMVEISRDGRRVYWTNSLYSTWDDQFYPDGVPGVEVMANVGGNGGLELDKDYFVSFPDGYRAHQIRLEGGDCSTDSFCYPSV

SEQ ID NO: 18233 - protein, 513 aa, Glycine max
MATLSSYDHFIFTALAFFISGLIFFLKQKSKSKKFNLPPGPPGWPIVGNLFQVARSGKPFFEYVNDVRLKYGSIFTLKMGTRTMIILTDAKLVHEAMIQKGATYATRPPENPTRTIFSENKFTVNAATYGPVWKSLRRNMVQNMLSSTRLKEFRSVRDNAMDKLINRLKDEAEKNNGVVWVLKDARFAVFCILVAMCFGLEMDEETVERIDQVMKSVLITLDPRIDDYLPILSPFFSKQRKKALEVRREQVEFLVPIIEQRRRAIQNPGSDHTATTFSYLDTLFDLKVEGKKSAPSDAELVSLCSEFLNGGTDTTATAVEWGIAQLIANPNVQTKLYEEIKRTVGEKKVDEKDVEKMPYLHAVVKELLRKHPPTHFVLTHAVTEPTTLGGYDIPIDANVEVYTPAIAEDPKNWLNPEKFDPERFISGGEEADITGVTGVKMMPFGVGRRICPGLAMATVHIHLMMARMVQEFEWGAYPPEKKMDFTGKWEFTVVMKESLRATIKPRGGEKVKL

SEQ ID NO: 18234 - protein, 199 aa, Brassica napus
MSGSRFVKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIILVGSKLDLRDDKQFFVDHPGAVPITTAQGEELRKLIDAPTYIECSSKSQENVKAVFDAVIRVVLQPPKQKKKKSKTQKACSIPVI

SEQ ID NO: 18235 - protein, 197 aa, Brassica napus
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPVILVGSKLDLRDDKQFFVDHPGAVPITTAQGEELRKLIDAPTYIECSSKSQENVKAVFDAAIRVVLQPPKQKKKKSKAQKACSIQ

SEQ ID NO: 18236 - protein, 197 aa, Brassica napus
MSGFRFVKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIILVGSKLDLRDDKQFFVDHPGAVPITTAQGEELRKLIDAPTYIECSSKSQENVKAVFDAAIRVVLQPPKQKKKKSKAQKACSIQ

SEQ ID NO: 18237 - protein, 197 aa, Brassica napus
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELTHYAPGVPIVLVGTKLDLRDDKQFFVDHPGAVPITTSQGEELMKLIGAPSYIECSSKSQENVKGVFDAAIRVVLQPPKQKKKKSKAQKACSIL

SEQ ID NO: 18238 - protein, 335 aa, Arabidopsis thaliana
MGSRDLISSLPDEILGKVLSLLPTKRAASTAVLSKRWNNLPALVDKLDINDAIGGPGGFPELIDKTLALLTNSTTIKRTSLNNEFQYGESQVNTWIRSFLERGCLQLYLNAQSLYTIDTEFFTSNTLVELTITGGFSPDGLLPPGGVFFPKLKTLSLVLMTFVDSDMYELFISGCPLLEEFLLRNDEIEIPPVWNALVSSPSIKRLTIVHHFPNYREAHDGCWFRTPNLVYLDYSSYVPDWYEVDLGSLVEARLDLRSWERLRDEKAGGYGDCDSVYDDEEYPDDPILGDVTNLVTGLSNIKTLHLSPDSLEVSFPYLLLFQFEVHSSLQSLLIV

SEQ ID NO: 18239 - protein, 352 aa, Arabidopsis thaliana
MGSRDLISSLPDEILGKVLSLLPTKRAASTAVLSKRWNNLPALVDKLDINDAIGGPGGFPELIDKTLALLTNSTTIKRTSLNNEFQYGESQVNTWIRSFLERGCLQLYLNAQSLYTIDTEFFTSNTLVELTITGGFSPDGLLPPGGVFFPKLKTLSLVLMTFVDSDMYELFISGCPLLEEFLLRNDEIEIPPVWNALVSSPSIKRLTIVHHFPNYREAHDGCWFRTPNLVYLDYSSYVPDWYEVDLGSLVEARLDLRSWERLRDEKAGGYGDCDSVYDDEEYPDDPILGDVTNLVTGLSNIKTLHLSPDSLEVFYFCCKSMPVFHNLLTLSFESAKKEAGQCCHFSSISLLT

SEQ ID NO: 18240 - protein, 314 aa, Bacillus coagulans
MNILLMVRTPFIEAVPDFVKNLNRLGNVTILDTDNGIEKEKLKQAVREVEVIITAVVQIDKEIIDAAPNLKYIMKFGAGYDNIDFKYAREKGIPVTNTPGQNADAVADLAIGLMLATARNIPAKNEELRNGNWELSMGIEIFQKKLGIIGFGAIGQAIAQRATGFQMEVLAYGTFQDQTIADRLNVEFVDLNKLLNESDIVVVSTTLRKDNYQLINAKTLNEMKKDALFINVSRGALVDEDALYKALTNGKIKGAGLDVFVEEPSHHPLLTLPNTTVTPHIGAATNEAIKRTGSVALENVQRLKNDLPLLYVVN

SEQ ID NO: 18241 - protein, 163 aa, Lycopersicon esculentum
MYQTVGYNPGPMKQPYVPPHYVSAPGTTTARWSTGLCHCFDDPANCLVTSVCPCITFGQISEILNKGTTSCGSRGALYCLLGLTGLPSLYSCFYRSKMRGQYDLEEAPCVDCLVHVFCEPCALCQEYRELKNRGFDMGIGWQANMDRQSRGVTMPPYHAGMTR

SEQ ID NO: 18242 - protein, 163 aa, Lycopersicon cheesmanii
MYQTVGYNPGPMKQPYVPPHYVSAPGTTTARWSTGLCHCFDDPANCLVTSVCPCITFGQISEILNKGTTSCGSRGALYCLLGLTGLPSLYSCFYRFKMRGQYDLEEAPCVDCLVHVFCEPCALCQEYRELKNRGFDMGIGWQANMDRQSRGVTMPPYHAGMTR

SEQ ID NO: 18243 - protein, 163 aa, Lycopersicon hirsutum
MYPTVGYNPGPMKQPYVPPHYVSAPGTTTARWSTGLCHCFDDPANCLVTSVCPCITFGQISEILNKGTTSCGSRGALYCLLGLTGLPSLYSCFYRSKMRGQYDLEEAPCVDCLVHVFCEPCALCQEYRELKNRGFDMGIGWQANMDRQSRGVTMPPYHAGMTR

SEQ ID NO: 18244 - protein, 163 aa, Lycopersicon pennellii
MYPTVGYNLGPMKQPYVPPHYVSAPGTTTARWSTGLCHCFDDPANCLVTSVCPCITFGQISEILNKGTTSCGSRGALYCLLGLTGLPSLYSCFYRSKMRGQYDLEEAPCVDCLVHVFCEPCALCQEYRELKNRGFDMGIGWQANMDRQSRGVTMPPYHAGMTR

SEQ ID NO: 18245 - protein, 475 aa, Piper mullesua
CPPQTETKASVGFKAGVKDYKLTYYTPDYETKDTDILAAFRMSPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLASEGNVIIREASKWSPELAAACEIWKEIKFEFPAMDTL

SEQ ID NO: 18246 - protein, 376 aa, Populus tremula x Populus tremuloides
MASMYNPETSAVQDQQQNPTLLYDALYCSEENWVEEVREDWFQDELEGESYCSNNSNKLNTFPILLEQDLSWEDEELSSLFAKEEQNQLCKDLETNPSLARARCEAVEWILKVNEHYSFTALTAVLAVNYLDRFLFSVHLQKEKPWMAQLAAVSCLSLAAKVEETQVPLLLDFQVEDSKYVFEAKTIQRMEILVLSTLKWKMNPVTPISFLDYITRRLGLEHYLCLEFLKRCERMVLSILADSRSMPYVPSVMAAATMLYVIDNIEPSLAAEYQSQLLSILGIDKDKVEDCSKFLMEFALRDHFKLLSNKRKFCSLPGSPSGVVDVSFSSDSSNDSWSVASSVSSSPKPLSKKSRALQSLNNATTSDFSQHSSPVP

SEQ ID NO: 18247 - protein, 456 aa, Chondrus crispus
MVTGFVPCAAPLRATTRQTAAVSVVSRSASTFVAPSRRVTAPAAPVPTVRMTTAAATTKKSIKDLSPADIAGKRVLVRCDLNVPLDGKTITDDTRIRASVPTIKFLMEAGAKVLLSSHLGRPKDGPEDKFSLSPVAARLTQLLGKDVTMAPDCIGDGVTKIVSGMANGDVTLLENVRFYKEETKNDPDFAKKLAANADFFVNDAFGTAHRAHGSTAGVTAHLKPSVAGLLLEKELAYLAGTVSDPARPFAAIVGGSKVSSKIGVIDSLLQKVDKLIIGGGMVFTFLKAKGLNVGSSLVEDDKLELARELVKTAEAKGVSIILPTDVVLADKFAADANTQVTSVDSIPDGWMGLDQGEDSTKLIQNELKECKTVIWNGPMGVFEMEKFAKGTFAIADTLADLTESGCITIIGGGDSVAAVEKAGLAEKMSHISTGGGASLELLEGKVLPGVAALDDN

SEQ ID NO: 18248 - protein, 418 aa, Chondrus crispus
MSFSKLCIDALDLAGKRVFIRVDFNVPFDKETGKTITNTQRIDAALPTIKYALEKGAKSVVLASHLGRPSGRVNPKFSLKPVADVVSEKIGKTVTFLEDAVGSATEEACKDPETGSVFLLENLRFHIEEEGKGVDADGNKIKADAAKVTEFRKSLSTLADVYVNDAFGTAHRAHSSMVGVDLPQKASGFLMKKELEYFGKALQEPQRPFLSILGGSKVSDKIQLIENLLDKVDEMIIGGGMAFTFKKAVEGMAIGQSLFDEAGAKIAQEIVDKAKAKNVKLHFPVDFTIADKFAPVANTRVATDSEGIPDEWMGLDAGPKSQEAMREVVLRAKTVVWNGPVGVFEFEAFAKGTKAVVDAVVEATSSGAVTIIGGGDTATAVKEMGAADSVSHVSTGGGASLELLEGKTLPGVAALTDA

SEQ ID NO: 18249 - protein, 299 aa, Arabidopsis thaliana
MIPYATIEEASIALSRNLTWLETLWFDYSATKSDYYLYCHNILFLFLIFSLVPLPLVFIESSQSTSDLFNRYKIQPKVKNSFSSMFKCYKDVMKMSILVVGPLQLVSYPSIQMIEIRSGLPLPSCMEIVAQLVVYFLVEDYTNYWVHRFFHCKWGYEKFHHIHHEYTAPIGYAAPYAHWAEVLLLGIPTFLGPAIAPGHMITFWLWIALRQIEAIETHSGYDFPWSLTKYIPFYGGAEYHDYHHYVGGQSQSNFASVFTYCDYIYGTDKGYRFQKKLLQQMKEKSKKSNKLVNGGEKFD

SEQ ID NO: 18250 - protein, 465 aa, Lycopersicon esculentum
MGSGAIDDSSKFDDDGRPKRTGTVLTTSAHIITAVIGSGVLSLAWATAQLGWIAGPVALIAFSAITWFASILLADCYRAPDGSRSYTYMDAVRAHLGGRKVQLCGLAQYSNLFGVTIGYAITTSISMVAIKRSNCFHRKGHDAGCHESNNPFIIIFGVMQILLSQIPNFHKLSFLSIIAAAMSFAYSFIGLGLSIAKIAKDGVSANTSLTGTIVGKDVSSRDKMWNTFSALGDIAFAYAFSIVLIEIQDTLKSHPPENKSMKKATFTGISVSTIFYLLCGLLGYAAFGNKAPGNFLTGFGFYEPFWLIDFANVCIVIHLVGAYQVFCQPIFGFVEGWSRQKWPESKFITKEYMINLSHLGLFNFNFYRLVWRTLYVVFTTILAMLFPFFNDFVGFIGAASFWPLTVYFPIQMYIAQAKIPKYSFTWIWLNILSFVCLIISLLAAAGSVRGLIKSLQEFEPFQSRS

SEQ ID NO: 18251 - protein, 472 aa, Gymnotheca involucrata
QTETKAFVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQSETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEIIREAAKWSPELAAACEVWKEIKFEFEAMDTL

SEQ ID NO: 18252 - protein, 269 aa, Gossypium arboreum
MAAIIESGWLYLITHFSDFQLASLGSFFLHESVFFLSGLPFIYLERAGLLSKYKIQTKNNSLAAQEKCITRLLLYHIGVNLPLMIASYPFFRFMGMKSSLPFPSWKVVLSQIIFYFILEDFVFYWGHRILHTKWLYKHVHSVHHEYATPFGLTSEYAHPAEILFLGFATIIGPAITGPHLITLWLWMTLRVLETVEAHCGYHFPWSLSNFLPLYGGADFHDYHHRLLYTKSGNYSSTFVYMDWIFGTDKGYRKLKALKRDGVEEEAKQT

SEQ ID NO: 18253 - protein, 140 aa, Axonopus compressus
LVKWKGFQQGLYMGNGGGANVVAKGYTKGDGLGAEIVGTFILVYTVFSATDAKRNARDSHVPILAPLPIGFAVFLVHLATIPITGTGINPARSLGAAIIYNREHAWNDHWIFWVGPFIGAALAAIYHQVIIRAIPFKSRS

SEQ ID NO: 18254 - protein, 367 aa, Corynebacterium glutamicum
MTSRTPLVSVLPDFPWDSLASAKAKAASHPDGIVNLSVGTPVDPVAPSIQIALAEAAGFSGYPQTIGTPELRAAIRGALERRYNMTKLVDASLLPVVGTKEAIALLPFALGISGTVVIPEIAYPTYEVAVVAAGCTVLRSDSLFKLGPQIPSMMFINSPSNPTGKVLGIPHLRKVVKWAQENNVILAADECYLGLGWDDENPPISILDPRVCDGDHTNLIAIHSLSKTSNLASYRAGYLVGDPALIGELTEVRKNLGLMVPFPIQQAMIAALNDDDQEAGQKLTYAIRRAKLMRALLESGFQVDNSEAGLYLWATREEPCRDTVDWFAERGILVAPGDFYGPRGAQHVRVAMTETDERVDAFVSRLS

SEQ ID NO: 18255 - protein, 463 aa, Oryza sativa (japonica cultivar-group)
MASSRRQQHKGSWSWTSRVAAAADAASWCLALSLVALLLVCSLGPGGAAGGEQRGGVAAVLRGAALSARACEEIYVVAEGETLHSISDKCGDPYILEQNPHVHDPDDVFPGLVIKITPSKPSTRAVVCRLLPVSKQVKPMEGRFQLLPLYRWREAPVTVETRPLQLPLARRGPRVLDPNVPVGVTGGANIRKDWQEKCSKGPLLNADAAISEHNQGKIWWYIEKVVIIGATKEIGRTAIAAISGMEEALEIPVLNDLTMVLGSIAQTRATGVVVDFSEPSTVYDNVKQAAAFGLNSVVYVPKIELDTVTELSAFCEKASMGCLVTPTLSIGSVLLQQAAIQASFHYNNVEIVESRPNPSDLPSQDAIQIANNITDLGQIYNREDMDSDNPARGQILGEDGVRVHSMVLPGLASSTSIHFSGPGEIYTLRHDVTNVQCLMPGLILAIRKVIRLKNLIYGLEKFL

SEQ ID NO: 18256 - protein, 138 aa, Lilium hybrid cv. 'Star Gazer'
MASKALLMLGVLIVAALFVTSDAGRELAEETKENTEKRATEAGVADQKYGGGYNNGGGYPGGGGGYHNGGGYPGGGGGYPGGGGGYPGGGGGYHNGGGGGRCYNGCCRRGYYGGCRCCAHPDEIPDPEYRAEPAYGHP

SEQ ID NO: 18257 - protein, 431 aa, Thermus caldophilus
MTENAEKFLWGVATSAYQIEGATQEDGRGPSIWDTFARRPGAIRDGSTGEPACDHYHRYEEDIALMQSLGVGVYRFSVAWPRILPEGRGRINPKGLAFYDRLVDRLLAAGITPFLTLYHWDLPQALEDRGGWRSRETAFAFAEYAEAVARTLADRVPFFATLNEPWCSAFLGHWTGEHAPGLRNLEAALRAAHHLLLGHGLAVEALRAAGAKRVGIVLNFAPAYGEDPEAVDVADRYHNRYFLDPILGRGYPESPFQDPPPTPILSRDLELVARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQL

SEQ ID NO: 18258 - protein, 103 aa, Eremothecium gossypii
MSGKGGKAGSAAKASQSRSAKAGLTFPVGRVHRLLRKGNYAQRIGSGAPVYLTAVLEYLAAEILELAGNAARDNKKTRIIPRHLQLAIRNDDELNKLLGNVTI

SEQ ID NO: 18259 - protein, 170 aa, Gossypium hirsutum
MASQSSKPQSIYDFTVKDAKGNDVDLSIYKGKVLIIVNVASQCGLTNSNYTDLTEIYKKYKDQGLEILAFPCNQFGGQEPGSIEESIQNMVCTRFKAEYPIFDKVDVNGDNAAPLYKFLKSSKGGFFGDSIKWNFSKFLVDKEGNVVDRYSPTTTPASMEKDIKKLLGVA

SEQ ID NO: 18260 - protein, 166 aa, Leavenworthia crassa
NTDRVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFEC

SEQ ID NO: 18261 - protein, 169 aa, Leavenworthia crassa
NTDRVRMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 18262 - protein, 469 aa, Corynebacterium glutamicum
MTTFPQGFLWGGATAANQIEGAYNEGGKGLSIQDVMPGGAIKPSTEGPTEDNLKLKAIDFYNNYVEDIALFAEMGFKTFRISIAWSRIFPNGDEQEPNEEGLAFYDRVFDELEKHGIEPLVTLSHYETPLGLARKYGGWRSRELIEFFAHYARTVFNRYKGRVHYWLTFNEINAVLAMPFTAGGIEVPRSELSESELYQAIHHELVASALVTKIAHEIDPNNQVGCMIIAVPRYGITPDPRDQLTAQQKSHEDFAFGDIHVRGEYPGYLLREFREKGITIDITDEDREILKNTVDFVSFSYYMSVCEAHDPENYASGGGNIIGGVTNPTLEASEWGWQVDPIGLRIVLNNYWERWQKPLFIVENGLGAKDVLIDGPSGPTVDDDYRIKYLNDHLVQVGEAIEDGVNLLGYTTWGPIDLVSASTAQMSKRYGFIYVDRNDDGSGTLKRYKKKSFDWYRDVIATNGGSLQA

SEQ ID NO: 18263 - protein, 169 aa, Leavenworthia stylosa
NTERVGMIHDGESRFSIKGKPIHHFLGTSTFSEYTVVHSGQVAKINREAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 18264 - protein, 169 aa, Leavenworthia stylosa
NTEIVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVSEFVNPKEHDKPVQQVIAEMTNGGVDRSVECTGSVQAMIQAFECVHD

SEQ ID NO: 18265 - protein, 169 aa, Leavenworthia uniflora
NTERVGMIHDGESRFSINGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 18266 - protein, 169 aa, Leavenworthia stylosa
NTDRVGMIHDGESRFSIKGKPINHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIADMTNGGVDRSVECTGSVQAMIQAFECVHD

SEQ ID NO: 18267 - protein, 169 aa, Leavenworthia stylosa
NTERVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPLQQVIAEMTNGGVDRSVKCTGSVQAMIQAFECVHD

SEQ ID NO: 18268 - protein, 169 aa, Leavenworthia stylosa
NTEIVGMIHDGESRFSINGKPINHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIDEMTNGGVDRSVECTGSVQAMIQAFECVHD

SEQ ID NO: 18269 - protein, 169 aa, Leavenworthia stylosa
NTERVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 18270 - protein, 169 aa, Leavenworthia stylosa
NTERVGMIHDGESRFSIKGKPINHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 18271 - protein, 199 aa, Leavenworthia crassa
SVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLSSKGFEEAKKFGVTEFVNPKEHNKPVQQVIAEMTNGGVDRSVECTGSV

SEQ ID NO: 18272 - protein, 199 aa, Leavenworthia crassa
SVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSNRFEEAKKFGVTEFVNPKEHNKPVQKVIAEMTNGGVDRSVECTGSV

SEQ ID NO: 18273 - protein, 199 aa, Leavenworthia crassa
SVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGTAEGARIAGASRIIGVDLNSNRFEEAKKFGVTEFVNPKEHNKPVQQVIAEMTNGGVDRSVECTGSV

SEQ ID NO: 18274 - protein, 199 aa, Leavenworthia crassa
SVGEGVTDLQPGDHVLPIFTGECGECPHCHSEESNMCELLRINTERGGMILDGESRFSINGKPIHHFLGTSTFSEYTVVHSGQVAKINPKAPLDKVCIVSCGLTTGLGATLNVAKPKKGQSVAVFGLGAVGLGAAEGARIAGASRIIGVDLNSNRFEEAKKFGVTEFVNPKEHNKPVQQVIAEMTNGGVDRSVECTGSV

SEQ ID NO: 18275 - protein, 199 aa, Leavenworthia crassa
SVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSNRFEEAKKFGVTEFVNPKEHNKPVQRVIAEMTNGGVDRSVECTGSV

SEQ ID NO: 18276 - protein, 199 aa, Leavenworthia crassa
SVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSNRFEEAKKFGVTEFVNPKEHNKPVQQVIAEMTNGGVDRSVECTGSV

SEQ ID NO: 18277 - protein, 199 aa, Leavenworthia crassa
SVGEGVTDLQPGGHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSNRFEEAKKFGVTEFVNPKEHNKPVQQVIAEMTNGGVDRSVECTGSV

SEQ ID NO: 18278 - protein, 199 aa, Leavenworthia crassa
SVGEGVTDLQPGDHVLPIFTGECGECLHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSNRFEEAKKFGVTEFVNPKEHNKPVQQVIAEMTNGGVDRSVECTGSV

SEQ ID NO: 18279 - protein, 199 aa, Leavenworthia stylosa
SVGEGVTDLQPGDHVLPIFTGECGHCPHCHSEESNMCELLRINTERGGMILDGESRFSINGKLIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 18280 - protein, 199 aa, Leavenworthia stylosa
SVGEGVTDLQPGDHVLPIFTGECGHCPHCHSEESNMCEFLRINTERGGMILDGESRFSINGKPIHHFLGTSTFSEYTVVHSGQVVKINHKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 18281 - protein, 199 aa, Leavenworthia stylosa
SVGEGVTDLQPGDHVLPIFTGECGHCPHCHSEESNMCELLRINTERGGMILDGESRFSINGKPIHHFLGTSTFSEYTVVHSGQVVKINPKAPLGKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 18282 - protein, 199 aa, Leavenworthia stylosa
SVGEGVTDLEPGDHVLPIFTGECGHCPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 18283 - protein, 199 aa, Leavenworthia stylosa
SVGEGVTDLEPGDHVLPIFTGECGHCPHCHSEESNMCELLRINTERGGMILDGESRFSISGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 18284 - protein, 346 aa, Populus tremuloides
MGTEAETVCVTGASGFIGSWLIMRLLEKGYAVRATVRDPDNMKKVKHLLELPKASTHLTLWKADLSEEGSYDEAIQGCTGVFHVATPMDFESKDPENEVIKPTINGVLDIMRACAKSKTIRKIIFTSSAGTVDVEEKRKPVYDESCWSDLDFVQGIKMTGWMYFVSKTLAEQAAWKFAEDNNLDFISIIPTLVVGPFIMQSMPPSLLTALSLITGNEAHYGILKQGHYVHLDDLCMSHIFLYENPKAEGRYICNSDDANIHDLAQLLREKYPEYNVPDKFKDIDENLACVAFSSKKLTDLGFEFKYSLEDMFAGAVETCREKGLIPLSHKKQAVEECKENEVLPAS

SEQ ID NO: 18285 - protein, 199 aa, Leavenworthia stylosa
SVGEEVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 18286 - protein, 199 aa, Leavenworthia stylosa
SVGEGVTDLQPGDHVLPIFTGECGHCPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 18287 - protein, 199 aa, Leavenworthia uniflora
SVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 18288 - protein, 338 aa, Leavenworthia uniflora
  misc_feature (170)..(170): Xaa can be any naturally occurring amino acid
TGQIIRSKAAVAWEAGKPLVMEEVEVAPPQKHEVRIKILFTSLSHTDVYFWEAKGQTPLFPRIFGHEAGGIVESVGEEVTDLQPGDHVLPIFTGECGDCPHCHSEESNMCDLLRINTERVGMIHDGESRFSINGKPIHHFLGTSTFSEYTVVHSGQVAKINPEAPLDKVXIVSCGLSTGLGATLNVAKPKKGQSVAVFGLGPVGLGAAEGARIAGASRIIGVDLNSNRFEQAKKFGVTEFVNPKEHDKPVQQVIAEMTNGGVDRSVECTGSVQAMIQAFECVHDGWGVAVLVGVPSKDDAFKTHPMNFLNERTLKGTFFGNYKPKTDIPGVVEKYMNK

SEQ ID NO: 18289 - protein, 379 aa, Leavenworthia stylosa
  misc_feature (11)..(11): Xaa can be any naturally occurring amino acid
MTTTGRIIRSXAGVAWEAGKPLVIEEVEVAPPQKHEVRIKILFTSLWHTDVYFWEAKGQTPLFPRIFGHEAGGIVESVGEGVTDLKPGDHVLPIFTGECGDCPHCHSEESNMCDLLRINTERRGMIHDGESRFSINGKPIHHFLGTSTFSEYTVVHSGQVAKINPKAPLDKVWIVSWGLSTGLGAILNVAKPKKGQSVAVFGLGAVGLAAAEGARIAGASRIIGVDLNSKRFEEAKKFGVTEFVNPKDYDKPVQQVIAEMTNGGVDRSVECTGSVQAMIQAFECVHDGWGVAVLVGVPSKDDAFKTHPMNFLNEKTLKGTFFGNYKPKTDIPGVVEKYMNKELELEKFITHTVPFSEINKAFDYMLKGESIRCIITMGA

SEQ ID NO: 18290 - protein, 223 aa, Leavenworthia crassa
GQTPLFPRIFGHEAGGIVESVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSVQAMIQ

SEQ ID NO: 18291 - protein, 380 aa, Leavenworthia stylosa
MTTTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGHCPHCHSEESNMCELLRINTERGGMILDGESRFSINGKPIHHFLGTSTFSEYTVVHSGQVVKINPKAPLDKICIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSVQAMIQAFECVHDGWGVAVLVGVPSKDDAFKTHPINFLNERTLKGTFFGNYKPKSDIPGVVEMYMNKELELEKFITHKVPFSEINKGFDYMLKGEGIRCIITMGA

SEQ ID NO: 18292 - protein, 281 aa, Leavenworthia uniflora
MTTTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSVQAMIQ

SEQ ID NO: 18293 - protein, 169 aa, Leavenworthia crassa
NTDRVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 18294 - protein, 322 aa, Leavenworthia crassa
GQTPLFPRIFGHEAGGIVESVGEGVTDLQPGDHVLPIFTGECGDCPHCHSEESNMCDLLRINTDRVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLNGEGIRCIITMGA

SEQ ID NO: 18295 - protein, 322 aa, Leavenworthia stylosa
  misc_feature (253)..(254): Xaa can be any naturally occurring amino acid
  misc_feature (256)..(256): Xaa can be any naturally occurring amino acid
GQTPLFPRIFGHEAGGIVESVGEEVTDLQAGDHVLPIFTGECGDCPHCHSEESNMCDLLRINTERVGMIHDGESRFSIKGKPINHFLGTSTFSEYTVVHSGQVAKINPEAPLDKVRIVSCGLSTGLGATLNVAKPKKGQSVAVFGLGAVGLGAAEGARIAGASRIIGVDLNSNRFEQAKKFGVTEFVNPKEHDKPVQQVIAEMTNGGIDRSVECTGSVQAMIQAFECVHDGWGVAVLVGVPSKDDASRTHPMXXLXERTLKGTFFGNYKPKPDIPGVVEKYMNKELELEKFITHTVPFSEINKAFDYMLNGEGIRCIITMGA

SEQ ID NO: 18296 - protein, 162 aa, Capsella rubella
AAPVYLSEVAPPRWRGAFNSGFQFFIGVGVVAANLINYGTDSHRNGWRISLGLAAVPAAIMTVGCLFISDTPSSLLARGKHENAHASLLKLRGVENIADVETELAALARSSQLAIEARAEPFAKTILERRYRPHLVVAVAIPCFQQLTGITVNAFYAPVLFR

SEQ ID NO: 18297 - protein, 379 aa, Cercospora zeae-maydis
MATEQIPDKGLAGVCVNEGPDFKVEVQEVDIPEPSKQNCWTISVNSSLTERWPESGELLIRLNCTGLCMSDIHFMVNDWAVPPMSQFGTKCAGHEGAGVVVKLGPNVSGWEVGDRAGIKPLWDVCHNCEHCWNGRENYCQHGVYTGLVAEGTYRQYLTSPAIYTSRIPEGVPDEVAGPIMCSASTMHRALVDSGLKAGDFVVFPGGGGGVGIQGVQLAKAMGMRPIVIDSGEAKSKLSKELGAEEFIDFKEHEDVAARVKEVAGGIGAHGVLVTAYQAYKDSFSYLGNRIGGRIMCIALPPAGTVNMGTDPNFIVFKNVRVIGTLVGTMQDTAAALEYARRGLLKGIAKVQGVSRFDKSVQALQRGKVAGRIVIDFNKK

SEQ ID NO: 18298 - protein, 277 aa, Staphylococcus epidermidis ATCC 12228
MGGYIVMKTLDSVNIPIRKDETHKGDYGKILLIGGSANMGGAIMLAARACVYSGSGLITVATHPNNHAALHSRCPEAMVIDINDTKMLTKMIEATDSILIGPGLGVDFKGNNAITFLLQNIQPHQNLIVDGDAITIFSKLKPQIPTCRVIFTPHQKEWERLSGIPIEEQTYERNLEAVERIGATVVLKQHGTEIYFCNDDVYKLPIGTPAMATGGMGDTLAGMITSFVGQFDNFKEAVTSATYMHSFIGEKLSDTMYVVPPSRLISEIPYVMKQLEG

SEQ ID NO: 18299 - protein, 504 aa, Staphylococcus epidermidis ATCC 12228
MKIRKRLDTYYTTIFLSTNSNYSYLSKEESRMTGEVKKYVDLLVIGAGSGGYVAAIRAAQLGKKVVLVDKAELGGVCLNRGCIPSKALISASERVKHIKHANTMGLKVSGEVQVDMPEVVKWKDGIVNKLTDGIRTLLKGNGVEVISGEAYLTEAHIAKIKIEDEEQIFSYKDLILAIGSLPVELKSMPFDQKRIISSTEALQLQEVPNHLVVVGGGYIGLELGTAYAKFGAKVTILEGSDTILSGTDPILTKTVKRHLKEIGITVITDALVQGGENTGDEVNVHVQVDGKEEIIQCDYCLVSIGRKPNTGKIGLENIGVVLDDQGFIKINNKCQTNIEHVYAIGDCAGGDLLAHKASYEAKIAAEVISGQNSVIDFQAMPFVIFSDPEVAYTGLTEKEAKEKGYETVSSRFPFQANARALSVSDADGFVQVVAEKNTKRVLGVQMVGPEVSSLIAEAVFAIEAGANAEDLSLTIHAHPTLPEPLMEAAEGVMGHATHMLNKKQ

SEQ ID NO: 18300 - protein, 453 aa, Staphylococcus epidermidis ATCC 12228
MRRIMMTKKYDLIVIGTGSAGSITAAKCNKAGWNVAMVDDRPFGGTCALRGCDPKKVLHGAAELIDWNKRMVKNGVPSEVSINWKDLMNFKRTFTDDVPEKKEEALNKQGIDTYHGNASFVSEDKLEVNKEVLEGSHFLIASGAKPTPLPIKGEEHLTYSDEFLELDELPQRIVFVGGGYISFEFAHIAARAGSEVHIIHRGQRPLENFDIDLVDILLEKSKEIGIQVHLQHSVESIEKEQGKFHVYARKKEDITRFEADIVIHGAGRVPALDMNLEKGNIERKKHGVHVNEYLQSVSNPNVYAAGDAAATDGLPLTPVASADSHVVASNLLKGNSKKIEYPVIPSAVFTVPKMASVGMSEEEAKNSGRNIKVKQKNISDWFTYKRTNEDFAAFKVLIDEDSDQVVGAHLISNEADELINHFATAIRFGISTKELKQMIFAYPTAASDIAHML

SEQ ID NO: 18301 - protein, 459 aa, Staphylococcus epidermidis ATCC 12228
MNFFDIHKIPNKGIPLAVQRKLWLRNFMQAFFVVFFVYMAMYLIRNNFKAAQPLLKEEIGLSTLELGYIGLAFSITYGLGKTLLGYFVDGRNTKRIISFLLILSAITVLIMGFVLSYFGSVMGLLIVLWGLNGIFQSVGGPASYSTISRWAPRTKRGRYLGFWNTSHNIGGAIAGGVALWGANTFFHGNVVGMFIFPSIIALIIGIVTLFIGKDDPEELGWNRAEEIWEEPIDQENIDSQGMTKWDIFKKYILGNPVIWILCISNVFVYIVRIGIDNWAPLYVSEHLHFNKGDAVNTIFYFEIGALVASLLWGYISDLLKGRRAIVAIGCMFMITFVVLFYTNATSVTMVNISLFALGALIFGPQLLIGVSLTGFVPKNAISVANGMTGSFAYLFGDSMAKVGLAAIADPTRNGLNIFGYTLSGWTDVFIVFYVALFLGMILLAIVAYYEEKKIRKLKI

SEQ ID NO: 18302 - protein, 451 aa, Staphylococcus epidermidis ATCC 12228
MANTRELNHKDAQYVWHPFTQMGVYAKNDNIIIEKGRGSYLYDTEGNKYLDGYASLWVNVHGHQHKKLNKAIHKQLDKIAHSTLLGSSNIPSIELAEQLVKLTPDRLQKVFYSDTGSASVEIAIKMAYQYWKNIDAKQYAKKNKFLTLHHGYHGDTIGSVSVGGIDSFHKIFKDLIFENIQIETPCLYKSKYRNEAEMLNSILNQIENILSERNDEIVGFILEPLIQGATGLFVHPHGFLKAVEQLCRKYDVLLICDEVAVGFGRTGEMFACNHEDVQPDIMCLGKAITGGYLPLAATLTSQKIYDAFLSQSHGKNTFFHGHTYTGNQLVCSVALENINLFKKKHLIGHIQKTSQTLKQRLEALQPHKNIGDIRGRGLMYGVELVENKSTQTPLDIPTVELIIRRCKENGLMIRNLENVITFVPILSMSNKEIKKMVKIFNKALHQTLGKK

SEQ ID NO: 18303 - protein, 1005 aa, Staphylococcus epidermidis ATCC 12228
MSKEIFDTFKFKCGAELKNRVLMAPMTIQAGYFDGSVTSEMIDYYQFRAGDASAIIVESCFVENHGRGFPGAIGIDNDDKIPGLKRLAEAIQAKGSKAILQLYHAGRMANPKFNEGEQPISASPIAALRPDAVPPREMTHAQINQMIDDFGEATRRAIEAGFDGVEIHGANTYLLQQFFSPHSNRRQDSWGGSREKRTRFPIEVLTKVQHVVAEKEASHFIIGYRFSPEEIEEPGIRFEDTMFLLNTLAEYEPDYFHISANSYQRTSIVNQEDTEPLINKYIKMQSAQLAKIPLIGVGSIAQRQDAEHALELGYDLLSVGKAYLVEPQWTDKISQNEEVEQFVDIHDQKVLHIPSPLWKVMDFMILDKEEEHRKYEKLKALQNKKVKFNKGTYHVYAKGHNGNLPMKVQLSEDKIVSIEVDDSGESEGIANPVFERLPQDIINGQTLNVDVISGATVTSEGIVQGIADAIEQAGEDPDILRARPKPVVQWSDEVVEETTDVVVIGTGGAGLSAAATVLDEGKEVIMLEKFAAIGGNTIRTGGQVNAAEPKWQNAFPALAGEKETLLQLLNHDENDIDEAYIEDFNTLKRQIKDYLENSSNEDEYLFDSVELHRIQTYLGGKRKDRNNVEISCDYDLVKTLTDNVLESVYWLKDKGVHFDRSFVDMPVGALWRRGHKPMKAQGLEYIENLGDYVKHNHGRIFTETTAEKLIKEGNQVVGIEARKANGAKVKIHTRHGVVLATGGFGANTKMLQQYNTYWDNIPDDIKTTNSPAITGDGIRLGVQAGADIVGMGFSQMMPISDPKTGALFTGLIVTPSNFVFVNKEGQRFVNEFESRDVLSKAALEQKDGIFYIIADANIKALAMNTTEDKINQELEDGTLVKADTLEALAQKLNIDTTTFVNTIERYNTFVEQGQDEDFNKNAFDLKIEKAPFYATPRKPAIHHTMGGLKINTHAQVIDVEGHIIEGLYAAGEVAGGIHAGNRLGGNALADIFTFGRIAGQSAVTK

SEQ ID NO: 18304 - protein, 467 aa, Staphylococcus epidermidis ATCC 12228
MLKRFHKGIIISLAIEKGMIRMKANKYLIFILGALGGLLYGYDNGVISGALLFIHKDIPLNSTTEGIVVSSMLIGAIVGAGSSGPLADKLGRRRLVMLIAIVFIIGALILAASTNLALLIIGRLIIGLAVGGSMSTVPVYLSEMAPTEYRGSLGSLNQLMITIGILAAYLVNYAFADIEGWRWMLGLAVVPSVILLVGIYFMPESPRWLLENRNEEAARQVMKITYDDSEIDKELKEMKEINAISESTWTVIKSPWLGRILIVGCIFAIFQQFIGINAVIFYSSSIFAKAGLGEAASILGSVGIGTINVLVTIVAIFVVDKIDRKKLLVGGNIGMIASLLIMAILIWTIGIASSAWIIIVCLSLFIVFFGISWGPVLWVMLPELFPMRARGAATGISALVLNIGTLIVSLFFPILSDALSTEWVFLIFAFIGVLAMIFVIKFLPETRGRSLEEIEYELRERTGARTE

SEQ ID NO: 18305 - protein, 469 aa, Staphylococcus epidermidis ATCC 12228
MQMKLGWHNVLLVKGGIYYMSKSYDLIVIGAGPGGYVAAIRGAQLGKNVAVIEKNNAGGTCLNVGCIPSKTLLEHGEKAHSIRVANDWGITTKDLKIDFTQFVQRKKKVVQTLTGGVKQLLKKNKVTYIEGEARISKNLKVDVNNETYQAKDIILATGSQPFIPPIDGLDQVNYETTDTFFDLEKLPKQLAVIGGGVIATELASSMADLGVRVTIIEVADDILLTEINETREMLKAHLDNQGIKILTKAKIKQVKESKIILDGQDDVSFDTLLVATGRQPNTQVAKDLNLEMDGKFFKVNEHYETSQKHVYAIGDLIKGYQLAHAASAHGIHVVETIMNKQPSLVRQEDITRCIYTRLEAASVGLSEAQAKEAGYDVKVTQSAFQGNAKALIKGENEGFIKLVVDKKYGEVLGAFIVGPHATDIIGELLSVKASEGTIHELSQIIQPHPALLEAIGESADAFFDSAIHM

SEQ ID NO: 18306 - protein, 211 aa, Staphylococcus epidermidis ATCC 12228
MNKLIDFSKGLVPVILQHAQTDSVLMLGYMNEEAYQKTLKEKKVTFFSRSKQRLWTKGETSGHFQHVESIHLDCDQDAILIKVMPQGPTCHTGSLSCFNSEIESRFKIQALAQTIHQSAKSNQSNSYTQYLLKEGIEKISKKFGEEAFEVVIGAIKHNREEVINETADVMYHLFVLLHSLDIPFSEVEQVLAHRHQKRNNFKGERKKVQEW

SEQ ID NO: 18307 - protein, 457 aa, Staphylococcus epidermidis ATCC 12228
MAKKKVIFECMACGYQSPKWMGKCPNCGAWNQMEEIVEKVAHPKHGVKTKETAGKVQKLNSVKHEATPRLLTESKEFNRVLGGGIVSGSLVLIGGDPGIGKSTLLLQICAALSQNKNVLYITGEESINQTKLRADRLEEDSSHLNVLAETDLEVIHQTVKEERPDLLVVDSIQTIYHPEISSAPGSVSQVRESTQSLMNIAKQMNIATFIVGHVTKEGQIAGPRLLEHMVDTVLYFEGDEHHAYRILRAVKNRFGSTNEMGIFEMKQSGLKGVLNPSEMFLEERSTNVPGSTIVPTMEGTRPLLIEVQALVTPTTFNNPRRMATGIDHNRLSLLMAVLEKKENYLLQQQDAYIKVAGGVKLTEPAVDLSIIVATASSFKDQAVDGLDCFVGEVGLTGEVRRVSRIEQRVQEATKLGFKRAIIPQTNIGGWTFPEGIQVVGVSSVHEALKYALHSKQR

SEQ ID NO: 18308 - protein, 455 aa, Staphylococcus epidermidis ATCC 12228
MFWQIFYRRDKTMKNYDLIIIGFGKAGKTLAAHAAGHGQKVAVVEQSTKMYGGTCINIGCIPTKTLIHDGIEGNSFKESITRKKEVVQALNNKNYQGLNSKNNIDVLNYNAKFISNEIIELQDSNGTIQETITADKILINTGSRANIPDIKGIDTAQNIYDSTGLLNIDYQPQELVIIGGGYIALEFASMFANFGTHVTILERGDAIMTNEDQDIANLIVKDLQDKGVTINTNTSTIAFSNNKDQTIIHTNHGEISADTVLLATGRKPNTNHLGLENTDVKIGKQGEVIVNKHLQSTVKHIYAAGDVKGGLQFTYISLDDYRIIKSHLFGDGSRTTENRGAIPYTVFIDPPLSRVGLIASEAKLQGYDILDNKVFVSNIPRHKINNDSRGLFKAVINKDTKEILGASLYGKESEELINLIKLAIDQHIPYTVLRDNIYTHPTMTESFNDLFLEPL

SEQ ID NO: 18309 - protein, 312 aa, Staphylococcus epidermidis ATCC 12228
MVNQVQLGKSSVNVFPIALGTNAVGGHNLYPNLDEEQGKEVVRQAIDNGITLLDTAYIYGPERSEELVGQVVKEYPREKVQIATKGSHVIKENGEVVQNNDPEFLKQQVENSLERLQVDYIDLYYIHFPDDDTPKDKAVAALKELKDEGKIKAIGVSNFSLEQLKEANKDGYVDVVQLEYNLLHRENEEVMAYAAENNITFVPYFPLASGILAGKYDENQTFEDHRAERPDFQPDVFKDNVRRVKALTDIAEAHDTTIANVVLAFYLTRPSLDVVIPGAKRAEQVVENIDAANIELSQGEIDKIDSLFPIKN

SEQ ID NO: 18310 - protein, 340 aa, Staphylococcus epidermidis ATCC 12228
MKAAVVTKDHRVSIEEKRLRELRPGEALVKTEYCGVCHTDLHVKNADFGDVTGVTLGHEGIGRVIKIADNVDSLKVGDRVSIAWMYAACGNCEYCTTGRETLCRDVLNAGYTVDGAMAEEVIVDANYAVKVPENLDPAAASSITCAGVTTYKAVKVSGIEPGQWLGVFGVGGLGNLALQYAKNVMGAKVVAFDINDDKLNFAKELGADAIINSTNVDPIEEVNRLTNNKGLDATVITAVAKTPFNQAVDVVKAGARVVAVGLPVDKMDLDIPRLVLDGIEVVGSLVGTRQDLREAFQFAAENKVIPKIQLRQLSEINDIFDEMEKGTITGRMVIDMKSTH

SEQ ID NO: 18311 - protein, 396 aa, Staphylococcus epidermidis ATCC 12228
MAKKIVSDLDLKGKVVLERADFNVPIKDGEITNDNRIVQALPTIEYIIEQGGKLVLFSHLGKVKEESDKEGLSLKPVAENLSKKLGKEVIFVPETRGEKLETAIENLNEGDVLLVENTRFEDLDGKKESKNDPELGKYWASLGDVFVNDAFGTAHREHASNVGISTHLETAAGYLMEKEIKFIGGVVNDPQKPVVAILGGAKVSDKINVIKNLVNIADKILIGGGMAYTFIKAQGKEIGLSLLEEDKIDFAKDLLENNGDQIVLPVDCKIAKEFSNDAKITEVSINEIPSDQEAMDIGPKTVELFNKELQGAHTVVWNGPMGVFEFSNFAKGTIGVCESIAKLEDATTIIGGGDSAAAAISLGFEDDFTHISTGGGASLEYLEGKELPGIKAINDK

SEQ ID NO: 18312 - protein, 253 aa, Staphylococcus epidermidis ATCC 12228
MRTPIIAGNWKMNKTVQEAKDFVNELPTLPDPKEVESVICAPTIQLDALVTAVKDGKAKGLKIGAQNAYFEESGAYTGETSPVALSELGVKYVVIGHSERRDYFHETDEEVNKKAHAIFNHGMTPIICVGESDEEREAGKANKIVGNQVKKAVEGLSDDQLKEVVIAYEPIWAIGTGKSSTSEDANEMCAHVRQTLADLSSQEVADATRIQYGGSVKPNNIKEYMAQSDIDGALVGGASLKVEDFVQLLEGAK

SEQ ID NO: 18313 - protein, 505 aa, Staphylococcus epidermidis ATCC 12228
MAKQPTALIILDGFANRESEHGNAVKQAHKPNFDRYYEKYPTTQIEASGLDVGLPEGQMGNSEVGHMNIGAGRIVYQSLTRINKSIEDGEFFDNTVLNNAVKHVKDNGSALHVFGLLSDGGVHSHYKHLFAILELAKKQGIDKVYVHAFLDGRDVDQKSALKYIEETEDKFKELGVGQFASVSGRYYAMDRDKRWDREERAYNAIRNFEGPTFTSAKAGVEANYKNDVTDEFVEPFIVEGQNDGVNDGDAVIFYNFRPDRAAQLSEIFTNKAFDGFKVEQVDNLFYATFTKYNDNVDAEIVFEKVDLNNTIGEVAQDNGLKQLRIAETEKYPHVTYFMSGGRNEEFEGERRRLIDSPKVATYDLKPEMSAYEVKDALLEELDKGDLDLILLNFANPDMVGHSGMLEPTIKAIEAVDECLGEVVDKIIDMGGHAIITADHGNSDQVLTDDDQPMTTHTTNPVPVIVTKEGVTLRETGRLGDLAPTLLDLLNVKQPSEMTGESLIKH

SEQ ID NO: 18314 - protein, 434 aa, Staphylococcus epidermidis ATCC 12228
MPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFEGIKSFYNLDK

SEQ ID NO: 18315 - protein, 323 aa, Staphylococcus epidermidis ATCC 12228
MNKILVTRQIPQHYVEQLKKIGQVVMWEHDLTPMSRESFLANVEDATACVITLSEHIDEEVFLRAQQLKVIANMAVGFDNIDISLAKKHGVVVTNTPHVLTETTAELGFTLMLTVARRIIEATSYIQEGKWKSWGPYLLSGKDVYGATVGIFGMGDIGKAFARRLQGFDARIIYHNRKRDLNAERDLNATYVTFKSLLEQSDFIICTAPLTKETENQFDARAFNKMKNDAVFINIGRGAIVDEEALLEALKNHEIQACGLDVMRQEPIQPNHPILKLPNAVVLPHIGSASQVTRNRMVQLCIDNIKAVLNNDAPITPVTSLHF

SEQ ID NO: 18316 - protein, 375 aa, Staphylococcus epidermidis ATCC 12228
MNNKYEPLFKSLTLPNGVEVRNRFVLAPLTHTSSNDDGTISDIELPYIEKRSKDVGIAINAASNVNDVGKAFPGQPSVAHDSDIEGLKELAQVMKKNGAKAIVQIHHGGAQALPELTPDGDVVAPSAISLKSFGQQKEHDAREMTAEEIEQTIRDFGEATRRAIEAGFDGVEIHGANHYLIHQFVSPYYNRRNDVWADNYKFPVAVIDEVVKAKKAHAYDDFIIGYRLSPEEAESPGISMEITEELIHQIANKPLDYIHVSLMDVNSVTREGKYKGENRLELIHQWINGRMPLIGIGSVFTAEDALNAVENIGVEFVALGREILLDYDFVAKIKEGREDEIINAFDPNREDQHYLTPNLWEQFNQGFYPLPRKDK

SEQ ID NO: 18317 - protein, 396 aa, Staphylococcus epidermidis ATCC 12228
MTQSEKIINLTNHYGAHNYVPLPIVISEAEGVWVKDPEGNTYMDMLSAYSAVNQGHRHPRIIQALKDQADKVTLVSRAFHSDNLGQWHEKICKLAGKDKALPMNTGAEAVETALKAARRWAYDVKGIEPNKAEIIAFNGNFHGRTMAPVSLSSEAEYQRGYGPLLEGFRKVEFGDVNQLKAAINKNTAAILVEPIQGEAGINVPPEGYLKTIRELCDEHQILFIADEIQAGLGRSGKLFATDWDHVKPDVYILGKALGGGVFPISVVLADNEVLDVFTPGSHGSTFGGNPLASAVSIAAIDVIIDEDLPGRSLELGEYFKSELKKIEHPSIKEVRGRGLFIGIELHESARPYCEALKEQGLLCKETHDTVIRFAPPLVITKEELDMALEKIKSVFA

SEQ ID NO: 18318 - protein, 443 aa, Staphylococcus epidermidis ATCC 12228
MTHIQLDYGKTLEFFDKHELDQQKDIVKTIHQTIHKGTGAGNDFLGWLDLPVDYDKEEFSRIVEASKRIKSNSDVLVVIGIGGSYLGARAAIEMLTSSFRTNTEYPEIVFVGNHLSSSYTKELLDYLQGKDFSVNVISKSGTTTEPAVAFRLFKQLVEEKYGKDEAKKRIFATTDKSKGALKQLADNEGYETFVVPDDVGGRYSVLTAVGLLPIATAGINIESIMIGAAKAREELSSDDLDQNIAYQYATIRNILYSKGYTTEMLINYEPSMQYFNEWWKQLYGESEGKDFKGIYPSSANYTTDLHSLGQYVQEGRRFLFETVVKVNHPKHDIKIEEDADDLDGLNYLAGKSIDEVNTKAFEGTLLAHTDGGVPNIVVNIPQLDEETFGYVVYFFELACAMSGYQLGVNPFNQPGVEAYKQNMFALLGKPGFEDKKKELENRL

SEQ ID NO: 18319 - protein, 492 aa, Staphylococcus epidermidis ATCC 12228
MKKAILSVSNKSGIVEFAKALTNLDYELYSTGGTKRVLEDANINIKSVSELTQFPEIMDGRVKTLHPAVHGGILADRDKEHHLEQLREQHIDLIDMVVVNLYPFQQTVAQPDVTETDAVENIDIGGPTMLRAAAKNFKHVTTIVHPSDYNEVIERIKNHQLDEAYRKSLMVKVFQHTNEYDHAIVNYFKDNKETLRYGENPQQSAYFVRTSDSKHTIAGAKQLHGKQLSFNNIKDADAALSLVKKFNEPTAVAVKHMNPCGVGIGQSIDEAFQHAYEADNQSIFGGIIALNRTVDVKLAEALHSIFLEVVIAPQFTEEALKILTQKKNIRLLQIDMTIDNAEQEFVSVSGGYLVQDKDNKDVTRNDMTVATDTQPTEAQWEAMLLGWKVVSAVKSNAVILSNNKQTVGIGAGQMNRVGSAKIAIERAIEINDNVALVSDGFFPMGDTVEYAAEHGIKAIIQPGGSIKDQDSIDMANKYGITMVMTGMRHFKH

SEQ ID NO: 18320 - protein, 468 aa, Staphylococcus epidermidis ATCC 12228
MVVGDFPIETDTIVIGAGPGGYVAAIRAAQLGQKVTIVEKGNLGGVCLNVGCIPSKALLHASHRFVEAQNSENLGVIAESVSLNYQKVQEFKTSVVNKLTGGVEGLLKGNKVEIVRGEAYFVDNNSLRVMDEKSAQTYNFKHAIIATGSRPIEIPNFEFGKRVIDSTGALNLQEVPNKLVVVGGGYIGSELGTAFANFGSEVTILEGAKDILGGFEKQMTQPVKKGMKEKGIEIVTEAMAKSAEETENGVKVTYEAKGEEQTIEADYVLVTVGRRPNTDELGLEELGLKFADRGLLEVDKQSRTSIENIFAIGDIVPGLPLAHKASYEGKVAAEAIDGQAAEVDYIGMPAVCFTEPELAQVGYTEAQAKEEGLSIKASKFPYAANGRALSLDDTNGFVKLITLKEDDTLIGAQVVGTGASDIISELGLAIESGMNAEDIALTVHAHPTLGEMTMEAAEKAIGYPIHTM

SEQ ID NO: 18321 - protein, 214 aa, Staphylococcus epidermidis ATCC 12228
MVKILPSLLSIDFLNLKEELQLLETAKVDGLHFDVMDGKFVPNISIGIPILDAVRQQSHLPIDVHLMIEQPENYINLFAEHGADMISVHVESTTHIHRAIEQIKQLGKKAGVVINPGTSVETILPILSIVDYVLVMTVNPGFGGQTFIEQCVTKIEQLNQLKHENHLTFDIEVDGGINDQTSKRCVEQGATMLVTGSYFFKQEDYAKVTSLLKE

SEQ ID NO: 18322 - protein, 274 aa, Staphylococcus epidermidis ATCC 12228
MNAYLAEFLGTAILILFGGGVCANVNLKRSAGNGADWIVIAFGWGLAVTMGVYAVGTFSGAHLNPAVTVALAMDGGFSWAQVPGYIVCQMLGGIVGGVFVWLMYLPHWKVTEDPAVKLGVFSTAPAIKNYFANFLSEIIGTMALTLGILFIGVNKIADGLNPIIVGSLIIAIGLSLGGTTGYAINPARDLAPRIAHAILPIHGKGKSNWSYAIVPVLGPMAGGMLGAIVYEVFYKQTFNFSCFIGLIVLIFTLILGVILNKISQNKNNDIESIY

SEQ ID NO: 18323 - protein, 158 aa, Staphylococcus epidermidis ATCC 12228
MESIYDFVVQKNNGESYKLEQYKGDVMLIVNTASECGFTPQFEGLQKLYDEYKDQRFIILGFPCNQFGGQEPGSGEEAAQNCKINYGVTFPIHEKVDVKGDNQHPLFHFLTNAAKGMINEKIKWNFTKFLIDREGNVIKRFSPQKKPEQIKTEIEKLL

SEQ ID NO: 18324 - protein, 446 aa, Staphylococcus epidermidis ATCC 12228
MPKRSFTKDDIRKFAEEENVRYLRLQFTDILGTIKNVEVPVSQLEKVLDNEMMFDGSSIEGFVRIEESDMYLHPDLDTWVIFPWTAGQGKVARLICDVFKTDGTPFEGDPRANLKRVLRRMEDMGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPEGDLQLTDTAYQFTAGVLKNARGFTAVCNPIVNSYKRLVPGYEAPCYIAWSGKNRSPLVRVPTSRGLSTRIEVRSVDPAANPYMALAAILEAGLDGIENKLEVPEPVNQNIYEMNREEREAVGIQDLPSTLYTALKAMRENKSIKNALGNHIYNQFINSKSIEWDYYRTQVSEWEREQYIKQY

SEQ ID NO: 18325 - protein, 482 aa, Staphylococcus epidermidis ATCC 12228
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDKIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 18326 - protein, 325 aa, Staphylococcus epidermidis ATCC 12228
MKIFDYEDIQLIPNKCIVESRSECNTSVKFGPRTFKLPVVPANMQTVMNEELAQWFAENDYFYIMHRFNEENRIPFIKKMHHAGLFASISVGVKENEFNFIEKLASSSLIPEYITIDIAHGHSNSVINMIKHIKKHLPNSFVIAGNVGTPEGVRELENAGADATKVGIGPGRVCITKIKTGFGTGGWQLSALNLCNKAARKPIIADGGLRTHGDIAKSIRFGATMVMIGSLFAAHEESPGETVELDGKKYKEYFGSASEYQKGEHKNVEGKKMFVEHKGSLKDTLTEMEQDLQSSISYAGGKDLKSLRTVDYVIVRNSIFNGDRD

SEQ ID NO: 18327 - protein, 243 aa, Staphylococcus epidermidis ATCC 12228
MSKLFIPYIMGDLNFIHHLKTLTENGADIVEIGVPFSDPVADGPIIMKAGRNAIDEGSNIKFIFDELIKNKNTISSKYVLMTYYNILSAYGEELFLDKCDEAGVYGLIIPDLPYELTKKFKKDFYHHSVKIISLIAMTASDARIMQIAKNSEGFIYTVTMNATTGNSGEFHPDLKRKIEYIKKVSKIPVVAGFGIKNPEHVKDIASVADGIVIGSEIVKRIEIDSRKEFITYIKSIRTTLNSL

SEQ ID NO: 18328 - protein, 302 aa, Staphylococcus epidermidis ATCC 12228
MQKNILKSGIEISELGLGCMSLGTDYKKAQPIIESAIDNGITYFDTADIYDQGVNEEIVGKALKKYQNRDDIVIGTKVGNRLTDDGHMTWDPSKKHIKESVKGSLKRLGLNHLDLYQLHGGTIDDPLDETISAFDELKQEGYIRAYGISSIRPNVIDYYLKNSQIETLMSQFNLIDNRPESLINDVHDKQVKILARGPVFKGLLTSKSVDVIDEKFKNGVLDYTQDELGSTIASIKELESNLTALSFKYLTSHDAMGSIIVGASSVEQLEENVRNYYKEISLDQIKSARNRVKDIEYTQHLK

SEQ ID NO: 18329 - protein, 468 aa, Staphylococcus epidermidis ATCC 12228
MTQQIGVVGLAVMGKNLAWNIESRGYSVSVYNRSRQKTDEMVKESPGREIYPTYSLEEFVESLEKPRKILLMVKAGPATDATIDGLLPLLDDDDILIDGGNTNYQDTIRRNKALAESSINFIGMGVSGGEIGALTGPSLMPGGQKDAYNKVSDILDAIAAKAQDGASCVTYIGPNGAGHYVKMVHNGIEYADMQLIAESYAMMKDLLGMSHKEISQTFKEWNAGELESYLIEITGDIFNKLDDDNEALVEKILDTAGQKGTGKWTSINALELGVPLTIITESVFARFISSIKEERVTASKSLKGPKAHFEGDKKTFLEKIRKALYMSKICSYAQGFAQMRKASEDNEWNLKLGELAMIWREGCIIRAQFLQKIKDAYDNNENLQNLLLDPYFKNIVMEYQDALREVVATSVYNGVPTPGFSASINYYDSYRSEDLPANLIQAQRDYFGAHTYERKDREGIFHTQWVEE

SEQ ID NO: 18330 - protein, 473 aa, Staphylococcus epidermidis ATCC 12228
MSEKQYDLVVLGGGTAGYVAAIRASQLGKKVAIVEKSLLGGTCLHKGCIPTKALLKSAEVNHTIKNAHTFGIDVNHFKINFPKILERKDAIVKQLHEGVNQLMKHHHIDIYNGIGRIMGTSIFSPQSGTISVEYEDGESDILPNKNVLIATGSSPQSLPFIKFDHKQILSSDDILRLNTLPQRLAIIGGGVIGLEFASLMNDLGADVVVIEANDRVLPTESTQVASLLKEELTNRGVTFYENIQLTKDHFNQTDKGVTINISDEPVQFDKVLVAIGRKPNTNDIGLNNTQIKTSDAGHIITNAYQQTEDKHIYAAGDCIGQLQLAHVGSKEAIVAVEHMFDCSPIPINYDLIPKCVYTNPEIASIGKNLEQAKKAGIKAKSIKVPFKAIGKAIIEDVTQSKGFCEMVVNKDDDEIIGLNMIGPHVTELINEISLLQFMNGSSLELGLTTHAHPSLSEVVMELGLKANGQAIHV

SEQ ID NO: 18331 - protein, 376 aa, Staphylococcus epidermidis ATCC 12228
MMSYLFNNYKRDNIEFVDANQNELIDKDNNVYLDFSSGIGVTNLGFNMEIYQAVYNQLNLIWHSPNLYLSSIQEEVAQKLIGQRDYLAFFCNSGTEANEAAIKLARKATGKSEIIAFKKSFHGRTYGAMSATGQKKITDQFGPVVPGFKFAIFNDFNSFKSLTSNNTAAVIIEIIQGESGVLPADPLFMKQLNEYCKQKDILIIVDEVQTGIGRTGKLYAHEHYQLSPDIITLAKGLGNGLPIGAMLGKKNLGHAFGYGSHGTTFGGNRLSLAAANQTLSIINDADLLNDVQSKGQFLIENLRKSLVNKRNVIEVRGVGLMVGIEVTNDPSQVVREAKRMGLIILTAGKNVIRLLPPLTITKKQLEKGIEILTEII

SEQ ID NO: 18332 - protein, 373 aa, Staphylococcus epidermidis ATCC 12228
MAKRDYYEVLGVNKSASKDEIKKAYRKLSKKYHPDINKEEGADEKFKEISEAYEVLSDENKRANYDQFGHDGPQGGFGSQGFGGSDFGGFEDIFSSFFGGGSRQRDPNAPRKGDDLQYTMTITFEEAVFGTKKEISIKKDVTCHTCNGDGAKPGTSKKTCSYCNGAGRVSVEQNTILGRVRTEQVCPKCEGSGQEFEEPCPTCKGKGTENKTVKLEVTVPEGVDNEQQVRLAGEGSPGVNGGPHGDLYVVFRVKPSNTFERDGDDIYYNLDISFSQAALGDEIKIPTLKSNVVLTIPAGTQTGKQFRLKDKGVKNVHGYGHGDLFVNIKVVTPTKLNDRQKELLKEFAEINGEDINEQSSNFKDRAKRFFKGE

SEQ ID NO: 18333 - protein, 427 aa, Staphylococcus epidermidis ATCC 12228
MSFEKSIKAMEQAEKLMPGGVNSPVRAFKSVDTPAIFMDHGEGSKIYDIDGNEYIDYVLSWGPLILGHKNQQVISKLHEAVDKGTSFGASTLQENKLAELVIDRVPSIEKVRMVSSGTEATLDTLRLARGYTGRNKIIKFEGCYHGHSDSLLIKAGSGVATLGLPDSPGVPEGIAKNTITVPYNDLDSLKLAFEKYGDDIAGVIVEPVAGNMGVVPPVNGFLQGLRDITNEYGALLIFDEVMTGFRVGYNCAQGYFGVTPDLTCLGKVIGGGLPVGAFGGKKEIMDYIAPVGTIYQAGTLSGNPLAMTSGYETLSQLTPESYEYFNSLGDILEKGLKEVFAKHNVPITVNRAGSMIGYFLNEGPVTNFEEANKSDLKLFSNMYREMAKEGVFLPPSQFEGTFLSTAHTKDDIEKTIQAFDNALSRIV

SEQ ID NO: 18334 - protein, 500 aa, Staphylococcus epidermidis ATCC 12228
MKKNNKQNDGVQRGLKDRHISMIAIGGCIGTGLFMTSGGAIHDAGALGALIAYAVIGAMVFFLMTSLGEMATYLPVSGSFSTYATRFVDPSLGFALGWNYWFNWVITVAADVTIAAQVIQYWSPMQGIPAWVWSCIFLIIIFALNSLSVRVYGESEYWFALIKVVTVIIFIGIGILTILGIMGGEFVGFDTFTKGDGPILGGNLGGSLLSILGVFLVAGFSFQGTELIGITAGESENPERAVPKAIKQVFWRILLFYILAIFIIGMLIPYDSKALMGGGDSIATSPFTLVFKNAGLAFAASFMNAVILTSVLSAGNSGMYASTRMLYSMSKDKLAYNSFGKTNKSGVPYVSLIATGVLVILIFALQHLSGDAYEYIVAASGMTGFIAWVGIAISHFRFRRAFDKQNYDKSKLKYKAKLFPFGPIFAGILCVIVIIGQDVDFIKTGNFDMNRFFITYMGIPVFLIFFFYHKFRYKTKKIPLNKVDLRQDVSMEEVRHHKNN

SEQ ID NO: 18335 - protein, 452 aa, Staphylococcus epidermidis ATCC 12228
MAENLQRELSNRHVQLIAIGGAIGTGLFLGAGQTIAMTGPSILLTYIIIGFMLFMFMRGLGEIIIQNTNFKSFADVTNTYIGPFAGFVTGWTYWLCWIITGMAEVTAVAKYISFWFPDIPNWISALFCVLILMSFNLLSAKLFGELEFWFAIIKIVTIIALIVIGVIMILFAFKTPFGNTSLTHLYQHGIFPKGASGFFMSFQMALFSFVGIEMIGVTAGETKDPEKTIPKAINSVPIRILIFYVGALAVIMSIIPWDKVDPDNSPFVRLFALIGIPFAAGIINFVVLTAAASSCNSGIFSNSRMLYGLSNQNQAPPTFASTNKHGVPHKAIIASSALLLIAALLNYIFPDATLVFTYVTTISTVLFVVVWALIIIAYINYSRKNPELHKKATYKLPGGQYMGYLILIFFVFVFALLFINVDTRRAIYCTPIWFILLGLMYLRYKKADKESR

SEQ ID NO: 18336 - protein, 285 aa, Staphylococcus epidermidis ATCC 12228
MFKDFFNRSKKKKYLTVQDSKQNDVPAGIMTKCPKCKKIMYTKELNENLNVCFNCDHHIALTAYKRIEAISDEGSFIEFDRGMTSANPLDFPGYEEKIEKDQQKTGLNEALVSGTAKLDGIQYGVAVMDARFRMGSMGSVVGEKICRIIDYCTEHRLPFILFSASGGARMQEGIISLMQMGKTSVSLKRHSDAGLLYISYITNPTTGGVSASFASVGDINLSEPKALIGFAGRRVIEQTINEKLPDDFQTAEFLLEHGQLDKVIHRKDMRETLSNILKIHQEVSN

SEQ ID NO: 18337 - protein, 474 aa, Staphylococcus epidermidis ATCC 12228
MNFWLQEQAQSNGNRLAIVTNQLSLTYEELYHRAKTIAQYLTSLNQKRIGLYISNDIDSVVLIHACWLAHIEIAMINTRLTRHEMINQMNSVDIATIVHTLPLELEGFNLYHFNDLTQLDKHDVSGYKFNLESIASIMFTSGTTGPQKAVPQTFNNHLASAKGCKQSLGFEQNTVWLSVLPIYHISGLSVILRAVIEGFTVRLVKKFQTDDMLTQIKTYPITHMSLVPQTLKWLMDAGLTQPFSLEKILLGGAKLSPQLIEQAFAYRLPVYNSFGMTETCSQFLTASPQMLKERFDTVGKTSENVEVKIKNPNAYGHGELLIKGENVMNGYLYPKYLKDTFDNDGYFQTGDIAEIDDEGYVIIYDRRKDLIISGGENIYPYQIETIAKDFEGIEDAVCVGISDDTWGQVPILYYVTNQDINQNELIEHFENHLARYKIPKKYYQVESLPYTSTGKLQRKKVKSEDLNEGKNNES

SEQ ID NO: 18338 - protein, 242 aa, Staphylococcus epidermidis ATCC 12228
MPVINIKNLNKKFGANEVLRDINLTVEKGEVVAIIGPSGSGKSTLLRCMNLLDVPSKGKVIFEDNELTQHNVHLDNLRQKMGMVFQNFNLFPHKKVIENVMLAPLLLHKDSKDQLKEKALYLLEKVGLKDKADSYPNQLSGGQKQRVAIARALAMEPDVMLFDEPTSALDPEVVGDVLKVMRQLANEGMTMVIVTHEMNFAKEISDKVVFMADGVVVESGTPQNIFENPQHSRTENFLSRVL

SEQ ID NO: 18339 - protein, 429 aa, Staphylococcus epidermidis ATCC 12228
MKFTESERLQQLSNEYILGGVNSPSRSYKAVGGGAPVVMKEGHGAYLYDVDGNKYIDYLQAYGPIITGHAHPHITEAIQDQAAKGVLYGTPTELEINFSKKLREAVPSLEKIRFVNSGTEAVMTTIRVARAYTKRNKIIKFAGSYHGHSDLVLVAAGSGPSQLGSPDSAGVPQSVAQEVITVPFNDIESYREAIDYWKDDIAAVLVEPIVGNFGMVMPQPGFLEEVNKISHDNGTLVIYDEVITAFRFHYGAAQDLLGVKPDLTAFGKIVGGGLPIGGYGGRQDIMEHVAPLGPAYQAGTMAGNPLSMRAGIALLEVLEQEGVYDKLDQLGRRLEEGLQKLIDKHHITATINRIYGSLTLYFTNEKVTHYEQVENSDGDAFAQFFKLMLNQGINLAPSKFEAWFLTTEHTEEDIDRTLEAADYAFSKMK

SEQ ID NO: 18340 - protein, 489 aa, Staphylococcus epidermidis ATCC 12228
MYQYNDDSLMLHNDLYQINMAESYWNDGIHERIAVFDLYFRKMPFNSGYAVFNGLKRVVNFIENFGFTNEDITYLKSIGYEEDFLNYLKDLKFTGNIKSMQEGEICFGNEPLLRVEAPLIQAQLIETILLNIINFQTLIATKASRIRQIATHDTLMEFGTRRAQEIDAALWGARAAFIGGFDSTSNVRAGKLFNIPVSGTHAHALVQTYGDEYIAFKKYAERHKNCVFLVDTFHTLKSGVPTAIKVAKELGDTINFIGIRLDSGDIAYLSKEARRMLDEAGFTEAKIIASNDLDEQTITSLKAQGAKVDGWGVGTKLITGYDQPALGAVYKLVSIETDDGTMSDRIKLSNNAEKVTTPGKKNVYRIINNKTGKAEGDYITLEGENPNDESPLKMFHPVHTYKMKFIKSFKAVNLHQSIFENGKLVYHLPDEYEAQDYLKNNLSILWEENKRYLNPQDYPVDLSTKCWENKHKRIFEVAEHVKEMEDENE

SEQ ID NO: 18341 - protein, 267 aa, Staphylococcus epidermidis ATCC 12228
MHLYYLGPKGTFSYLAAKQFESHEQYDFIPLSNLHEVIQSVSKDKQAVGIVPIENSIEGTINIVADSLAHHDVYAHGEIQLDIDFSLYGHHSNSLDDIHKVYSIAPAISQTINYIHRQQFDYDYVDSTIQSLNMIKDGIGAIAPLGSGETYGYHTLDQHIQDYPHNVTRFLVVKNHTHFIEHPNTTIFLITPKYDKPGLLASVLNTFTLFNINLSWIESRPLKTQLGMYHFYVQADTAINNDVNKIISILETLDFQVKIIGAFNKKN

SEQ ID NO: 18342 - protein, 459 aa, Staphylococcus epidermidis ATCC 12228
MTIIRDKFNNSKAFFNTHKTKNLKFRKQQLKLLSKNIKNHENELLDALYKDLGKSKVEAYATEIGMLLKSIKLMRKELKNWSKTKQTDTPLYLFPTKSYIKKEPYGTVLIIGPFNYPVQLVFEPLIGAIAAGNTAIVKPSELTPHVAIVIKDIIEDTFDEAYVSVVEGGIEETQTLLSLPFDYMFFTGSEKVGKIVYEAAARKLIPVTLELGGKSPVIVDDTANIKVASERISFGKFTNAGQTCVAPDYILVQRKVKNDLIKALKKTITEFYGENIEKSPDFGRIVNQKHFNRLNDLIQIHKDNVVFGGNSSKEDLYIEPTLLDNITNDNKIMKEEIFGPILPIITYDNFDEVLEIIQSKSKPLSLYLFSEDENMAHRVVEELSFGGGAINDTLMHLANPNLPFGGVGSSGIGQYHGKYSFDTFSHMKSYTFKSTRLESSLFFPPYKGKFKYIKTFFKN

SEQ ID NO: 18343 - protein, 319 aa, Staphylococcus epidermidis ATCC 12228
MRRLFAIGEALIDFIPNVTHSKLKDVEQFSRQVGGAPCNVAATVSKLGGKSEMITQLGNDAFGDIIVETIEQLGVGTQYIKRTNKANTALAFVSLQDDGQRDFSFYRKPSADMLYQPENIDDIQVFQDDILHFCSVDLIESDMKYAHEKMIEKFESVDGTIVFDPNVRLPLWEDKLECQRTINAFIPKAHIVKISDEELLFITGKRNEDEAIQSLFRGRVNVVIYTQGAQGATIYTKDDYRIHHEGYQVQAIDTTGAGDAFIGAIIYCILESRYSECKDLFKEKGKDILAFSNRVAALTTTKHGAIESLPTKEDIKDYN

SEQ ID NO: 18344 - protein, 475 aa, Staphylococcus epidermidis ATCC 12228
MRNFTKQYINGEWVDSASGETIDVINPATEEVMGKIAKGNEEDVNKAVDAADKVYLEFRHSSVEERRELLDKIVKEYQNRKNDLIEAITDELGAPLSVSENVHYQMGLNHFTAARDALDSFQFEEQRGDDLVVKEAIGVAGLVTPWNFPTNQTSLKLAAAFAAGSPVVLKPSEETPFAAIILAEIFDKVGVPKGVFNLVNGDGSGVGNPLSEHPKVRMMSFTGSGPTGSKIMEKAAKDFKKVSLELGGKSPYIVLDDVDVEEAANATTKKVVNNTGQVCTAGTRVLIPESIKEDYLTAVKEAFSKVKVGQPREEGTQVGPIISKKQFDQVQDYIDKGINEGAELFYGGPGKPEGLDKGYFARPTIFINVDNHMTIAQEEIFGPVMSVITYNNLDEAIEIANDTKYGLAGYVIGKDKDTLRHVARSIEAGTIEINEAGRKPDLPFGGYKESGLGREWGDYGIEEFLEVKSIAGYFK

SEQ ID NO: 18345 - protein, 470 aa, Staphylococcus epidermidis ATCC 12228
MTKKLPDDFIFGGATAAYQAEGATQTDGKGRVAWDTYLEENYWYTAEPASDFYNRYPVDLELSERFGVNGIRISIAWSRIFPKGYGEVNQKGVEYYHNLFKECHKRHVEPFVTLHHFDTPEVLHKDGDFLNRKTIDYFVDYAEFCFKEFPEVKYWTTFNEIGPIGDGQYLVGKFPPGIKYDFEKVFQSHHNMMVAHARAVKLFKDENYKGEIGVVHALPTKYPYDPSNPEDVRAAELEDIIHNKFILDATYLGKYSRETMEGVQHILSVNGGQLEISDEDYKILDEAKDLNDFLGINYYMSDWMRGFEGESEITHNATGDKGGSKYQLKGVGQREFDVDVPRTDWDWMIYPQGLYDQIMRVVKDYPNYHKIYITENGLGYKDVFDEKEKTVHDDARIDYIKQHLSVIADAIADGANVKGYFLWSLMDVFSWSNGYEKRYGLFYVDFETQERFPKKSAYWYKELAESKEIK

SEQ ID NO: 18346 - protein, 215 aa, Staphylococcus epidermidis ATCC 12228
MNIILMGLPGAGKGTQASEIVKKFPIPHISTGDMFRKAIKDETDLGKEAKSYMDRGELVPDEVTVGIVKERISEDDAKKGFLLDGFPRTIDQAESLSQIMSELDREIDAVINIEVPEEELMNRLTGRRICEKCGTTYHLVFNPPKVDGICDIDGGKLYQREDDNPETVSNRLSVNVKQSKPILEYYNNKGVLKNIDGSKDIDEVTNDVIDILDHL

SEQ ID NO: 18347 - protein, 444 aa, Staphylococcus epidermidis ATCC 12228
MKKYFQFDKHGTSYKNEILGGITTFLSMAYILAVNPQILSLAGVKGATSDMKMDQGAIFVATALAAFVGSLFMGLIAKYPIALAPGMGLNAFFAFTVVLTMGIPWQVGLTGVLFSGIFFALLTVTGLREVIINAIPHQMKLAVSAGIGLFITFVGLQSSGIIIKSDSTLVKLGHLTEAPVLLAIFGIIVTVILYAMKIPGSIFIGMIVTAVAGMLTGQIHPPSGIIGEVPSIKPTFGAAFESFKDPGQLFTIQFLIVILTFLFIDFFDTAGTLVAVATQAGLMKDNKLPRAGRALFSDSLATIVGSVFGTTTTTSYIESTSGVAVGARTGFASIVTGICFLLALFFSPLIEVVTSAVTTPALVVVGVLMAANFADINWKQFEVAVPAFITIIMMPLSYSIATGIACGFIFYPITMIITKKYKEVHPIMYFLMALFILYFIFVHK

SEQ ID NO: 18348 - protein, 458 aa, Staphylococcus epidermidis ATCC 12228
MENNELQRGLNARQMQMIALGGTIGVGLFMGATSTIKWTGPSVILAYLIAGIFLFLIMRAMGEMIYINPTTGSFATFASDYIHPAAGYMTAWSNVFQWVVVGMSEVIAVGEYMNYWFPSLPNWIPGVIAVLFLMAANLVSVKAFGEFEFWFALIKVVTIVLMIIAGLGLILFGIGNGGNPIGISNLWSHGGFMPNGFIGFFFALSIVIGSYQGVELIGISAGETKNPQTNIVKAVNGVIWRILIFYIGAIFVIVSVYPWNQLGSIGSPFVATFAKVGITFAAGLINFVVLTAALSGCNSGIFSASRMIYTLAKKGQMPKVFTKVMKNGVPFYTVFAVSMGILIGALLNVILPLIIDGADSIFVYVYSASILPGMIPWFMILFSHLRFRRLHPEKVHNHPFKMPGGAIANYLTIMFLLLVLVGMLLNKETVVSVVIGIVFLTAVTLYYLIRYHKKERQI

SEQ ID NO: 18349 - protein, 387 aa, Staphylococcus epidermidis ATCC 12228
MNMKKGVSQLTLQTLSLVAGFMAWSIISPLMPFISQDVDISPGQISVILAIPVILGSVLRVPFGYLTNIVGAKWVFFWSFIVLLLPIFLLGQAQSPGMLMLSGFFLGIGGAIFSVGVTSVPKYFSKDKVGLANGIYGVGNIGTAVSSFCAPVLAGAIGWQNTVRSYLIILSIFAILMFFLGDKNEPKVKIPLMAQVKDLSKNYKLYYLSLWYFITFGAFVAFGIFLPNFLVDHFSIDKVDAGIRSGIFIALATFLRPVGGVIGDKFNAVQALIIDFVIMIIGALILSLSSHIVLFTIGCLAISICAGIGNGLIFKLVPSYFSKEAGSANGIVSMMGGLGGFFPPLVITFVTSITGSSHLAFFFLAIFGVIALITMIHLNKKEKAIRI

SEQ ID NO: 18350 - protein, 243 aa, Staphylococcus epidermidis ATCC 12228
MIELSHIHKSFNETEVIKGIDLKVNQGEVVTLIGRSGSGKTTLLRMINALEIPTEGTVYVNGMTYNAKDKKSQIKVRQQSGMVFQNYNLFPHKSALENVMEGLITVKKMNKATANEEAMNLLAKVGLVHVKDQRPHALSGGQQQRVAIARALAMNPKVMLFDEPTSALDPELVNDVLKVIKELADEGMTMVIVTHEMRFAKEVSNQIAFIHEGVIAEQGTPEDIFNHPKTEELQRFLNVINEK

SEQ ID NO: 18351 - protein, 228 aa, Staphylococcus epidermidis ATCC 12228
MPKLILCRHGQSEWNAKNLFTGWADVKLSKQGIEEAQSAGKKIYDNQIEIDIAFTSLLTRALETTQYILAGSDQQWIPVYKSWRLNERHYGGLQGLNKDDARKKWGEDQVHQWRRSYDVRPPRESEEQREAYLKNRRYQHIDHRMMPYCESLKDTLERVVPFWTDHISQHLLDDKTVLVSAHGNSIRALIKYLEGLSEEDIVGYEIKTGAPLVYELTDDLVVKDKYYL

SEQ ID NO: 18352 - protein, 458 aa, Staphylococcus epidermidis ATCC 12228
MAKQLQRELNNRHIQLIAIGGAIGTGLFLGSGQTISLTGPSLLFTYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFIFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 18353 - protein, 452 aa, Staphylococcus epidermidis ATCC 12228
MFNFLKPARHIKSLPSEKVDDTYKRLRFQVFLGIFIGYAGYYLLRKNFSLAMPSLIEQGFSKGELGIALSAVSIAYGFSKFVMGTVSDRSNARMFLTLGLVLTAIINLLLGFIPFFTSSITIMFIMLFLVGWFQGMGWPPSGRVLVHWFSVSERGSKTSIWNVAHNVGGGLMAPIATWGISMTALYNFGYLKGFEGVFIYPALLAIIIAILSYILIRDTPQSQGLPPIEQYKNDYATSTKQTIETELTTKEILFKYVLNNKWVWAIAFTNIFVYFVRYGVLDWAPTYLSEEKHFDLSASGWAYFLYEWAGIPGTLLCGYLSDKLFKGRRGPAGFFFMLGVTIFILIYWLNPPGHAWLDNLSLIGIGFLIYGPVMLIGLQALDYVPKKAAGTAAGLTGLFGYLFGAVMANIVLGFVVQHFGWHIGFVLLTVISILAMLCFILTWNKRGQEQID

SEQ ID NO: 18354 - protein, 479 aa, Staphylococcus epidermidis ATCC 12228
MEVFNMTNQLFINNEFIESQSKETMDVINPATGEAFDTITLATEEEVNDAIEKSQQAQLEWERVPQPTRAEHVKLLIPLLEKNRDEIAQLYVKEQGKTLTQAYGEIDKSISFIDYMTSLSMSDKGRVLQNSIANETIQIINKPIGVTAGIVPWNAPILVLMRKVIPAIVTGCSVVIKPSEETTLLTLRLAELFRASTIPAGLIQIVPGTGETVGTQLASHKDIQLISLTGSMRAGKSVYENAAQTVKKVNLELGGNAPVIVTSNADLDKAVNYIVTARINNAGQVCTCPERIFVHEDVHDDFLNKVTSKMKSLTVGDPFDENTDYGAIINQKQLDSIHEKVQDAIKNGATLMTGGHQLKRHGFFYAPTVLDNVRKDDNVFKDEIFGPVLAITTYRDFEQVIEDANDTNAGLSSYIFSENLTEVMTATERLKFGEVYANCEAEEVVNGYHAGWRESGLGGADGIHGFEEYYNTTVSYIRY

SEQ ID NO: 18355 - protein, 497 aa, Staphylococcus epidermidis ATCC 12228
MTNINVRNYIDESYGLFINNEFQASDSGETLTVSNPANGEDLAKVARAGKKDVDKAVQAAHDAFDSWSKISKEERADYLLEISRRIHEKTEHLATVESLQNGKPYRETSTIDVPQAANQFKYFASVLTTDEGSVNEIDQNTMSLVVNEPVGVVGAVVAWNFPILLASWKLGPALAAGNTVVIQPSSSTPLSLIELAKIFQEVLPKGVVNVLTGKGSESGDAIFHHEGVDKLSFTGSTDVGYGVAQAGAERIVPTTLELGGKSANIIFDDANLEQVIEGVQLGILFNQGEVCSAGSRLLVQSSIYDELLPKLKEAFENIKVGDPFDEDTKMSAQTGPEQLDKIESYIKIAEEDDKANILTGGHRITDNGLDKGYFFEPTIIEINDNKHQLAQEEIFGPVVVVEKFDDEQEAIEIANDSEYGLAGGIFTTDIHRALNVAKAMRTGRIWINTYNQIPAGAPFGGYKKSGIGREVYKDAIKNYQQVKNIFIDTSNQTKGLY

SEQ ID NO: 18356 - protein, 391 aa, Staphylococcus epidermidis ATCC 12228
MRRHSMEMSERLASIPDSYFGKTMGRIVEHGPLPLINMAVGIPDGETPKGIINHFSEALCIPENQKYGPFHGKDAFKQAIVNFYQRHYDVELDKEDEVCILYGTKNGLVALPTCVVNPGEIVLLPDPGYTDYLAGVMLADAKPLPLKLSPPNYLPNWNTISAKVLEKTKLIYLTYPNNPTGSTATQDDFDEAIHRFKGTQTKIVHDFAYSAFGFDAKNPSILASKNAKDVAIEIFSLSKGYNMSGFRVGFAVGNKKMIQALKKYQTHTNAGMFGALQDAATYALNHYDEFLEKQNEIFRRRRDNFESQLKHAHLPFVHSKGGIYIWLHTPPGYDSEAFEQLLLKEKSILVAPGKPFGENGNQYVRVSLALDDKQLEEAANRLTQLRYLYER

SEQ ID NO: 18357 - protein, 459 aa, Staphylococcus epidermidis ATCC 12228
MADKLQRELSNRHIQLIAIGGAIGTGLFLGAGQSIHLAGPSILLTYIIVGFVLFMFMRAMGELLLSNLGFKSFGDIAHHHIGSMAGFMVGWTYWLTWIISGMAEVTAVAKYVSFWYPTIPNWLTAAATILVLVALNLFSAKLFGELEFWLSIIKVLTILALIAVGVVMIVFGMKTSYGPATVTNIWKDGGFFPNGAQGFFMSFQMAIFSFIGIELIGITAGETKDPHKTIPQAINNVPFRILLFYIGSLAVIMSVVPWQQLNPADSPYVKMFGLVGIPFAAGIINFVVLTAAASSCNSGIFANSRTMFGLAGRKQGPAFLHRTNKHGVPHYAILVTCGLLSISVVLNAIFKDATKVFVQITTFSTVLNIMIWTIIMIAYLGYLRHEPKQHKESNYKMWGGKYMAYSILGFFAFIFIILLINSATRYAVLSAPVWFVIMLLMYQKYKKESRKAKIKNEEE

SEQ ID NO: 18358 - protein, 483 aa, Staphylococcus epidermidis ATCC 12228
MGSFFNRMTRKENPTIYQSKDGHLKRTLRVRDFLALGVGTIVSTSIFTLPGVVAAEHAGPAVSLSFLLAAIVAGLVAFTYAEMASTMPFAGSAYSWINVLFGELFGWVAGWALLAEYFIAVAFVASGFSANLRGLIAPLGISLPKSLSNPFGSNGGVIDIIAAVVIILTALLLSRGMNEAARMENVLVILKVLAIILFVIVGLTAINFSNYIPFIPEHKVTETGDFGGWQGIYAGVSMIFLAYIGFDSIAANSAEAINPQKTMPRGILGSLIVAIVLFVAVALVLVGMFHYSQYADNAEPVGWALRESGHGIIAAIVQAISVIGMFTALIGMMLAGSRLLYSFGRDGLLPSWLSQLNHKHLPNRALVILTIIGVVIGSMFPFAFLAQLISAGTLVAFMFVSLAMYRLRKREGKDLPKPEFKLPLYPILPAITFILVLLVFWGLSFEAKLYTLIWFIVGIIIYLIYGIRHSKKNDEEAYQVPRK

SEQ ID NO: 18359 - protein, 445 aa, Staphylococcus epidermidis ATCC 12228
MSKVNHLIDEDERYFAHSGRIKYYPLVIDHGYGATLIDIDGKSYIDLLASASSQNVGHAPKPVVEAIKNQTEKFIHYTPAYMYHEPLVRLSKKLCDIAPGNYEKRVTFGLSGSDANDGIIKFARAYTGRPYIISFTNAYHGSTFGSLSMSSISLNMRKRYGPLLNGFYHIPFPDKYRGMFEQAKPNTVEEYLAPLKEMFTKYVPAEEVACIVVETIQGDGGLLEPVPGYFEALQELCHAHNILIAVDDIQQGLGRTGKWSSVDHYHFTPDLMTFGKSLAGGLPMSAIVGRKEIMESLEAPAHLFTTGANPVSCEAALATIKMIEDEDLLNASWKKGSYVRKRIDPWIERYQYVGDVRGIGLSIGIDIVSNKIEKTRDSEAALKICNYCFENGVIIIAVAGNVLRFQPPLVITYKQLDKALDTIEEALEKLERGELNQYDISGQGW

SEQ ID NO: 18360 - protein, 453 aa, Staphylococcus epidermidis ATCC 12228
MKYIVVGTSHSGYEVIQTLLKEDENADIQVFESADQPSFLSCGIQSYLEDISSSLDDLHYASVDSYKAQGVNIHTNSTVTDLDTDNKTVVVEHQGQTATYSYDKLFLSPGGKPVTPPVDGIEKYKHVLFMRGRDWANQIKERMKDAKKAVVVGGGYIGIEAAEAFAKADIDTTIVDVADRILNTYLDKEFTDILETNAQQHGLHFKGGETVKSISGNQNGEVTTVVTDKNEYDADTVLFAVGVEPATEWLKDKIDLGKKGIININHQQQTSAKDVYAGGDATLVPFAPVSEDRYIALATNSRRQGVVAAKNMLGKEMTMPRVSGTSGLQLFDYKFGQTGIHGTEIDNYDGNLGQTYVEELIRPQFMQDDTKIHMKIIYDKDTHRILGGQVMSKEDITASINTISVVISAGFTLEQLAVQDFFFQPDYDRPWHYLNVLAQQALGDTFGSDKMLF

SEQ ID NO: 18361 - protein, 496 aa, Staphylococcus epidermidis ATCC 12228
MELVDKLSNRQYIDGEWVESSNKNTRDIINPYNQETIFTVAEGTKEDVERAILAARRSFEDGEWSLETSEVRGKKVRAVADKIKENREELAKLETLDTGKTLEESYADMDDIHNVFMYFAGLADKDGGEIINSPIPNAESKVVKEPVGVVTQITPWNYPLLQASWKIAPALATGCSLVMKPSEITPLTTIRVFELMEEVGFPKGTINLVLGAGSEVGDVMSGHEEVDLVSFTGGIETGKHIMKQAANHVTDVALELGGKNPNIIFDDADFELAVDQALNAGYFHAGQVCSAGSRILVHNDIKDKFEKALIDRVSKIKLGNGFDQDTEMGPVISTAHRDKIEGYMEVAKKDGATIAIGGKRPEREDLQAGLFFEPTVITDCDTSMRIVQEEVFGPVVTVEGFADEEEAIRLANDSIYGLAGAIFTKDIGKAQRVANKLKLGTVWINDFHPYFAQAPWGGYKQSGVGRELGKEGLEEYLVSKHILTNTNPEPVDWFSK

SEQ ID NO: 18362 - protein, 158 aa, Staphylococcus epidermidis ATCC 12228
MSIYDIAVENYDGSTYLLKRYKGKVLIIVNTATNCTLNDQFNKLEMLYKKYHKYGLEILSFPCNDFNNQEPELIKDIYRVYKYKFGITFPIHAKINVNGEHEHPLYTLLKCKQPGLFGSQIKWNFTKFVVDQQGNIVKRFLPCDNPNQMEKLIRQLLK

SEQ ID NO: 18363 - protein, 449 aa, Staphylococcus epidermidis ATCC 12228
MLMKQYDVVFLGSGHAAWHAALTLKQSGKQVAIVEKDTIAGTCTNYGCNAKIFLEGPYEVLEEAKQYPNIIDSHNLEVNWKNLMHYKEQVINPMSETLTSMFEQQGIDVIMGKGKLVDAHTIEVNNTTLQSDYIVIATGQHSHQLDIEGKEYTHDSREFLSMQSLPDSITFIGAGIISIEFASIMIKSGVEVNVVHHTNQALEGFNESHVNKLIQKLKDEGVKFYFSENTKSVKPNAQRFIVETESGKMIETDYVLDATGRKPNVQQIGLEKVGILFSDRGIEVDDYLRTNVKNIYASGDVINKMIPKLTPTATFESNYIAAHILGLNTDAIQYPPIPSVLYSLPRLSQIGVTVSEAKKDDTYMIKDIPFGRQMVFEYQNETEAEMSIVLDSHKRLVGAEIYGNDAGDLVNLLVFIINQKLTAQDLNKNIFAFPGASSGVIDLLKLAMM

SEQ ID NO: 18364 - protein, 310 aa, Staphylococcus epidermidis ATCC 12228
MAQKPVDYVTQIIGNTPVVKLRNVVDDDAADIYVKLEYQNPGGSVKDRIALAMIEKAEREGKIKPGDTIVEPTSGNTGIGLAFVCAAKGYKAVFTMPETMSQERRNLLKAYGAELVLTPGSEAMKGAIKKAKELKEEHGYFEPQQFENPANPEIHELTTGPELVEQFEGRQIDAFLAGVGTGGTLSGVGKVLKKEYPNVEIVAIEPEASPVLSGGEPGPHKLQGLGAGFVPDTLNTEVYDSIIKVGNDTAMDMARRVAREEGILAGISSGAAIYAAIQKAKELGKGKTVVTVLPSNGERYLSTPLYSFDN

SEQ ID NO: 18365 - protein, 179 aa, Staphylococcus epidermidis ATCC 12228
MHKDLKNVLLSEEDIQNICKEMGAIITEDYKDRPLVCVGILKGSVMFMADLIKRIDTHLSIDFMDVSSYHGGTESTGEVQILKDLGASIENKDVLIIEDILETGTTLKSITELLQSRKVNSLEIATLLDKPNRRKADIEAKYVGKKIPDEFVVGYGLDYRELYRNLPYIGTLKAEVYSK

SEQ ID NO: 18366 - protein, 487 aa, Staphylococcus epidermidis ATCC 12228
MGEFKGFMKYDKQSLSELSLVDRLSNHEAFQQRFTKEDASIQGARCMDCGTPFCQTGQSYGRETIGCPIGNYIPEWNDLVYHQDFKAAYERLRETNNFPEFTGRVCPAPCEQSCVMKINRESVAIKGIERTIIDEAYENEWVHPAYPEDHKDQRVAIVGSGPAGLTAAEELNFKGYKVTVYEKAHEPGGLLMYGIPNMKLDKDVIRRRVSLMKDAGVLFKTGVEIGVDVSRETLEENYDAIILCTGAQNARDLPLEGRMGSGIHFAMDYLTEQTQYLNGEIESLSITAKDKNVIIIGAGDTGADCVATALRENCKSIVQFNKYTKQPEEITFESNTSWPLAMPVFKMDYAHKEYEAKFGQEPRAYGVQTMRYDVDELGNVKGLYTQILKETPDGMVMEDGPERFWPADLVLLSIGFVGTETTVPHAFDIHTERNKIVANDTNYQTNHAKIFAAGDARRGQSLVVWAIKEGREVAHSVDQYLSKEVLV

SEQ ID NO: 18367 - protein, 341 aa, Staphylococcus epidermidis ATCC 12228
MIEFKNVNKVFRKKRETIQALKNVSFKIDQHDIFGVIGYSGAGKSTLVRLVNQLETVSDGQVIVDGHEIDTYKEKDLRDIKKDIGMIFQHFNLLNSKSVYKNVAMPLILSKTNKKEIKEKVDEMLEFVGLADKKDQFPDELSGGQKQRVAIARALVTHPKILLCDEATSALDPATTSSILNLLSNVNRTFGVTIMMITHEMSVIQKICHRVAVMENGEVIEMGTVKDVFSHPQTNTAKNFVSTVINTEPSKELRASFNSRKDSNFTDYKLFLDSEQIQLPILNELINEHHLNVNVLFSSMSEIQDETVCYLWLRFEHDESFNDFKLTDYLSKRHIRYEEVI

SEQ ID NO: 18368 - protein, 302 aa, Staphylococcus epidermidis ATCC 12228
MIAYDLIGQTPLVLLESFSDENVKIYAKLEQFNPGGSIKDRLGKYLIEKAIDEGRLKEGDTIVEATAGNTGIGLAIASNRHKVKCIIFAPEGFAEEKISIMKALGADVRRTPKAEGMTGAQQEALAYATRYGYLYMNQFETKDNPGAYTQTLAKQLTDELSHIDYFVAGVGSGGTFTGVAQHLKTYDVKNYIVEPEGSVLNGGVSHPHATEGIGSEKWPSFLEKELVDGIFTVADKDAFNNVKLVANKEGLLVGSSSGAALQGALELKKSIQNGVIVTIFPDGSDRYMSKQIFNYKESFNNE

SEQ ID NO: 18369 - protein, 488 aa, Staphylococcus epidermidis ATCC 12228
MWENKFAKESLTFDDVLLIPAASDVLPSDVDLSVKLSDKIKLNIPVISAGMDTVTESKMAIAMARQGGLGVIHKNMGVEEQADEVQKVKRSENGVISNPFFLTPEESVYEAEALMGKYRISGVPIVDNQEDRKLIGILTNRDLRFIEDFSIKISDVMTKDNLITAPVGTTLDEAEAILQKHKIEKLPLVENGRLEGLITIKDIEKVLEFPYAAKDEHGRLLAAAAIGTSKDTEIRAQKLVEAGVDALIIDTAHGHSKGVINQVKHIKETYPEITVVAGNVATAEATRALFEAGADVVKVGIGPGSICTTRVVAGVGVPQITAVYDCATEARKHGKAIIADGGIKFSGDIIKALAAGGHAVMLGSLLAGTEESPGATEVFQGRQYKVYRGMGSLGAMEKGSNDRYFQEDKTPRKFVPEGIEGRTAYKGPLQDTIYQLMGGVRAGMGYTGSENLKKLREEAQFTRMGPAGLAESHPHNVQITKESPNYSF

SEQ ID NO: 18370 - protein, 196 aa, Staphylococcus epidermidis ATCC 12228
MEIYLVRHGESQSNYDNKHGYLYFCGQLDVPLTERGIKSAKELSVYFKNKYIDNIYLSDLKRTRQTYEELFPYDIPTIYTKTLRERSLGVFEGENKEEVCKDKRFEKYFRDPNYKYFRHSFSQKAPQGESYQDVYDRVVTFIENELNQQQKRVVIVAHQVVIRCFFVYFKMITKEEALATEIHNCYPYLIKKEMKF

SEQ ID NO: 18371 - protein, 488 aa, Photorhabdus luminescens
MTIINHWINGKNVSSKTYFETTNPATGEVLAEVAAGGQEEIDQAVAAAKEAFPKWADLPMKERARLMRRLGELIDENVPEIAAMETKDTGLPIHQTQNVLIPRASHNFNFFAEICQQMNGHTYPVDDKMLNYTLVQPVGVCALISPWNVPFMTATWKVAPCLALGNTAVLKMSELSPLTANRLGELALEAGIPAGVLNVVQGYGATAGDALVKHHDVRAVSFTGGTVTGRQIMKNAGLKKYSMELGGKSPVLIFEDADIERALDASLFTIFSINGERCTAGSRIFIQQSIYPEFIKRFAERANRLRVGDPQDPNTQIGALISKPHWEKVSGYIRLGIEEGATLLAGGPDKPIDLPAHLKEGNFLRPTVLADVDNRMRVAQEEIFGPVACLLPFKDEAEGLRLANDVEYGLASYIWTQDVSKVLRLARNIEAGMVFVNTQNVRDLRQPFGGVKASGTGREGGEYSFEVFAEMKNVCISMGDHHIPRWGI

SEQ ID NO: 18372 - protein, 490 aa, Photorhabdus luminescens
MTNDVNTELLRQQAYINGQWVDADNQATFKVTNPANGQVIAHVSNMGAAETERAIAAAQQALPAWRAMTAKQRSQILQRWFQLMMANQQALAELLSREQGKSQAEAMGEIAYGASFIEWFAEEGKRTYGETIPSPMPGRRIVTIKQPIGVVAAITPWNFPNAMITRKVGPALAAGCTVILKPASETPLSALALAALAEQAGIPAGVFNVVTGVDAKTIGGVLTQSPIVRKLSFTGSTRIGKLLMAQSADTVKKLSLELGGNAPFIVFDDANIDAAVQGALIAKFRNSGQTCVCANRILVQETIYDAFAERLAQAVNKLQVGPASDAKSQQGPLINQAAVDKVEEHINDAVSRGARILAGGKPHALGGLFFEPTVLADVNESMLISQEETFGPVAPLFKFRDEAEAIHLANDTEFGLAAYFYSRDIGRIYRVAEALESGMVGINEGLISNEVAPFGGIKQSGLGREGSRYGIEDYLEVKYLCFGGIEDTGV

SEQ ID NO: 18373 - protein, 387 aa, Photorhabdus luminescens
MSVIKMTDLDLAGKRVLIRADLNVPVKDGKVTSDARIRASLPTIEAALKQGAKVMITSHLGRPIEGEYNEEFSLKPVVDYLKEKLSSSVRLEKEYLEGVEVSEGELVVLENVRFNKGEKKDDESLAKKYASLCDIYVMDAFGTAHRAQASTHGVAKFAPVACAGPLLFGELEALGKALDNPARPMVAIVGGSKVSTKLTVLDTLSKIADQLIVGGGIANTFVAAEGHNVGRSLYEDDLIPEAKKLLISCDIPVPTDVRVATEFSETAEATLKSSSDIKDDEQILDLGDESAQRLADILKNAKTILWNGPVGVFEFPNFRQGTEIVARAIADSDAFSIAGGGDTLAAIDLFGIADKISYISTGGGAFLEFVEGKKLPAVVMLEERAKQ

SEQ ID NO: 18374 - protein, 213 aa, Oryza sativa (japonica cultivar-group)
MGAGALGVVAMVAAAVVVAMAGANSEGDALSALRRSSGTPAGVLQSWDPTLVNPCTWFHVTCDRDNRVTRLDLGNLNLSGHLVPELGKLDHLQYLELYKNNIQGTIPSELGNLKNLISLDLYKNNISGTIPPTLGKLTSLVFLRLNGNRLTGPIPRELAGISSLKVVDVSSNDLCGTIPTSGPFEHIPLSNFEKNPRLEGPELQGLAVYDTNC

SEQ ID NO: 18375 - protein, 388 aa, Mycobacterium avium
MAVHNLKDLLAEGVSGRGVLVRSDLNVPLDSDGEQGRITDPGPDHRVGADVERTGRGGRQGGGRRAPRASQEWAGPGVVAGPGGRRARRAAGPARAAGLGRGGHRRPGPRRGVDRRRRPAAGKHPVRRPRNVQGRRRAARAGRQMAELVGPTGAFVSDGFGVVHRKQASVYDVATLLPHYAGTLVAEEIAVLEQLTGSTKRPYAVVLGGSKVSDKLGVIESLATKADSIVIGGGMCFTFLAAQGFSVGKSLVETEMVDTCRRLLDTYVDVLRLPVDMVAADRLAADAAPQTVPADAIPDDLMGVDIGPGSVKRFTALLSNAETMFWNGPMGVFEFPAFAAGTKGLAEAIAAATGKGAFSVVGGGDSAAATAVELQLLFPLVRLIARLA

SEQ ID NO: 18376 - protein, 321 aa, Pseudomonas aeruginosa
MALNPDIAAYLELVGNGRSSGKSLPMHQLTVQQAREQFDQSSALMDPGLDEPLPRVETLFVPARDGTPLPARLYSPQGLSASPPLPGVLYLHGGGYVVGSLDSHDALCASLAERAGCVVLSLAYRLAPEWRFPTAAEDAEDAWCWLAAEAARLGIDPQRLAVAGDSVGGSLCAVLSHRLALRGDASQPRLQVLIYPVTDASRTRQSIERYAVGHLLERDSLEWFYQHYQRSPEDRQDPRFSPLLGVVPADLAPTLLLVAECDPLHDEGIAYAEHLRQGGARVELCVYPGMTHDFLRMGAIVDEADEAKDMIADALVAALAP

SEQ ID NO: 18377 - protein, 502 aa, Aspergillus fumigatus
MPTLGGLLKKRRTKDSHTLSKELESSSSPAAAQTQTSPNSADHDHHYQHYDQTHHHQHSASSNPSNNSATPSAAQPHRSSNDNPNRSSGTDQKSEGQTASMQFAVTQPHPSTHHNPRLHHLQQQQQQQQQQQQQQQQQQPQQQSHTSRLHNILHPSHHASSQASTEGHAHSQQANQTEARTTKGKYSLDDFTIQRTLGTGSFGRVHLVQSKHNHRFYAIKVLKKAQVVKMKQVEHTNDERRMLNRVRHPFLITLWGTWQDARNLYMVMDFVEGGELFSLLRKSQRFPNPVAKFYAAEVTLALEYLHSQQIIYRDLKPENLLLDRHGHLKITDFGFAKEVPDITWTLCGTPDYLAPEVVSSKGYNKSVDWWSLGILIFEMLCGFTPFWDSGSPVKIYENILRGRVKYPPYLHPDAVDLLSQLITADLTKRLGNLHGGSEDVKNHPWFAEVTWDRLARKDIDAPYVPPIRGGQGDASQYDRYPEETEQYGQQGEDVHGHLFPDF

SEQ ID NO: 18378 - protein, 411 aa, Solenostemon scutellarioides
MELQNSAQEMEAPTTITIKGILGLLMANTDAKENGKRVISLGIGDPTAYSCFHASNAAQEGVVECLRSAKFNGYAPTAGLPQTRQAIAEYLSRDLPYKLPAESVYVTAGCTQAIEIALSVLARPGANILLPRPCFPIYGLCASFRNIEVRYFDLHPEKGWEVDLQAVEDLADHNTVAMVIINPGNPCGNVYSYQHLKKVAETAKRLGIVVIADEVYGHLAFGANPFVPMGNFGSIAPVVTLGSLSKRWLVPGWRLGWLVINDPDGTLMSPKFVERIKKYCDICGGPATFIQAAVPEIVEQTQEVFFRKTINILRQTSDICCQKIEEIDGITCPTKPKGAMAFMVKLNISRMKDISDDIDFCFKLAKEESVIILPGIAVGLNNWLRITFAVEPSALEEAMERLKSFCIRHSY

SEQ ID NO: 18379 - protein, 239 aa, Helianthus annuus
QYGRETRHTGDYENPIHSTGGQYEQEVPQTDEYGNPVRRTDEYGNPVHSTTGGTMGDYGSTGLGQGTGTGGIGTGGYGTTGHHGLGTGVGHTTGGTGTDYTSGGRSTGQTGYQGLGTEPEFGGKTGTFQNQPSATPVGGVGLSSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 18380 - protein, 244 aa, Helianthus debilis
ANYGGDKQYGRETRQTGDYENPIHSTGGQYEQDVRQTDEYGNPVRRTDEYGNPVHSTTGGTMGDYGSTGLGRGTGGIGTGGYGTTGHQGLGTGVGHTTGGTGTDYTSGGRSTGQTGYQGLGTESEFGGTTGTFQNQPSATPIGGTGLGGGTGAGFGGTGTGTGTGILHRSGSSSSSSSEDDGQGGRRKKKGVMQKIKEKLPGGHSQEGQYRSQTTTTAGGAGYGETHEKKGMMEKIKEKLPGHH

SEQ ID NO: 18381 - protein, 246 aa, Helianthus debilis
ANYGGDKQYGRETRQTGDYENPIHSTGGQYEQDVRQTDEYGNPVRRTDEYGNPVHSTTGGTMGDYGSTGLGRGTGGIGTGGYGTTGHQGLGTGVGHTTGGTGTDYTSGGRSTGQTGYQGLGTESEFGGTTGTFQNQPSATPIGGTGLGGGTGAGFGGTGTGTGTGILHRSGSSSSSSSEDDGQGGRRKKKGVMQKIKEKLPGGHSQEGQYQSQTTTTTTAGGAGYGETHEKKGMMEKIKEKLPGHH

SEQ ID NO: 18382 - protein, 242 aa, Helianthus debilis
ANYGGDKQYGRETRQTGDYDNPIHSTGGQYEHDVHQTDEYGNPVRRTDEYGNPVHSTTGGTMGDYGSTGLGRGTGGIGTGGYGTTGHQGLGTGIGHTTGGTGTDYTSGGRSTGQTGYQGLGTESEFGGIQNQPSATPIGGTGLGGGTGAGFGGTGTGTGTGILHRSGSSSSSSSEDDGQGGRGKKKGVMQKIKEKLPGGHSQEGQYQSQTTTTTTAGGAGYCETHEKKGMMEKIKEKLPGHH

SEQ ID NO: 18383 - protein, 240 aa, Helianthus hirsutus
ANYGGDKQYGRETRHTGDYENPIHSTGGQYDQDVRQTDEYGNPVRRTDEYGNPVHTATGGTMGDYGSTGLGQGTGGIGTGGYGATGHQGLGTGVGHTTGTGTDYTSGGRSTGQTGYQGLGTESEFGGTTGTFQNQPSATPIGGTGLSSGTGAGLGGTGTGTGTGILHRSGSGSSSSSEDDGQGGRRKKKGVMQKIKEKLPGGHSQEEQYQSQTTTTTGYGETHEKKGMMEKIKEKLPGHH

SEQ ID NO: 18384 - protein, 241 aa, Helianthus mollis
ANYGGDKQYGRETRHTGDYENPIHSTGGQYEQDVRQTDEYGNPVRRTDEYGNPVHSATGGTMGDYGSTGLGQGTGGIGTGGYGTTGHQGLGTGVGHTTGGTGTDYTSGGHSTGQTGYQGLGTESGFGGTTGTFQNQPSATPMGGTGLGSGTGAGFGGTGTGTGTGILHRSGSGSSSSSEDDRQGGRRKKKGVMQKIKEKLPGGHSQEEQYQSQTTTTTGYGETHEKKGMMEKIKEKLPGHH

SEQ ID NO: 18385 - protein, 246 aa, Helianthus niveus
ANYGGDKQYGRETRQTGDYENPIHSTGGQYEQDVRQTDEYGNPVRRTDEYGNPVHSTTGGTMGDYGSTGLGQGTGGIGTGGYGTTGHQGLGTGVGHTTGGTGTDYTSGGRFTGQTGYQGLGTESEFGGTTGTFQNQPSATPMGGTGLGSGTGAGFGGTGTGTGTGILHRSGSSSSSSSEDDGQGGRRKKKGVMQKIKEKLPGGHSQEGQYQSQTTTTTTAGGAGYGETHEKKGMMEKIKEKLPGHH

SEQ ID NO: 18386 - protein, 240 aa, Helianthus tuberosus
ANYGGDKQYGRETRHTGDYENPIHSTGGQYDQDVRQTDEYGNPVRRTDEYGNPVHTATGGTMGDYGSTGLGQGTGGIGTGGYGTTGHQGLGTGVGHTTGTGTDYTPGGRSTGQTGYQGLGTESEFGGTTGTFQNQPSATPIGGTGLSSGTGAGFGGTGTGTGTGILHRSGSGSSSSSEDDGQGGRRKKKGVMQKIKEKLPGGHSQEEQYQSQTTTTTGYGETHEKKGMMEKIKEKLPGHH

SEQ ID NO: 18387 - protein, 228 aa, Helianthus maximiliani
ANYGGDKQYGRETRHTGDYENPIHSTGGQYEQDVRQTDEYGNPVRRTDEYGNPVHSATGGTMGDYGSTGLGQGTGGIGTGGYGTTGGTGTDYTSGGHSTGQTGYQGLGTESGFGGTTGTFQNQPSATPMGGTGLGSGTGAGFGGTGTGTGTGILHRSGSGSPSSSEDDRQGGRRKKKGVMQKIKEKLPGGRSQEEQYQSQTTTTTGYGETHEKKGMMEKIKEKLPGHH

SEQ ID NO: 18388 - protein, 246 aa, Helianthus neglectus
ANYGGDKQYGRETRQTGDYENPIHSTGGQYEQDVRQTDEYGNSVRRTDEYGNPVHSTTGGTMGDYGSTGLGRGTGGIGTGGYGTTGHQGLGTGIGHTTGGTGTDYTSGGRSTGQTGYQGLGTESEFGGTTGTFQNQPSATPIGGTGLGGGTGAGFGGTGTGTRTGILHRSGSSSSSSSEDDGQGGRRKKKGVMQKIKEKLPGGHSQEGQYQSQTTTTTTAGGAGYGETHEKKGMMEKIKEKLPGHH

SEQ ID NO: 18389 - protein, 237 aa, Helianthus petiolaris
ANYGGDKQYGRETRHTDEYGNPIHSTGGHQTDEYGNPVRRTDEYGNPVHSTTGGTMGDYGSTGLGQGTGGIGTGGYGTSGYQGLGTGLGHTTGGTGTDYASGGRSTGQTGYQGLGTESEFGGTTGTFQNQPSATPMGGTGLGGGTGAGFGGTGTGTGTGTGILHRSGSSSSSSSEDDGQGGRRKKKGVMQKTKEKLPGGHSQEGQYQSQTTTTTTAGGTHEKKGMMEKIKEKLPGHH

SEQ ID NO: 18390 - protein, 240 aa, Helianthus petiolaris
ANYGGDKQYGRETRHTDEYGNPIHSTGGHQTDEYGNPVRRTDEYGNPVHSTTGGTMGDYGSTGLGQGTGGIGTGGYGTSGHQGLGTGVGHTTGGTGTDYASGGRSTGQTGYQGLGTESEFGGTTGTFQNQPSATPMGGTGLGGGTGAGFGGTGSGTGTGILHRSGSSSSSSSEDDGQGGRRKKKGVMQKIKEKLPGGHSQEGQYQSQTTTTTTAGGAGYGETHEKKGMMEKIKEKLPGHH

SEQ ID NO: 18391 - protein, 246 aa, Helianthus praecox
ANYGGDKQYGRETRQTGDYDNPIHSTGGQYEQDVRQTDEYGNPVRRTDEYANPVHSTTGGTMGDYGSTGLGRGTGGIGTGGYGTTGHQGLGTGVGHTTGGTETDYISGGRSTGQTGYQGLGTESEFGGTTGTFQNQPSATPIGGTGLGGGTGAGFGGTGTGTGTGILHRSGSSSSSSSEDDGQGGRRKKKGVMQKIKEKLPGGHSQEGQYQSQTTTTTTAGGAGYGETHEKKGMMEKIKEKLPGHH

SEQ ID NO: 18392 - protein, 236 aa, Helianthus annuus
ANYGGDKQYGRETRHTGDYENPIHSTGGQYEQEVLQTDEYGNPVRRTGQTDEYGNPVRRTDEYGNPVHSTAGGTMGDYGSTGLGQGTGGIGTGGYGTTGHHGLGTGIGHTTGGTGTDYTSGGRSTGQTGYQGLGTESEFRGKTGTGVGGTGTGTGILHRSGSSGSSSSEDDGQGGRRKKKGVMQKIKEKLPGGHRQEEQYQSQTTTTTTGGGAGYGETHEKKGMMEKIKEKLPGHH

SEQ ID NO: 18393 - protein, 469 aa, Medicago truncatula
MASTRRVQCLMRRFYRGSRTFGVATQPNASSSSQTIIDKEFQHSAHNYHPLPIVFAHAKGSAVWDPEGNKYIDFLSGYSAVNQGHCHPKILKALKNQAGRLTVSSRAFYNDRFPVFAEYSTALFGYDMVLPINTGAEGVETALKLARKWGYDKKKIPNDEALIVSCCGCFNGRTLGVISMSCDNEATRGFGPLIPGHLKVDFGDAEALEKILKEKGDAIAAFILEPIQGEAGVKIPPDGYLKAVRDLCSKYNVLMIADEIQTGLARTGKMLACEWEEVRPDVVVLGKALGGGIIPVSAVLADKEVMLCIKPGQHGSTFGGNPLASAVAIASLEVIKEERLAERSTKLGGELLGLLEKIQKQYPDHVKEVRGRGLFIGVELNSESLSPVSFFELSEKLKDRGVLAKSTHDTIIRFTPPLCISADEIQQGSKALADVLEIDLPMLKKMKPKDAAPPAGPSACDRCGRVVYG

SEQ ID NO: 18394 - protein, 213 aa, Nicotiana tabacum
  misc_feature (76)..(76): Xaa can be any naturally occurring amino acid
CVFLETRRGGPGPLSTCILLSVLTRGDGAVGKTCMLICYTSNKFPTDYIPTVFDNFSANVAVDGSIVNLGLWDTAXQEDYSRLRPLSYRGADIFVLAFSLISRASYENVLKKWMPELRRFAPNVPIVLVGTKLDLREDNRYLADHMGSNIITPDMGEELRKQIGAAAYIECSSKTQQNVKAVFDTAIKVVLQPPRRKEVPRKKRRRSTGCSIV

SEQ ID NO: 18395 - protein, 102 aa, Posidonia oceanica
ISGGHINPAVTFGLFLARKLSMTRALFYMVMQCLGAICGAGVVKGFVNKDNFAMWKGGANVVSHGYTKGGGLGAEIVGTFLLVYTVFSATDAKRNARDSHVP

SEQ ID NO: 18396 - protein, 142 aa, Posidonia oceanica
ISGGHLNPAVTFGAFVGGNITFLRGILYWHGQLLGSIVACLLLKFVTGGMTTGGFAVSGVSVWNALVFEIVMTFGLVYTVYATAIDPKKGAIGTIAPLAIGLIVAANIFDGGVFTGASMNPAVAFGPALVSWNWVNQWVYWV

SEQ ID NO: 18397 - protein, 250 aa, Posidonia oceanica
MPFSRIAMGRREEVTHGDALKATLAEFISTLIFVFAGEGSGIAYNNLSGDGDTTASSLIAAALAHGLGLFVAVSVGANISGGHVNPAVTFGAFVGGNITFLRGILYWHGQLLGSIVACLLLKFVTGGMTTGGFAVSGVSVWNALVFEIVMTFGLVYTVYATAIDPKKGAIGTIAPLAIGLIVAANIFVGGVFTGASMNPAVAFGPALVSWNWVNHWIYWVGPLVGAAIAGIVYQLLFINHTHEQLPTTDY

SEQ ID NO: 18398 - protein, 290 aa, Posidonia oceanica
MEGKEEDVKLGANKFSERQPIGTAAQTGDDRDYKEPPPAPLYEPGELISWSFYRAGIAEFMATFLFLYITILTVMGYEKVDNKCKTVGTQGIAWAFGGMIFALVYCTAGISGGHINPAVTFGLFLARKLSMTRALFYMVMQCLGAICGAGVVKGFVNKDNFAMWKGGANVVSHGYTKGDGLGAEIVGTFLLVYTVFSATDAKRNARDSHVPILAPLPIGFAVFLVHLATIPITGTGINPARSFGAAVIYNKQHAWDDHHWVFWVGPFIGAALAAIYHQIVIRAIPFKTGP

SEQ ID NO: 18399 - protein, 2518 aa, Polyangium cellulosum
ILGSDARLASALEAAGAHVTRHRDPGAWIDAIRGGGAPEVVAVLACTTRPDAPSGALAATHGAAADALAALQAWLAEERLASCALVVLTERAVATRPDEDVLDLVHAPVWGLVRAAQVENPDRALILVDVDADDASLPALPALVAAAVARAADASEPQLALREGRRLVPRLGRLGGDDALVPPSAAAYRLHVAAKGTLESLALVPHEEATRPLAEGQIRVAVRAAGLNFRDALDALGMYPGDPGPLGAEGAGVVLEVGPGVTELAPGDRVMGLLSAAFGPIALADHRMVSRIPAGLSFVEAASIPVVFLTAYYGLVDLGRLRPGERVLVHAAAGGVGIAAVQLARHLGAEVFATASPPKWATLRALGLDDDHIASSRSGDFEAHFRRTSGGRGVDVVLDSLARELVDASLRLVALAPDGRFVEMGKSDVRDPLAVAASHPSVAYRAFDLAEAGPERIQAMLAELVALFERGVLRVPPITPCDLRRAPQAFRALAQARLVGKVVLTIPRALDPRGSVLVTGGTGTLGALVARHLVQRHGVRSLVLSSRRGPAAPGADDLRRELEAAGASVAIVACDAGDRLALERLLAGIPADRPLTAVVHAAGTLDDGVLTSLTPERLRSVMSAKVDAAAHLDELTRPLDLSAFVLFASLSGVLGSPGQANYAAANTFLDALAHQRRSRGLPAVSLDWGYWAERTGLTAHLGDTDLQRMARGGLRPLTTDDGLALFDAALAHVDAALVAAPFDPVALRAHAVAPILRGLVRAGAARRKLANNAASAAPLAQRLAGLAPKERERAMIDVVRPEIGVVLGLPPSRHLDGDRPLKELGLDSLMAVELRNRLAAIVGTRLPATLLFDYPTPTALARFLATALVGRGDAAAAPSAARAASAGASDDAIAIVAMACRFPGGVLTPEDLFRLLREGGDAISAFPENRGWDLDALSDGAARQGGFLHDADLFDAEFFGISPRETLALDPQQRLLLEMTWEALERAGIIPASLHGSKSGVFVGVFGSDYVARLLHGPSGAQAMESLRGYIGTGSASSVASGRIAYALGLEGPAISVDTACSSSLVALHLACHAIRRGECSLALAGGVTVMATPGIFGEFSAQHAGAPDGRCKSFSADANGAGWSEGAGIVLLERLSDARKNGHPVLAIVRGSAVNQDGKSQGLTAPNGPAQERVIRDALASAGLAPADVDAVEAHGTGTTLGDPIEARALFATYGAAHAKERPLWLGSLKSNLGHTQAAAGIGGVIKMVLALQSGVLPRTLHAASPSQHIDWSSGAIRLLTEEVPWKPGGSPRRAAVSSFGISGTNAHVVLEEAPRAAAGDDQAAEPARAPLAPPVPVLLSAKSDAALRAQAGKLHAHLAEHEDVALVDVAASLATTRSHFERRAAVVADDRAALLSALAALAEGRAGAGTVAGEALPPGKVAFVFPGQGSQWPSMARALLASSPAFRAEIEACERALAPHVDWSLLAVLGGDEAHAAPMLERVDVVQPVLFAVMIALAATWRAAGVTPDAVVGHSQGEIAAAYVAGALSLEDAARVVALRSRAITKLAGRGAMAAVELTTADLEARLAPFGGRLAIAAINSPHAALVSGDPDAIDELVAELSGAQLFARKVRVDYASHSAHVEAIERTLLEALDGIAPRPATVPLYSAVTGERLDGEALGAAHWYRNLRHTVRFEHATRALLDDGHRFFVEVSPHPVLTVALRDTIDASGHDAVACASLRRDEGDLARFNLSLAELHTRGLAVDWRAFFAPFAPRTVALPTYAFQRERFWLDAPKASGVIPAAASPAEARFWSAVEDGDVATVTDALDVGDDERRAALATLLPTLATWRRARRAQSTIDAWRYRVAWRALTAPPKGDIAGTWLVVAPEVAGALADGVARALEARGARGVLVPVDAEDAARTPLAGRLRAVAGGQAIRGVISFAALDERPAPLEPSVPLGLAVSLGLVQALGDAAIDAPLWLVTRGAVAVGASERVTRPLQAMTWGLGRVVALEHPERWGGLVDLGEESAPDANGARDANVHDRLANLVARRDDEDQLALRAAGTYVRRLVRAPHDGARPPAFAPRGAALVTGGTGALGAHVARWLARIGAEHIVLASRRGAAAPGAAALAEELSALGARVTLAACDVADREAVAALVRDVEAGGATVRAVFHAGGAMHEAPVAAMRVEELADAIAAKARGAQHLHDVFAQRPLDAFVLFSSGAGVWGGGRQGAYAAANAFLDALAEARRADGLAATSIAWGAWAGGGMLATDAERRLKHRGVAPMDPELAVAALAHALDHAETCLAVADVDWARFAPSFASARPRPLLDELAEARSALDALREPPDDARTAAGPEPASTLRTTLAALPEGERHRHLLALVRTETAAVLGHADASRVEPNRGFFDLGLDSLMSVELRRRVQRATGIKLPATLAFDHPTPSALASKVLAAIVLHDATPRASPAAELERLEGMLSAIYADEALRDDLTARLRAFLDKRAVRTERPDDAAFAEKLGSASADELIRLIDQKLGDRIDVDRY

SEQ ID NO: 18400 - protein, 456 aa, Polyangium cellulosum
MISISKSKQKLLPPGPRSPMALQTLQWLKNPVPFLEACGARYGEMFTLKLPTQWPVVVVQHPEAVKEVFALDSNAGHAGEANNILKPFLGKYSLLVLDGEEHMRQRKMMMPAFHGERMEAYGHAMIDAAHASIDAWPVGSPFGVHAPMQAITLQVILRTVVGMTDGPLLAELEALYPQVIDAASAPAMHFELFRKDLGPWSPWGKFKRRSARGKEIMIHEIRRAREKGTAGRTDVLAMIIDAKDENGELLTEDEIHGELMTLLVAGHETTATALCWALRWLLRDAALTRRVAEEAAEVADDPVKIAKSELLDRVVKEALRLQPIGPVVARVLKQPLTIQGRELPADVMVAPCVQLLHHRPSLYPEPTRFDPDRYATFTPKPWEFIPFGGGLRKCIGAAFSMYEMKMVLATAFSRLSMELATDDIKIIRRGVTLAPSGGLPLVIRKKSPRATKPIAA

SEQ ID NO: 18401 - protein, 380 aa, Proteus sp. LE138
MDFRLNDEQELFVDGVRELMASENWEAYFAQCDRESKYPERFVKALADMEIDNLLIPEEHGGLNAGFVTVAAIWMELGRLGAPTYVLYQLPGGFNTVLREGTQEQIDKIMAFRGTGKQMWNSAITEPGAGSDVGSLQTTYTRKNGKVYLNGSKCFITSSAYTPYIVVMSRDAASPDKPIFTEWFVDMSKPGIKVTKLEKLGLRMDSCCEITFDNVELEEKDMFGREGNGFNRVKEEFDHERFLVALTNYGTAMCAFEDAARYANQRVQFGETIGRFQLIQEKFAHMAIKLNSMRNMLYETAWKSDNGLITSGDAAMCKYFCANAAFEVVDSAMQVLGGVGIAGEHRIARFWRDLRVDRVSGGSDEMQILTLGRAVLKQYR

SEQ ID NO: 18402 - protein, 502 aa, Petunia x hybrida
MEIQLSSLVPFLLFLSSIFLLLRKWKTQELNLPPGPWKLPFIGSLHHLVFAGPLPHHGLTNLAKRYGPLMLLQLGEQPTVFISSPQMAKEVLKTHDLAFATRPKLTFAEIIKYGSTDIAFSPYGEYWRQIRKICVMELLSAKMVNSFSSIREDELSNMISWIRLRPNIPVNLTEKVKWFTSSVVCRSALGKICKDQNKLIILMREILSLAISVNFADFFPRWKFLHDLGGSKTRLLKEHHKIDEILQDIVNEHKQNRVNGKMGNGEFGGEDLIDVLLRVRESGQHQLPITDDNIKAVIVDMFSAGTETSSTTIIWALAEMMKKPSVLAKAQAEVRQAMKGKKGFQLIDLDELKYLKLVIKETLRMHPPIPLLIPRECMEETKINGFNIPLKTRVIVNIWAIGRNPESWEDPESFMPERFENNPIDFTGNHHQFIPFGAGRRMCPGMLFGLTNVAQLLAQLLHHFDWKLPNGQSPQDLDMTESPGVSATRKDDLVFVATPYDS

SEQ ID NO: 18403 - protein, 206 aa, Nicotiana tabacum
MSRNWKSGDSAVEQPPAKAPKAEDQPPATKKSVKEKKPRAPREKKPKSAKTVTHPPYFQMIKEALLALNEKGGSSPYAIAKYMEDKHKDELPANFRKILGLQLKNSAAKGKLMKIKASYKLSVAGKKERTTASTKKVPKADTKKKPRSTRSTTATAKKTEVTKKAKPTQKPKKVGAKKIRKSTPAKAKQPKSIKSPAAKRAKKVAA

SEQ ID NO: 18404 - protein, 412 aa, Terrabacter sp. DBF63
MTDPRTVVVVGASVAGVRTAQSLRTEGFGGRIVLVGDEPDLPYDKPPLSKQFLAGCWSVERIALLTAEAAAAVGIELRLGVAAQRLDVAGRQVVLIDGSTIDYDAAVLATGAAARPAPWSATSGVHVLRSMADARALRDDLEVDRPVVIIGGGFIGAEVAATAHALGREVTVVDPLSAPIGRVVGREVGELFVDLHTRHGVTTKFGVGVESVEGEAGDLTVQLTDGSQLAAGTVVVGIGAVPNDGWLAGSGLLVDDGVVCDEHCRAVDAADVYAVGDVLRWFHPGHGEHVRVEHWTNAVESAAVVAHNIAHPEELRSHCPVEYVWSDQYDWKIQIVGRPVGATRHTLVGDLTSAHPRGAAVYTDDSGDLRGAVAVNWPKALLVCRRAVGAGASFDDVVAQLDRLSAAGAAPA

SEQ ID NO: 18405 - protein, 308 aa, Sorghum bicolor
MEINIVDKYEKLEKVGEGTYGKVYKAQDKATGQLVALKKTRLEMDEEGIPPTALREISLLNLLSHSIYVVRLLAVEQAAKNGKPVLYLVFEFLDTDLKKYLDVYRRGPAARPLPATLIKNFLYQLCKGVAHCHGHGVLHRDLKPQNLLVDKDKGILKIADLGLGRAFTVPMKSYTHEIVTLWYRAPEVLLGATHYSTGVDMWSVGCIFAEMARRQALFPGDSELQQLLHIFRLLGTPSEEQWPGVSELRDWHEFPQWKPQSLARVVPTLEPEGVDLLSKMLQLDPSNRISAIAAMEHPYFDSLDKSQF

SEQ ID NO: 18406 - protein, 486 aa, Pseudomonas sp. S-47
MKEIKHFISGAFVGSASGKLFDNVSPANGQVIGRVHEAGRAEVDAAVRAARAALKGPWGKMTVAERAEILHRVADGITARFGEFLEARMPGHRQAEVAGQPHRHSARRANFKVFADLLKNVANEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKPREKVPSYYQQAVDDGATVVTGGGVPEMPAHLAGGAWVQPTIWTGLADDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 18407 - protein, 147 aa, Fritillaria agrestis
TMLSSVATAARAAPAQASMVAPFVGLKSTSSFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 18408 - protein, 147 aa, Fritillaria agrestis
TMLSSVATAARAAPAQASMVAPFVGLKSASAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 18409 - protein, 147 aa, Fritillaria agrestis
TMLSSVATAARTAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMLKLPMFGCTDAAQVVKEAAECKKEY

SEQ ID NO: 18410 - protein, 147 aa, Fritillaria agrestis
TMLSSVATAARTAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 18411 - protein, 147 aa, Fritillaria agrestis
TMLSSVATAARAAPAQASMVAPFVGLKSTSSFPVTQKPATGLSTLPSNGGRVQCMKVWPIVGLKKFETLSYLPTLSVETLLKQIEYLIRNGWVPCLEFSLEGFVSRDNNKSPGYYDGRYWTMWKLPMFGCTDAAQVVKEAAECKKEY

SEQ ID NO: 18412 - protein, 147 aa, Fritillaria agrestis
TMLSSVATAARAAPAQASMVAPFVGLKSTFAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 18413 - protein, 219 aa, Photorhabdus luminescens
MKNKLISTQQAMEHFYDGMTIMAGGFMGVGTPPHLITALLNSGVKDLTIIANDTAGIDVGIGPLVVNNRVKKVITSHIGTNPETGRKMLAGEIEVELVPLGTLIERIRCGGAGLGGFLTPTGVGTVVEEGKQKITVNGTDYLLELPLRADLALIQAHLADYHGNLTYQLSARNFNPVIALAADITLAEPDRLVEVGEITPDCVITPGALIDYIVYPRGN

SEQ ID NO: 18414 - protein, 203 aa, Neisseria gonorrhoeae
MKALLLGAPGAGKGTQAQFITAAFGIPQISTGDMLRAAIKAGTPLGLEAKKIIDEGGLVRDDIIIGMVKERIAQDDCKNGFLFDGFPRTLAQAEAMVEAGVGLDAVIEIDVSDSVIVDRMSGRRVHLASGRTYHVTYNPPKTEGKDDVTGEDLIQRDDDKEETVKKRLAVYHEQTEVLVDFYSKLEGEHAPKYIKVDGTQAVE

SEQ ID NO: 18415 - protein, 451 aa, Neisseria gonorrhoeae
RFVDLRFTDTKGKQHHFTVPARIVLEGPEEWFENGQAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 18416 - protein, 451 aa, Neisseria gonorrhoeae
RFVDLRFTDTKGKQHHFTVPARIVLEGPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 18417 - protein, 451 aa, Neisseria gonorrhoeae
RFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 18418 - protein, 451 aa, Neisseria gonorrhoeae
RFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAAFKADHEFLLRGGVFSKDWIDSYIAFKEEDVRRIRMAPHPLEF

SEQ ID NO: 18419 - protein, 451 aa, Neisseria gonorrhoeae
RFVDLRFTDTKGKQHHFTVPARIVLEDPEEWFENGPAFDGSSIGGWKGIEASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 18420 - protein, 451 aa, Neisseria gonorrhoeae
RFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKVDHEFLLRGGVFSKDWIDSYIAFKEEDVRRIRMAPHPLEF

SEQ ID NO: 18421 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGKLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAIECGIPMPCMASAITFLDGYTTERLPANLLQAQRDYFGAHTYERTDKPRGEFFHTNWTGKGGDTASTTYDI

SEQ ID NO: 18422 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGKLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 18423 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGRLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 18424 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGKLFARTATPVEGGKQEWVEALRQALLASKIISYAQGFMLIREAGESYGWDLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 18425 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGRLFARTATPVEGGKQEWVEALRQALLASKIISYAQGFMLIREAGESYGWDLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 18426 - protein, 318 aa, Neisseria gonorrhoeae
MKHLHDLPAWSKLWNHFDDSKTLHMREMFEQDPQRAERYWLQVGGLTLDYSKNRINDETMSLLFELAREAGVPERMRQMFHGEKINTTENRAVLHVALRNRTNSPIMVDGEDVMPKVNRVLQRMGEFAHEVRSGSWLGYTNQVITDVVNIGIGGSDLGPLTMCTALKPFGHPRLNMHFVSNVDGSQLRDVLSKVHPETTLFIIASKTFTTQETLTNALTAREWFLNHAGDEEAVAKHFAAVSTNRKAVAEFGIDIANMFEFWDWVGGRYSLWSAIGLPIMLYLGEENFIEMLNGAHLMDQHFINTPLERNLPVILALI

SEQ ID NO: 18427 - protein, 182 aa, Escherichia coli
MVRDMKHTVEVMIPEAEIKARIAELGRQITERYKDSGSDMVLVGLLRGSFMFMADLCREVQVSHEVDFMTASSYGSGMSTTRDLKILKDLDEDIRGKDVLIVEDIIDSGNTLSKVREILSLREPKSLAICTLLDKPSRREVNVPVEFIGFSIPDEFVVGYGIDYAQRYRHLPYIGKVILLDE

SEQ ID NO: 18428 - protein, 268 aa, Salmonella typhimurium
MERYENLFAQLNDRREGAFVPFVTLGDPGIEQSLKIIDTLIDAGADALELGVPFSDPLADGPTIQNANLRAFAAGVTPAQCFEMLAIIREKHPTIPIGLLMYANLVFNNGIDAFYARCEQVGVDSVLVADVPVEESAPFRQAALRHNIAPIFICPPNADDDLLRQVASYGRGYTYLLSRSGVTGAENRGALPLHHLIEKLKEYHAAPALQGFGISSPEQVSAAVRAGAAGAISGSAIVKIIEKNLASPKQMLAELRSFVSAMKAASRA

SEQ ID NO: 18429 - protein, 511 aa, Geobacillus stearothermophilus
MSKKPVALIILDGFALRDETYGNAVAQANKPNFDRYWNEYPHTTLKACGEAVGLPEGQMGNAEVGHLNIGAGRIVYQSLTRINIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVAGYVAFKPTNLDNTIGEVLSQHGLRQLRIAETEKYPHVTFFMSGGREEEFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 18430 - protein, 473 aa, Methylobacillus sp. 12S
MKIVPVILSGGSGTRLWPLSRQALPKQLLPLTSGHSMLQETLLRLSGVESIESPIVVCGNDHRFLVAEQLLEIGSKPKAIVLEPVGRNTAPAIAVAASRLLQENAEDVLMLVLPADHVIQNRAAFSAAIAVAAQAAKSGRLVTFGIKPTVPETGYGYINGGAALASCPGSFELSRFVEKPNLETAKQYLASGDYYWNSGMFLFSPKQYMEELTQFAPEIASKASEALEQSYTDLDFVRLHEASFKECPSQSVDYAVMEHTRNAAVVPVDIGWSDVGSWTALADVLDKDDAGNVTVGDVYLNGVKNSMVRSEGRMVAALGVENLIIVETSDAVLVAHKDAAQDVKKIVDYLKEQGRKEHEYHSRVYRPWGWYEGIDAAERFQVKRIMVKPGEKLSLQMHHHRAEHWVVVSGTAIVTKNGEAEMLCENQSTYIPIGATHRLENPGKLPLHLIEVQSGGYLGEDDIVRFEDTYGRS

SEQ ID NO: 18431 - protein, 242 aa, Bacillus subtilis
ALKILTRINGETVAKEELKNIENSLKIEQMGSLSQLFKPGLRKALVIGILLALFNQVIGMNAITYYGPEIFKMMGFGQNAGFVTTCIVGVVEVIFTVIAVLLIDKVGRKKLMSIGSAFMAIFMILIGTSFYFELTSGIMMIVLILGFVAAFCVSVGPITWIMISEIFPNHLRARAAGIATIFLWGANWAIGQFVPMMIDSFGLAYTFWIFAVINILCFLFVVTICPETKNKSLEEIEKLWIK

SEQ ID NO: 18432 - protein, 439 aa, Musa acuminata
MVNCAESCVPLSEVATSNTHGEDSPYFAGWKAYDEDPYDAASNPAGVIQMGLAENQVSFDLLEKYLDQHPGASGWGCGISGFRENALFQDYHGLQTFRQAIATFMEQIREGRAKFDPERIVLTAATAANELLTFILADPGDCLLIPTPYYPGFDRDLRWRTGVRIIPVHCSSSNGFQVTLQALEDAYVKAEGMKIRVRGLLLTNPSNPLGTAIARHVLEEVLDFVTQKDIHLISDEIYSGSVFSSDEFVSVAEIVEARGYKDCGRVHIVYSLSKDLGLPGFRVGAIYSYNDRMVTAARRMSSFTLVSSQTQRMLASMLADRGFTENYLKTNRERLKNRRDFITEGLKNAGIECLPGNAGLFCWMNLAPLLEEPTREGELRLWSLIVHEAKLNISPGSSCHCSEAGWFRVCFANMSQQTLEVALRRIKDFMKNMKAKQEK

SEQ ID NO: 18433 - protein, 475 aa, Picea abies
MSPKTETKASVGFKAGVKDYRLTYYTPEYQTKDTDILAAFRVTPQPGVPPEEAGAAVAAESSTGTWTTVWTDGLTSLDRYKGRCYDIEPVAGEESQFIAFVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHGGTVVGKLEGEREITLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREASKWSPELAAACEIWKEIKFEFEAVDTI

SEQ ID NO: 18434 - protein, 4735 aa, Amycolatopsis mediterranei
MRTDLIKPLHVALLENATRFAGKPAFADDHRTVTYGDLEARTRRLAGHLAGLGVRHGDRVAICLGNRVSTVESYFAILRAGAVGVPLNPGSATAELEHPLTDSGATVVVTDAAQAARLRLAPHVELLVTGDDVPEGAHSYDELALSEPAEPAADDLELDEPAWMFYTSGTTGRPKGVVSTQRNCLWSVASCYVPFPGLSDQDRVLWPLPLFHSLSHIACVLSATVVGASVRIADGSSADDVMRLIEAESSTFLAGVPTTYHHLVRAARQRGFSAPSLRIGLAGGAVLGAGLRSEFEETFGVPLIDAYGSTETCGAITMNPPDGARVEGSCGLAVPGVDVRVVDPDTGLDVPAGEEGEVWVSGPNVMLGYHNSPEATAAAMRDGWFRTGDLARRDDAGYFTICGRIKELIIRGGANIHPGEVEAVLRTVDGVADAAVGGVPHDTLGEVPVAYVIPGPTGFDPAALIEKCREQLSAYKVPDRILEVAHIPRTASGKIRRGLLTDEPAQLRYAATEHEEQSRHADESVAAALRARLSGLDERAQCELLEDLVRTQAADVLGQPVPDGRAFRDLGFTSLAIVELRNRLTEHTGLWLPASAVFDHPTPAALAARVRAELLGITQAVAEPVVAADPGEPIAIVGMACRLPGGVASPEDLWRLVAERVDAVSEFPGDRGWDLDSLIDPDRERAGTSYVGQGGFLHDAGEFDAGFFGISPREAVAMDPQQRLLLETSWEALENAGVDPIALKGTDTGVFSGLMGQGYGSGAVAPELEGFVTTGVASSVASGRVSYVLGLEGPAVTVDTACSSSLVAMHLAAQALRQGECSMALAGGVTVMATPGSFVEFSRQRALAPDGRCKAFAAAADGTGWSEGVGVVVLERLSVARERGHRILAVLRGSAVNQDGASNGLTAPNGLSQQRVIRRALAAAGLAPSDVDVVEAHGTGTTLGDPIEAQALLATYGQERKQPLWLGSLKSNIGHAQAAAGVAGVIKMVQALRHETLPPTLHVDKPTLEVDWSAGAIELLTEARAWPRNGRPRRAGVSSFGVSGTNAHLILEEAPAEEPVAAPELPVVPLVVSARSTESLSGQAERLASLLEGDVSLTEVAGALVSRRAVLDERAVVVAGSREEAVTGLRALNTAGSGTPGKVVWVFPGQGTQWAGMGRELLAESPVFAERIAECAAALAPWIDWSLVDVLRGEGDLGRVDVLQPACFAVMVGLAAVWESVGVRPDAVVGHSQGEIAAACVSGALSLEDAAKVVALRSQAIAAELSGRGGMASVALGEDDVVSRLVDGVEVAAVNGPSSVVIAGDAHALDATLEILSGEGIRVRRVAVDYASHTRHVEDIRDTLAETLAGISAQAPAVPFYSTVTSEWVRDAGVLDGGYWYRNLRNQVRFGAAATALLEQGHTVFVEVSAHPVTVQPLSELTGDAIGTLRREDGGLRRLLASMGELFVRGIDVDWTAMVPAAGWVDLPTYAFEHRHYWLEPAEPASAGDPLLGTVVSTPGSDRLTAVAQWSRRAQPWAVDGLVPNAALVEAAIRLGDLAGTPVVGELVVDAPVVLPRRGSREVQLIVGEPGEQRRRPIEVFSREADEPWTRHAHGTLAPAAAAVPEPAAAGDATDVTVAGLRDADRYGIHPALLDAAVRTVVGDDLLPSVWTGVSLLASGATAVTVTPTATGLRLTDPAGQPVLTVESVRGTPFVAEQGTTDALFRVDWPEIPLPTAETADFLPYEATSAEATLSALQAWLADPAETRLAVVTGDCTEPGAAAIWGLVRSAQSEHPGRIVLADLDDPAVLPAVVASGEPQVRVRNGVASVPRLTRVTPRQDARPLDPEGTVLITGGTGTLGALTARHLVTAHGVRHLVLVSRRGEAPELQEELTALGASVAIAACDVADRAQLEAVLRAIPAEHPLTAVIHTAGVLDDGVVTELTPDRLATVRRPKVDAARLLDELTREADLAAFVLFSSAAGVLGNPGQAGYAAANAELDALARQRNSLDLPAVSIAWGYWATVSGMTEHLGDADLRRNQRIGMSGLPADEGMALLDAAIATGGTLVAAKFDVAALRATAKAGGPVPPLLRGLAPLPRRAAAKTASLTERLAGLAETEQAAALLDLVRRHAAEVLGHSGAESVHSGRTFKDAGFDSLTAVELRNRLAAATGLTLSPAMIFDYPKPPALADHLRAKLFGSAANRPAEIGTAAAEEPIAIVAMACRFPGGVHSPEDLWRLVADGADAVTEFPADRGWDTDRLYHEDPDHEGTTYVRHGAFLDDAAGFDAAFFGISPNEALAMDPQQRLLLETSWELFERAAIDPTTLAGQDIGVFAGVNSHDYSMRMHRAAGVEGFRLTGGSASVLSGRVAYHFGVEGPAVTVDTACSSSLVALHMAVQALQRGECSMALAGGVMVMGTVETFVEFSRQRGLAPDGRCKAFADGADGTGWSEGVGLLLVERLSEAQRRGHQVLAVVRGSAVNSDGASNGLTAPNGPSQQRVIRKALAAAGLSTSDVDAVEAHGTGTTLGDPIEAEALLATYGQNRETPLWLGSVKSNLGHTQAAAGVAGVIKMVMAMRHGVLPRTLHVDRPSSYVDWSAGAVELLTEARDWVSNGHPRRAGVSSFGIGGTNAHVVLEEVAAPITTPQPEPAEFLVPVLVSARTAAGLRGQAGRLAAFLGDRTDVRVPDAAYALATTRAQLDHRAVVLASDRAQLCADLAAFGSGVVTGTPVDGKLAVLFTGQGSQWAGMGRELAETFPVFRDAFEAACEAVDTHLRERPLREVVFDDSALLDQTMYTQGALFAVETALFRLFESWGVRPGLLAGHSIGELAAAHVSGVLDLADAGELVAARGRLMQALPAGGAMVAVQATEDEVAPLLDGTVCVAAVNGPDSVVLSGTEAAVLAVADELAGRGRKTRRLAVSHAFHSPLMEPMLDDFRAVAERLTYRAGSLPVVSTLTGELAALDSPDYWVGQVRNAVRFSDAVTALGAQGASTFLELGPGGALAAMALGTLGGPEQSCVATLRKNGAEVPDVLTALAELHVRGVGVDWTTVLDEPATAVGTVLPTYAFQHQRFWVDVDETAAVSVTPPPAEPIVDRPVQDVLELVRESAAVVLGHRDAGSFDLDRSFKDHGFDSLSAVKLRNRLRDFTGVELPSTLIFDYPNPAVLADHLRAELLGERPAAPAPVTRDVSDEPIAIVGMSTRLPGGADSPEELWKLVAEGRDAVSGFPVDRGWDLDGLYHPDPAHAGTSYTRSGGFLHDAAQFDAGLFGISPREALAMDPQQRLLLETSWEALERAGVDPLSARGSDVGVFTGIVHHDYVTRLREVPEDVQGYTMTGTASSVASGRVAYVFGFEGPAVTVDTACSSSLVAMHLAAQALRQGECSMALAGGATVMASPDAFLEFSRQRGLSADGRCKAYAEGADGTGWAEGVGVVVLERLSVARERGHRVLAVLRGSAVNQDGASNGLTAPNGPSQQRVIRGALASAGLAPSDVDVVEGHGTGTALGDPIEVQALLATYGQEREQPLWLGSLKSNLGHTQAAAGVVGVIKMIMAMRHGVMPATLHVDERTSQVDWSAGAIEVLTEAREWPRTGRPRRAGVSSFGASGTNAHLIIEEGPAEEAVDEEVASVVPLVVSARSAGSLAGQAGRLAAVLENESLAGVAGALVSGRATLNERAVVIAGSRDEAQDGLQALARGENAPGVVTGTAGKPGKVVWVFPGQGSQWMGMGRDLLDSSPVFAARIKECAAALEQWTDWSLLDVLRGDADLLDRVDVVQPASFAMMVGLAAVWTSLGVTPDAVLGHSQGEIAAACVSGALSLDDAAKVVALRSQAIAGELAGRGGMASVALSEEDAVARLTPWANRVEVAAVNSPSSVVIAGDAQALDEALEALAGDGVRVRRVAVDYASHTRHVEAIAETLAKTLAGIDARVPAIPFYSTVLGTWIEQAVVDAGYWYRNLRQQVRFGPSVADLAGLGHTVFVEISAHPVLVQPLSEISDDAVVTGSLRRDDGGLRRLLASAAELYVRGVAVDWTAAVPAAGWVDLPTYAFDRRHFWLHEAETAEAAEGMDGEFWTAIEQSDVDSLAELLELVPEQRGALSTVVPVLAQWRDRRRERSTAEKLRYQVTWQPLEREAAGVPGGRWLAVVPAGTTDALLKELTGQGLDIVRLEIEEASRAQLAEQLRNVLAEHDLTGVLSLLALDGGPADAAEITASTLALVQALGDTTTSAPLWCLTSGAVNIGIQDAVTAPAQAAVWGLGRAVALERLDRWGGLVDLPAAIDARTAQALLGVLNGAAGEDQLAVRRSGVYRRRLVRKPVPESATSRWEPRGTVLVTGGAEGLGRHASVWLAQSGAERLIVTGTDGVDELTAELAEFGTTVEFCADTDRDAIAQLVADSEVTAVVHAADIAQTSSVDDTGVADLDEVFAAKVTTAVWLDQLFEDTPLDAFVVFSSIAGIWGGGGQGPAGAANAVLDALVEWRRARGLKATSIAWGALDQIGIGMDEAALAQLRRRGVIPMAPPLAVTAMVQAVAGNEKAVAVADMDWAAFIPAFTSVRPSPLFADLPEAKAILRAAQDDGEDGDTASSLADSLRAVPDAEQNRILLKLVRGHASTVLGHSGAEGIGPRQAFQEVGFDSLAAVNLRNSLHAATGLRLPATLIFDYPTPEALVGYLRVELLREADDGLDGREDDLRRVLAAVPFARFKEAGVLDTLLGLADTGTEPGTDAETTEAAPAADDAELIDALDISGLVQRALGQTS

SEQ ID NO: 18435 - protein, 164 aa, Forsythia x intermedia
SKLANNASGQLEWQDYFFHCIFPEEKWDLSICPKTPTDYIPAISEYAKQLRDLTSKMLSVLSLGLGLEQGRLEKEVGGMEELLLQLKINYYPKCPQPELALGVEAHTDISALTFILHNMVPGLQLLYEGKWVTAKCVPNSIIMHIGDTVEILSNGKYNSILHRG

SEQ ID NO: 18436 - protein, 190 aa, Erwinia chrysanthemi
MSKRILAPVVTVLSLTAFSPAFAATTSTHVLLTTSAGNIELALDDQKAPVFVKNFVDYVNSGFYNGTIFHRVIPGFMVQGGGFSSDMKQKATNPPVKNEADNGLRNLRGTISMARTSEKDSATSQFFINVADNAFLDHGQRDFGYAVFGKVVKGMEVADKISQVQTENVGPYQNVPSKPIVIQSAKIIKK

SEQ ID NO: 18437 - protein, 507 aa, Solenostemon scutellarioides
MTSLLAHPLLPPPRRRPLPPLLPPPVSHPAGPRPGRWWRNLYDVKPVRFRCFAEWAQLFGPTFSVWFGSTLNVIVSSSELAKEVLKEKDGQLADPPRSRSAVKLSRDGKDLIWADYGPHYVKVRKVCTVVLFSPKRLELLRPIREDEITVMVESIYQDSAASGKSVVIKKYLASMAFHNITRLVFGKRFVNSEGEVDKQGQEFKAIAINGLKLGASLAVSEHIPWLRWMFPLDEDAFTQHGVRMERLTREIMQEHTLARQKTGGAKQHFFDALLTLKDEYDLSEDTIIALLWDMIAAGMDTPAISVEWAMAELVRNPRVQEKVQEELDRVIGHERIMTELDIPNLPYLQCVVKESLRLHPPTPVMLPHRSNADVKIGGYDIPKGSNVHVNVWAIARDPKSWKVPLEFRPERFLEEDVDIKGHDFRLLRFGAGRRVCPGAQLGIDLATSMIGHLLHHFRWTPPTGVRAEDIDMGENPGTVTYMRTPVEAVPTPRLPANLYKRVAVVDI

SEQ ID NO: 18438 - protein, 370 aa, Arabidopsis thaliana
MENGEAKQSVPLLTPYKMGRFNLSHRVVLAPLTRQRSYGNVPHAAIYYSQRTTPGGFLITEATGVSDTAQGYQDTPGIWTKEHVEAWKPIVDAVHAKGGIFFCQIWHVGRVSNSGFQPNGKAPISCSDKPLMPQIRSNGIDEALFTPPRRLGIEEIPGIVNDFRLAARNAMEAGFDGVEIHGANGYLIDQFMKDTVNDRTDEYGGSLQNRCKFPLEIVDAVAKEIGPDRVGIRLSPFADYMESGDTNPGALGLYMAESLNKYGILYCHVIEARMKTMGEVHACPHTLMPMRKAFKGTFISAGGFTREDGNEAVSKGRTDLVAYGRWFLANPDLPKRFQVDAPLNKYDRPTFYTSDPVVGYTDYPFLESTA

SEQ ID NO: 18439 - protein, 309 aa, Picea abies
MTKEERRESEQQGFPPKDYTDPPPAALIETSEFKLWSFYRALIAEFVATLLFLYITIATVIGHSRTSTNCGSVGVLGIAWSFGGMIFVLVYCTAGISGGHINPAVTFGLFLARKVSLPRAILYMIAQCLGAICGTGLAICGTGLVKSFQKSFYDRYGGGANYVHHGYTKGVGLAAEIIGTFVLVYTVFSATDPKRSARDSHVPVLAPLPIGFAVFMVHLATIPITGTGINPARSFGAAVIYGHKQSWDDHWIFWVGPFAGAALAAAYHQYILRAAAIKALGSFRSNGNVELEELVARRSCLCLKYVGLQ

SEQ ID NO: 18440 - protein, 358 aa, Arthrobacter sp. BP2
MKRCSAMHAFAVLPDDATIHDLEFSTPRPEGRQVLLKVMRAGVCHTDTHLREGGYDLGSRGHMSMKDRGIQYPMVLGHEVVGVVEQVGADVASVSAGDVRLIYPWIGCGTCRQCREGHDNRCAAGQNLGVARHGGYAEYIIVPDEKYLVDIEGLDPSWAATLACSGLTAHSAVDKVLPLEPDEPVVIFGAGGLGLTAIAILRARGHRNICAVDVAERNLALARDMGATSTVLSGAGSGAADIQRAAGGPASAVVDFVNNGATATAAFDALAKAGTMVQVGLFGGEVTLPTAMLALRMIRIEGSFVGALSQLQDLVRIAKAGELPTIPVSERTLSAAEVSRALDDLTAGGIAGRIVLTA

SEQ ID NO: 18441 - protein, 478 aa, Arthrobacter sp. BP2
MVPAAGLDYYVIHHRGEPPMGVYTTIDPATGDATAQYPEISDAELDTLIKNSAAAYRSWRTTTLEQRRAVLTRTAEIHREQAEELAKLLTLEMGKPIAQARGEVELVASIYQHYADNLEEYLADESLTFRGSGTAVVRTEPIGPLVGVMPWNYPYYQVARFAAPNIALGNTIILKHARNCPQSALAIERVLTEAGLPAGVYANAFISSAQVAAAVADRRVQGVSLTGSEKAGAAVGEVAGRNLKKCVLELGGSDPFIVLDDADIDAAAAAAVIGRLSNGGQACTASKRFIVADSVYEEFLQKFLDAMASWQTGDPTDSGTKLGPLASAAGVEELDELVQDAVSHGAKLLLGGERPDGPGAYYPATVLAGVTPAMRAFTEELFGPVAVVYRVGSLQEAIDLANNSPFGLSSSVFTSDARNAERLAEELEVGMVWINSTSKSSPDLPFGGVKGSGFGRELAGYGFNEFANKKLVRNPGAR

SEQ ID NO: 18442 - protein, 352 aa, Rhodococcus sp. Phi2
MRVFAVQPEDTTIHDLQVPTPSPEGREVLLRVVRAGVCHTDTHLRAGGYDLGSRGMMSMKERGIEYPMVLGHEVVGVVEKVGDGVESVQVGDIRLIYPWIGCGECRQCRAGHDNRCAAGKNLGVARHGGYAENILVPDEKYLVDIDGLDPSWAATLACSGLTAYSAVDKALPLEPDEPVVVFGAGGLGLTAIAILRSRGHRNICAVDVAERNLALARDMGASSTVLSGTGSGADDIRGAAGGPAGAVIDFVNNGATATTAFEVLAKAGIMIQVGLFGGEVTLPTALLALRMIRIEGSFVGTLVQMQDLVRLAQRGELPHIPVVERSLSAAAVSQALDDLTAGGVAGRIVLTA

SEQ ID NO: 18443 - protein, 459 aa, Rhodococcus sp. Phi2
MGVYTTTDPATGEEVAQYPEISDAQLDELIGRSAAAYRSWRTTPLEQRRAVLSRAAEIHREQADELAALLTLEMGKPITQAKGEVALVASIYQYYADHAEEFMADEPLDIAGSGTAVVRTEAIGPLVGVMPWNYPYYQVARFAAPNIALGNTIILKHARNCPQSALAIERVLTEAGLPDGVYLNAFISSAQVAAAIADPRVQGVSLTGSEKAGSAVGEVAGRHMKKCVLELGGSDPFIVLGDADVDAAAAAAVVGRLGNGGQACTASKRFLVEEPVYDEFVRKFLDGMISWQPSDPTSPETKLGPLSSRSAVDELDELVQDAVSRGAQVLTGGDPRDEKGAYYPPTVLVGVTPDMRAYYEELFGPVAVVHRVGSLDEAIEAANDSPFGLSSSVFTSDPQKADRVAEELETGMVWINSTSKSSPDLPFGGVKRSGVGRELARFGFDEFANKKLVRKPGKK

SEQ ID NO: 18444 - protein, 214 aa, Mycoplasma gallisepticum
MIRLIFLGAPGTGKGTISSYLKEQHGFFHISSGDLFRFYAKEEKTALAEEIKSYINNGLYVPDELTNRTVADFYHKNQSQDKIIFDGYPRTLNQCEYIDEIIKFTHVILLQPTDWDMIINRLSSRRSCPQCKRIYNINSVDFKPKVANLCDLCKVELIHRKDDDPSVVSTRINVYNEQTKPVIEYYKKKNLLHLVDANKSFEELYKLVLEIVNK

SEQ ID NO: 18445 - protein, 382 aa, Comamonas testosteroni
DKLPAGAHAFDDLLARARPADPIDTHGDEPAFWLYSSGSTGAPKGTVHSQANLYWTCELYGKAVLGMREDDVVLSAAKLFFAYGLGNALSFPLSVGATVVLMAERPTPQACFKRMTEHRPTIFCGAPTGYGGMLASADLPAKEAVALRLCSSAGEALPQDIGERWTRHFGVEIIDGIGSTEMLHIFLSNVPGEVHYGSTGHPVPGYEVELRGEDGQALAPNADGSIDIGDLYIKGPSAALMYWNNRDKSRDTFQGGWTKAGDKYQRNPNGTYTYAGRNDDMLKVSGIYVSPFEVEATLVQHPAVLEAAVIGHTDGEGLTKTKAYVVLKPGQQAGAADLQAFVKERLAPYKYPRFIEFLDELPKTATGKIQRFRLRERDQAGG

SEQ ID NO: 18446 - protein, 319 aa, Actinidia deliciosa
MTTLDLRPLGNTGLKLSSVGFGASPLGNVFGPVSDHDAIASVREALRLGINFFDTSPYYGGTLSEKVLGKALKALGVPRNEYIVSTKCGRYAEGFDFSAERVTKSFDESLERLQLDYVDILQCHDIEFGSLDQIVNETIPALQKLKEAGKIRFIGITGLPLGVFTYVLDRVPPGTVDVILSYCHYSINDSTLEDLLPYLKSKGVGVISASPLAMGLLTESGPPEWHPASPELKAACQAAAAHCKEKGRNISKLAMQYSLSNKDISSILVGMNSVKQVEENVAAANELATFGKDEKTVSEIEEILKPVKNQTWLSGIQQI

SEQ ID NO: 18447 - protein, 475 aa, Rhoiptelea chiliantha
MSPQTETKASVGFKAGVKDYKLTYYTPEYQTKDTDILAAFRVSPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 18448 - protein, 512 aa, Clostridium perfringens
MSKKPVMLMILDGFGISPNKEGNAVAAANKPNYDRLFNKYPHTELQASGLEVGLPEGQMGNSEVGHLNIGAGRIIYQELTRITKEIKEGTFFTNKALVKAMDEAKENNTSLHLMGLLSNGGVHSHIDHLKGLLELAKKKGLQKVYVHAFMDGRDVAPSSGKDFIVELENAMKEIGVGEIATISGRYYAMDRDNRWERVELAYNAMALGEGEKASSAVEAIEKSYHDNKTDEFVLPTVIEEDGHPVARIKDGDSVIFFNFRPDRAREITRAIVDPEFKGFERKQLHVNFVCMTQYDKTLECVDVAYRPESYTNTLGEYVASKGLNQLRIAETEKYAHVTFFFNGGVEQPNTNEDRALIASPKVATYDLKPEMSAYEVTDELINRLDQDKYDMIILNFANPDMVGHTGVQEAAVKAIEAVDECLGKVADKVLEKEGTLFITADHGNAEVMIDYSTGKPMTAHTSDPVPFLWVSKDAEGKSLKDGGKLADIAPTMLTVMGLEVPSEMTGTCLLNK

SEQ ID NO: 18449 - protein, 258 aa, Arabidopsis thaliana
MAASANPSGNNQEGSSATQKVSSSSAAAANGAAVNSVDNGGNTGAAADNSQTIGALRHNPGISTDWTLEEQSLLEDLLVKYATEPSVFRYAKIAMKMKDKTVRDVALRCRWMTKKENGKRRKEDHSSRKSKDKKEKATDSSAKSSSHLNVHPNGPSYAPPMMPIDTDDGISYKAIGGVSGDLLEQNAQMFNQLSTNFSAFQLHENVNILCKARDNILAILNDLNDMPEVMKQMPPLPVKLNEELANSILPRPSHQRKS

SEQ ID NO: 18450 - protein, 436 aa, Pseudomonas putida
MNYLSPAKIDSLFSAQKAYFATRATADVGFRKQSLERLKEAVINNKEALYSALAEDLGKPKDVVDLAEIGAVLHEIDFALAHLDEWVAPVSVPSPDIIAPSECYVVQEPYGVTYIIGPFNYPVNLTLTPLIGAIIGGNTCIIKPSETTPETSAVIEKIIAEAFAPEYVAVIQGGRDENSHLLSLPFDFIFFTGSPNVGKVVMQAAAKHLTPVVLELGGKCPLIVLPDADLDQTVNQLMFGKFINSGQTCIAPDYLYVHYSVKDALLERLVERVKTELPEINSTGKLVTERQVQRLVSLLEATQGQVLVGSQADVSKRALSATVVDGVEWNDPLMSEELFGPILPVLEFDSVRTAIDQVNKHHPKPLAVYVFGKDMDVAKGIINQIQSGDAQVNGVMLHAFSPYLPFGGIGASGMGEYHGHFSYLTFTHKKSVRIVP

SEQ ID NO: 18451 - protein, 185 aa, Podospora anserina
MQGLLLSLSLLASAAVGVLASDDLKIDVTLPVECDRVTKKGDKINVHYKGTLKSNGEKFDSSYDRQSPFSFKLGAGMVIKGWDEGLVDMCIGEKRTLTIGPSYGYGDRNVGPIPAGSTLVFETELVGIEGVPKPESIVTKSATDAPESTASAKVVEKVASVAKQAAEVVETIIADTDDTQEHNEL

SEQ ID NO: 18452 - protein, 488 aa, Pisum sativum
MILEMGSMWVVLMAIGGALLVLRSILKNVNWWLYESKLGVKQYSLPPGDMGWPFIGNMWSFLRAFKSKDPDSFISSIVSRYGSSGIYKALMFGNPSVIVTTPEGCKRVLTDDEKFTTGWPQSTIELIGKNSFIAMTYEEHKRLRRLTSSSINGMEALSLYLKYIEENVIISLEKWSNMGQIEFLTEIRKLTFKIIMHIFLSSESEPVMEALEKEYTILNHGVRAMQINVPGFAYYKALKARKNLVGIFQSIVDDRRNIRKVYSQKKAKDMMDSLIDVEDDNGRKLNDEDIIDIMLMYLNAGHESSGHITMWATYFLQKHPEYLKKAKEEQEEIIKRRPSTQKGLTLKEIRGMDFLYKVIDETMRVITFSLVVFREAKSDVTINGYTIPKGWKVLTWFRSVHLDPEIYPNPKEFNPNRWNKEHKAGEFLPFGAGTRLCPGNDLAKMEIAVFLHHFTLNYRLEQLNPKCPIRYLPHTRPMDNCLGRVKKC

SEQ ID NO: 18453 - protein, 490 aa, Pisum sativum
MASLWFIFGAIAGALLVLRSLLKNVNWFLYEAKLGDKQYSLPPGDMGWPIIGNMWSFLRAFKSSKPDSFMDSIVKRFGNTGIYKVFMFGFPSVIVTSPEACKKVLTDDENFEPGWPQSTVELIGEKSFIKMPFEEHRRLRRLTSASINGYEALSVYLKYIEEIVISSLEKWTQMGEIEFLTQMRKLTFKIIIHIFLGSESEPVMEALEREYTVLNLGVRAMRINIPGFAFHKSLKARKNLVAIFQSIVDKRRNERRGKEPAPGKKAKDMMDSLIDAVDENGRKLGDDEIIDIMLMYLNAGHESSGHITMWATYFLQRHPEFFRKAKEEQVEMLKRRPPSQKGLKLEDVRKMEYLSKVIDETMRVVTFSLMVFRQARNDVKVNGYLIPKGWRVLTWFRSVHFDSELYPDPREFNPENFSVVRKAGEFLPFGAGTRLCPGNDLAKLEISVFLHHFLLKYELEQLNPKSPIRFLPHTRPLDNCLARIKKQEAA

SEQ ID NO: 18454 - protein, 388 aa, Lupinus albus
MVDQVQRPTIMEKVSSQLHLRSGVSSDIQSYDAAFRRPAVYQRRSFGNYSNAALQYPVMPSCRATTDLSSVATASPVFAAAPAEKGHFLIDFLMGGVSAAVSKTAAAPIERVKLLIQNQDEMIKSGRLSEPYKGIGDCFKRTMADEGVVALWRGNTANVIRYFPTQALNFAFKDYFKRLFNFKKDRDGYWKWFAGNLASGGAAGASSLFFVYSLDYARTRLANDSKAAKKGGERQFNGLVDVYKKTLASDGVAGLYRGFNISCVGIIVYRGLYFGMYDSLKPVLLTGSLQDSFFASFGLGWLITNGAGLASYPIDTVRRRMMMTSGEAVKYKSSLDAFSQILKNEGAKSLFKGAGANILRAVAGAGVLAGYDKLQVIVFGKKYGSGGA

SEQ ID NO: 18455 - protein, 328 aa, Podospora anserina
MVCALFLNRIGVEDLLIAGIGLFLGSGRSLASAGPGGAVLCYILMGTVQNYHLFCVICPDLLTVTSHRVKMTALMSVNAPVMEFPRRFMSRGVGFAVGWVYWFAYAVLAGEQLVAVSNAINSRWVRGLIMPCGYPCFRPMLMLPFKVFGELEYIFGCFKLMFIILLIMVGHSIEGSLGTLLGVWTTFTSVMSSYIGMDIVAATAAESRALSDVESMKMAARKINLRVITLYSLAMLPASFVVPMDHPFINGHSTSVGARSIFIIAVVEAGMPKVAHFFNAVFVFSAFTCGINSMYIATRVLHTLALRGQTGPEFITRRLRQCRSGVPS

SEQ ID NO: 18456 - protein, 135 aa, Podospora anserina
MTGGGKSGGKASSGKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTGTKPGKNASQEL

SEQ ID NO: 18457 - protein, 509 aa, Podospora anserina
MAFKRFFWVSSLISLALAQAQNNNQGGATLDPEVIQQGSFVDGKSSLGAEDVQAASATSQNNFINFCKGQTLTNGFQITTGSCNGIVMGQIPAKDRMISTVITNPANGATIPSNQDFEIVVQVTNLNAGAFTNAAVTYYSAPQQLDNGNIVGHTHVTVQDTGADLNPQQPMDPQQFAFFKGINDAGNGQGRLSAAVTGGLPAGNYRVCTLTAAANHQPVIMPVAQRGSQDDCVRFTVTGDGNTPNEAANNGAKGQAAAALVADAIALGPGAPNPGGNNAGGNGQGNGQGNGQGNGQGNGQGNGQGNGQGNGQGNGQGNGQGNGQGNGQGNGQGNGQGNGQGNGQGNGQGNGQGNGQGNGQGNGQGNGQGNGQGNGQGNGQGNGQGNGQGNAGNPAGGDAAGGNPAGGDAAGGNPAGGDAVAGNPAGVDAAGGNGGGGNAAGNNNANAGNNKQADGQNREGKGKGKANGNDNAQQEQTGQEGPALDPAAAPTPPAAARLARLARRRRFIA

SEQ ID NO: 18458 - protein, 353 aa, Podospora anserina
MSNAQARGGARKISFNVSEQYDIQDVVGEGAYGVVCSAIHKPSGQKVAIKKITPFDHSMFCLRTLREMKLLRYFNHENIISILDIQKPRSYESFNEVYLIQELMETDMHRVIRTQELSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPNTSDMALDLLEKLLAFNPVKRITVEEALKHPYLEPYHDPEDEPTAPPIPEEFFDFDKHKDNLSKEQLKQLIYQEIMR

SEQ ID NO: 18459 - protein, 490 aa, Podospora anserina
MLSQRLLLGRTAVRSALKPSGCAEEKDLVIIGGGVAGYVAAIKAGQEGMKVACIEKRGTLGGTCLNVGCIPSKSLLNNSHLYHQILHDTKHRGIEVGDVKLNLQQLMKAKETSVTGLTKGVEFLLKKNGVEYIKGTGSFQDEHTVKVELNDGGETSVTGKNILIATGSEVTPFPGLTIDEQTVISSTGAIALEKVPEKLVVIGGGIIGLEMASVWSRLGSKVTVVEYLDQIGGPGMDTEVAKGIQKILKKQGITFKTGTKVLSGEKTGDEVKVQTEAAKGGKEETLDADVVLVAIGRRPYTGGLGLENIGLELDERGRVIIDAEYRTKIPHIRCVGDATFGPMLAHKAEEEAVAVVEYIKKGYGHVNYGCIPSVMYTFPEVAWVGQSEQDLKKADIPYRVGTFPFSANSRAKTNLDTEGFVKILADPETDRLLGIHIIGPNAGEMIAEGTLALEYGASSEDIARTCHAHPTLSEAFKEAAMATHAKAIHF

SEQ ID NO: 18460 - protein, 166 aa, Brassica rapa subsp. pekinensis
VEEYEEHMKKLASKLMWLALNSLGVSEEDIEWASLSSDLNWAQAALQLNHYPVCPEPDRAMGLAAHTDSTLLTILYQNNTAGLQVFRDDLGWVTVPPFPGSLVVNVGDLFHILSNGLFKSVLHRARVNQTRARLSVAFLWGPQSDIKISPVPKLVSPVESPLYQSV

SEQ ID NO: 18461 - protein, 401 aa, Myxococcus xanthus
MTALSQSEPSLSASSDSSTDALVQKAKRHLLQNYKQPPFVLARGQGARVWDMDGREYLDLIGGIATCALGHCHPEVVAAAKAQLDSLWHVSNVFYSQPQIDLAAQLTEWSGLSRAFFCNSGAEANEALLKLTRKVMKDRGTPERFEVISFDSSFHGRTLATVTATGQAKYQKGFEPLPAGFTHVPYGDLEAVRKAVGPATAAILVEPIQGEGGVRMAPLGFLVGLRALCDEHGLLLLVDEVQTGMGRTGKPFGFMHEGIVPDGISVAKALGNGLPIGAMLCKEELGASLTPGTHGSTFGGNPVAAAAANAVVRILRRPGFLDEVQEKGAYLLARARELQGRLPAGRIQAVRGQGLLVGVQLDHKVAPVIAQVHEEGLLVNPAGDRTMLFAPPFIVTVRELD

SEQ ID NO: 18462 - protein, 308 aa, Geobacillus stearothermophilus [sequence omitted]

SEQ ID NO: 18463 - protein, 170 aa, Anthoceros formosae
MPRSQKNDNFIDKTFTIIADILLQIIPTTQREKEAFTHYRDGMSAQSEGEYAEALQNYYEAMRLEIDPYDRSYILYNIGLIHTSNGEHAKALEYYFQALERNSSLPQALNNMAVICHYRGEQAIEEGDPETCEVWFDQAADYWKKAISLAPSNYIEAQNWLRITGRSKIK

SEQ ID NO: 18464 - protein, 475 aa, Anthoceros formosae
MSPQTETKAGVGFKAGVKDYRLTYYTPDYETKDTDILAAFRMTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIFKSQAETGEIKGHYLNATAGTCEEMMKRAHFARELGMPIVMHDYLTGGFTANTTLARYCRDNGLLLHIHRAMHAVIDRQRNHGIHFRVLAKALRMSGGDHIHSGTVVGKLEGEREVTLGFVDLLRDDYIEKDRSRGIYFTQDWVSMPGVLPVASGGIHVWHMSALTEIFGDDSVLQFGGGTLGHPWGNAPGAVANRVALEACVQARNEGRDLAREGNDIIREASKWSPELAAACEVWKEIKFVFETIDTL

SEQ ID NO: 18465 - protein, 313 aa, Anthoceros formosae
MSLMNWFEDRRKFSGLIGAFIEKATKGYILSERRKDRHIKIDTTKGLWTRCDNCENMLYIRFLRQNKRICEECGYHLQMSSTERIESLIDRGTWHPMDEDMVARDALKFSDEDSYKNRVLFYQKRTGLTDAIQTGIGKLNGIPIALGVMDFQFMGGSMGSVVGEKITRLIEYGTRESMPVIIVCSSGGARMQEGTLSLMQMAKISAVLQIHQAQKKLLYIAILTYPTTGGVTASFGMLGDVIIAEPKAYIAFAGKRVIEQTLRQKIPDGSQVAESLFDHGLLDLIVPRNLLRGVLSEIFELYSSAPCRRSNNS

SEQ ID NO: 18466 - protein, 316 aa, Petunia x hybrida
MEQENHNNNNCTNDKESACISSVLPGWFSEISPLWPGEAHSLKVEKILFQGKSDYQNVMVFQSSTYGKVLVLDGVIQLTERDECAYQEMITHLPLCSIPNPKKVLVIGGGDGGVLREVSRHSSIEQIDICEIDKMVVEVSKQFFPDVAVGYEDPRVNLHIGDGVAFLKAVPAGTYDAVIVDSSDPIGPAQELFEKPFFETVARALRPGGVVSTQAESIWLHMDIIENIVTNCRQIFKGSVNYAWTTVPTYPSGMIGFMLCSTEGLEVDFKNPVNLIENDEIHSKTLPPLKFYNFEIHKASFALPSFAKRVIESKGN

SEQ ID NO: 18467 - protein, 243 aa, Arabidopsis thaliana
MSLFRIFINQLEEDDEDMATSKKMITREEWEKKLNAVKLRKEDMNTLVMNFLVTEGYVEAAEKFQRESGTKPEIDLATITDRMAVKKAVQNGNVEDAIEKVNDLNPEILDTNPELFFHLQQQRLIELIRQGKTEEALEFAQEELAPRGEENQAFLEELEKTVALLVFDDASTCPVKELLDLSHRLKTASEVNAAILTSQSHEKDPKLPSLLKMLIWAQTQLDEKAVYPHINDLSTGKLEDPSE

SEQ ID NO: 18468 - protein, 491 aa, Saccharomyces cerevisiae
MSKYQINCIRYRHFLRTSNISQIPDFTKYCIGPVNEELAPYIMETMKAYPSNSEYINPQHYYHNRTVLVENYLKRSPNPVSLTQLAQYYDDSTKLTRTKIINSGKFVKEELVIRIAHKLNQLQQLPFNVVNNFHFVQVYESYYNIFESFRKYPTIRTLEDASQFADFIKNMLEGFNTLNLPHLIMGALECTILDLYPREKMDQLLSDLLRARISRRLIVEEHVVYTANYTSGKEENTLVLGDIFQECSAKKYLLEASEESQKFIQDMYFKDIPMPEFIIEGDTQLSFYFLPTHLKYLLGEILRNTYEATMKHYIRKGLEKPEPIIVTVVSNDESYLFRISDKAGGVLHDDENLWSFGKSKERAQESLNNFHKLPGLQTVSIYDEVHSHTKYNSKLKSLQSITLKPYMHTSLEPMSYPSIINGHIKYETPLIELLKRSFRYKLGIGLAMCKVYAEYWNGDLSLHSMPGYGTDVVLKLGNLMKHTKKLQLDKV

SEQ ID NO: 18469 - protein, 101 aa, Phaseolus vulgaris
MASSMISSPAVTTVNRAGAGAGMVAPFTGLKSLGGFPSRKMNNDITSVANNGGRVQCIQVWPTVGKKKFETLSYLPPLTKQQLAKEVDYLLRKGWVPCLEF

SEQ ID NO: 18470 - protein, 431 aa, Wautersia oxalatica
MRPGNLLLNWAAPFSNDLSSHCTMPQEAMKAPVVVLGAGLAAVSFASELRQAGYQGPLTVVGDEAEPPYDRPPLSKDFMGHGDAEKIRLDCKRAPEVEWLLGVAAQSFDPQAHTVTLSDGRTLPYGTLVLATGATPRTLPALQSAPMPVHTLRTLEDARRIQVGLRPQARLLIVGGGVIGLELAATARAAGVHVTLVETQPRLMGRAASSTLSDFVARYHAAQGVDLRFGRSVTGFTEGTVLLDDGARIAADMVVVGIGVVTNDALARAARLACDDGIFVDAFGRTTCPDVYAIGDVTRQRNPLSGRFERIETWSNAQNQGIAVARHLVDPAAPGYAELPWYWSDQGALRIQVAGLASGDEEIVRGEFSIESPKFTLIELQKGCIVGATCVNNARDFAPLRRLLAAGAQPDRAALANPATDLRKLAAAVGT

SEQ ID NO: 18471 - protein, 146 aa, Catharanthus roseus
RTLRELKLLRHMDHENVVAIRDIIPPPQRESFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTTAIDVWSVG

SEQ ID NO: 18472 - protein, 1103 aa, Aspergillus oryzae
MSTPKAEPVPIPGPRGVPLMGNILDIESEIPLRSLEMMADTYGPIYRLTTFGFSRCMISSHELAAEVFDEERFTKKIMAGLSELRHGIHDGLFTAHMGEENWEIAHRVLMPAFGPLNIQNMFDEMHDIATQLVMKWARQGPKQKIMVTDDFTRLTLDTIALCAMGTRFNSFYSEEMHPFVDAMVGMLKTAGDRSRRPGLVNNLPTTENNKYWEDIDYLRNLCKELVDTRKKNPTDKKDLLNALINGRDPKTGKGMSYDSIIDNMITFLIAGHETTSGLLSFAFYNMLKNPQAYQKAQEEVDRVIGRRRITVEDLQKLPYITAVMRETLRLTPTAPAIAVGPHPTKNHEDPVTLGNGKYVLGKDEPCALLLGKIQRDPKVYGPDAEEFKPERMLDEHFNKLPKHAWKPFGNGMRACIGRPFAWQEALLVIAMLLQNFNFQMDDPSYNIQLKQTLTIKPNHFYMRAALREGLDAVHLGSALSASSSEHADHAAGHGKAGAAKKGADLKPMHVYYGSNTGTCEAFARRLADDATSYGYSAEVESLDSAKDSIPKNGPVVFITASYEGQPPDNAAHFFEWLSALKGDKPLDGVNYAVFGCGHHDWQTTFYRIPKEVNRLVGENGANRLCEIGLADTANADIVTDFDTWGETSFWPAVAAKFGSNTQGSQKSSTFRVEVSSGHRATTLGLQLQEGLVVENTLLTQAGVPAKRTIRFKLPTDTQYKCGDYLAILPVNPSTVVRKVMSRFDLPWDAVLRIEKASPSSSKHISIPMDTQVSAYDLFATYVELSQPASKRDLAVLADAAAVDPETQAELQAIASDPARFAEISQKRISVLDLLLQYPSINLAIGDFVAMLPPMRVRQYSISSSPLVDPTECSITFSVLKAPSLAALTKEDEYLGVASTYLSELRSGERVQLSVRLSHTGFKPPTELSTPMIMACAGSGLAPFRGFVMDRAEKIRGRRSSGSMPEQPAKAILYAGCRTQGKDDIHADELAEWEKIGAVEVRRAYSRPSDGSKGTHVQDLMMEDKKELIDLFESGARIYVCGTPGVGNAVRDSIKSMFLERREEIRRIAKEKGEPVSDDDEETAFEKFLDDMKTKERYTTDVFA

SEQ ID NO: 18473 - protein, 429 aa, Methylobacterium extorquens
MTAITNIAAREILDSRGNPTVEVDVLLEDGSFGRAAVPSGASTGAHEAVELRDGDKSRYNGKGVLKAVDAVQSEILDAIGGMDAEDQVAVDEAMIALDGTPNKARLGANAILGVSLAVAKAAAETAGLPLYRYVGGVQGRVLPVPMMNIVNGGAHADNPIDFQEFMVMPVGATSLSDAVRMGAEIFHTLKSALKKAGHNTNVGDEGGFAPNLPSAEAALDFVMESINAAGFKPGSDVVLALDCAATEFFKDGAYRYEGEGQTRSIEQQVDYLAKLTEAYPILSIEDGMSEDDWEGWKLLTDRIGSRVQLVGDDLFVTNVERLARGIETGTANSILVKVNQIGSLTETLAAVDMAQRAGYTAVMSHRSGETEDSTIADLAVATNCGQIKTGSLARSDRLAKYNQLIRIEEGLGAQALYAGRSAIRQLAGR

SEQ ID NO: 18474 - protein, 315 aa, Hordeum vulgare subsp. spontaneum
MATAGKVIKCKAAVAWEAGKPLSIEEVQVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 18475 - protein, 315 aa, Hordeum vulgare subsp. spontaneum
MATAGKVIKCKAAVAWEAGKPLSIEEVEVAPPQAMEVGVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 18476 - protein, 235 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVCKTKKGFHGGHFRSWSCRTGCHGRGQDGWGIKDHWCGFEPCKIRTS

SEQ ID NO: 18477 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQVKKFGCTDFVNPKDHTKPVQEVLVEMINGGVDRAVECTGHIDAMIAAFECVHDGWGVAVLVGVPHKEAVFKTHPMNFLNEK

SEQ ID NO: 18478 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 18479 - protein, 315 aa, Hordeum vulgare subsp. spontaneum
MATAGKVIKCKAAVAWEAGKPLSVEEVEVAPPQAMEVRVKILYTALCHTDVYFWEAKGQTPVFPRILGHEAGGIVESVGEGVTELVPGDHVLPVFTGECKDCAHCKSKESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 18480 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEMLVDMTNGGVDRAVECTGHIDAMIAAFECVHDGWGVAVLVGVPHKEAVFKTHPMNFLNEK

SEQ ID NO: 18481 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEASLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 18482 - protein, 315 aa, Hordeum vulgare subsp. spontaneum
MATAGKVIKCKAAVAWEAGKPLSVEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 18483 - protein, 206 aa, Buchnera aphidicola str. Bp (Baizongia pistaciae)
MLKKINFIDINWNKVDNMLPVVIQHNLSGKVLMHGYMNQEALKRTQNEGIVTFYSRTKQRLWTKGETSKNFLYVTDIRLDCDQDALLIFVRPVGKTCHLNHVSCFQVPSENLFFLHDLDCMLKFKKHYGLENSYTFNLHKNGVNRIAQKVAEEAIETAISAVSKNKVELINESSDLVYHLLVLLHSYDLDLYDVIKNLKMRSNKQV

SEQ ID NO: 18484 - protein, 468 aa, Buchnera aphidicola str. Bp (Baizongia pistaciae)
MAKQQIGVIGMAVMGRNLALNMERNQYTVSIFNRSLDITEKIILNNPNKNLFPFFSIKDFVLSLIVPRCIVLMIKSGVATDDTIKSLIPYLSKGDIIIDGGNTFYKDTIQRGYELLKIGVNLIGAGFSGGEKGALYGPSIMPGGRQEAYNYVSPILKKIASNSEGIPCVTYIGPDGSGHYVKMVHNGIEYGDMQLIAESYFILKTLLRLDNQSISKIFDIWNQGELNSYLIDITKDILIKKDDQNNYLIDCILDEGSSKGTGTWTTKSALDLNEPLTLITESVFFRYLSSLKSQRLLASKILCGPKDFFIVLNRDDFIEKIRQALYLGKIISYAQGFSQLNSASQKYNWNLKLGEISRIFQSGCIIRAKLLKNITQEYSSNNNFVNLLLTPYFREIANTYHSSLREIVSISVKYGIPIPALSSAISYFDSYRSAFLPSNLIQAQRDFFGAHTYKRIDKSGIFHTNWYS

SEQ ID NO: 18485 - protein, 383 aa, Buchnera aphidicola str. Bp (Baizongia pistaciae)
MSKQDYYKTLGVTQSSDEREIKRAYKKLAMKYHPDRNPGNKNSEEKFKTIKEAYEILIDPKKRTAYDQYGHSAFEQGNSTGNNNTFTHSFSSNSDFSDIFGDVFGDIFGGTRKQKSERQGSDLRYDMTLTLEEAVRGTIKEIKIPTLQKCPTCYGYGTKTGTKPQFCPTCRGNGQIQMRKGFFTVQQTCPQCHGEGNFIRDPCRRCHGNGRIEISKTLSVKVPPGVDTNDKIRLNNEGEAGENGAMAGNLYVQINVKKHPIFEREENNLYCEVPISFSMAALGGEIEVPTLDGKVKLKIPCETQSGKLLRIRGRGVKSIRNNNRQGDLLCRIIVETPVNLNDLQKDLLYKLGESFNGFKGEKNSPKSKRFFEGVKRFFDDLTR

SEQ ID NO: 18486 - protein, 351 aa, Buchnera aphidicola str. Bp (Baizongia pistaciae)
MRIEEDIKLGFKDVLIRPKRSILKSRSQVDLTRLFIFKHAQNKWSGIPLIAANMDTVGTFKMAIALSSFGILTAIHKYYSYLDWKKFIHTIPGTVVKHIMVSTGMLDEDFVKLKQILSLSSKLKYICIDVANGYSEKFVTFLKKVRECYCDKIICAGNVVTGEMVEELILSGADIVKVGIGPGSVCTTRAKTAIGYPQLSAVIECSDAAHGLGGQIISDGGCVVSGDIAKAFGGGADFVMLGGMLAGHKECEGLIFKENKKRYMIFYGMSSKFAMDRHIGGVARYKTPEGKTVKVLFRGAVSETINNILGGLRSTCTYVGAFTLKELTKRTTFIKVSEQENIIFNNQEVSN

SEQ ID NO: 18487 - protein, 475 aa, Buchnera aphidicola str. Bp (Baizongia pistaciae)
MISKKVDTQVVIIGSGPSGYSAAFRCSDLGLNVVLIEQYYSLGGVCLNVGCIPSKYLLHIAKVIKDVKKLSRIGISFEKLDINLKEIQCNQKKIIESFSSGISNLARKRNVRIIFGYAKFLDANSIFVQGEHDSYVVSFNKIVIATGSLSKKLSYIPYDDIRIWNSSFAVSIPSIPKKLLIIGGGIIGLEMATIYSALGSNVDIIDNSHDILPHLDRDVIDIFKRSVNHDYNIFFNSNVIKIVQEKNGLLVHIAENDNKNKRFELYDIILVAIGRVPNTDMLDISKVGLKTDNNGFIKVNEQFCTNIPNIYAIGDVIGQPMLAHKGTHEGHIVAEVISGKKHYFNPFVIPCVSYTEPEIAWVGITENEARKNNINYEVSSVLWNTLGRAVSSQCSEGVTKLIFDKKTNKIIGGCIVGSNAGELLGEISLAIEMGCDAEDLALTIHAHPTLYESINLSAQIFQGTITDLINKKIKK

SEQ ID NO: 18488 - protein, 269 aa, Buchnera aphidicola str. Bp (Baizongia pistaciae)
MNNRYYQLNKNLIPYKLGCYIPFVVLGDPSIEISLEIIYSLIKNGADGLELGIPFSDPLADGPIIQQANLRAFSANITLTKCFEMLFKIRTHNPKIPIGILIYANLIFKLGIQKFYSICSKIDIDSVLIADVPIEESFEFEQHSIKNNIDSIFVCPPDASKNFLKKLSKHSTGYIYLLSRSGVTGIDMKITPPLKNFVKELKKLTSIPIIQGFGISNENQIKNIILSGVSGVICGSVIIQIIANNLNNKKIMLKKIKKLSNRFKKATII

SEQ ID NO: 18489 - protein, 429 aa, Buchnera aphidicola str. Bp (Baizongia pistaciae)
MQKNNLNFDKQHIWHPYASMIQPTPCILVKSAKGIILKLHNGKKLIDGMSSWWSTIHGYNHPRLNNALKNQINKMSHVMFGGITHYPAISLCKKLIEITPNSLTRIFLSDSGSVSIEIAIKMILQYWQSLGKNKVIFLTIKKSYHGDTFAAMSVCDPKNSFHQFYHNFLPINIFADNPKCSFDGLWNKKDIISFKKLIQKHKDVVAAVILEPIVQSVGGMKFYHPNYLKQVRFLCDLYKIPLILDEIATGFGRTGKFFAFEHSNIVPDVLCIGKAITGGTITLSATLTTDKIANVISNSASGCLMHGPTFMGNPLACAAAYENILILQENKWKIQVKNIETCLRTYLFPLKTHYEVYDVRVLGAIGVVECYHYINISMMQNYFVKNNVWIRPFRKLIYLVPAYIIDNASLKKLINVISNALNYENFFMK

SEQ ID NO: 18490 - protein, 232 aa, Buchnera aphidicola str. Bp (Baizongia pistaciae)
MKVYKLVLMRHGESIWNELNKFTGWHDVDLSNRGVQESLKAAKLLKKHGFYFDYAYSSVLKRSIHTLWNIIKFLDQSWIPVKKSWRLNERHYGALEGLNKDDVIQKYGNDKVQQWRRSFNIAPPKISYLEKKKLAHDSRYNNINFDILPYCESLKLTTQRVLPYWLNEIFPRFQKNTKIIIVAHGNSLRALIKYLNNINDIDILNLNIATGFPIIYEFNSEFKPIQYYYLKQ

SEQ ID NO: 18491 - protein, 252 aa, Buchnera aphidicola str. Bp (Baizongia pistaciae)
MKKKIIIANWKLNGNIQLLQTLLKPLVNFYIRHKNKSSIKLVIMPPYVYLYPMKSIISHSSILLGSQNVDINLIGAFTGEVSINMLKDVGVSYVLVGHSERRQYHRENDVIIAKKFKIVKDSHLIPVLCIGETEHEYLSCKTEKICKFQIDAIFDLLGPSGFNNSVIAYEPKWAIGTNTIPSINFIQKILMFIQNYIFNKQNSTIKLFSLQYGGSVNEHNIIELYDVKNIDGFLVGSASLSLDFFKKLLNNC

SEQ ID NO: 18492 - protein, 479 aa, Buchnera aphidicola str. Bp (Baizongia pistaciae)
MIRRFRRTKIVATLGPSTDNHIILENMIKSGVNVFRLNFSHGTREEHIYRAKLVTSIAKRLNCHIALLGDLQGPKIRICKFQDKKVFLKVNNYFILDANLNENLGTSERVGIDYKNLPKDVKKCDILLLDDGKIQLKVINIVDQEIFTKIIIGGVLSNNKGINKLGGGLSARILTKKDKRDIITSIDIGVDYLAVSFPRYGSDLDHARKCAVKFGSKAKIIAKIERAEAVKDLKIIDEIILASDAIMVARGDLGVEIGESELAGIQKTLIRRARQLNRVVITATQMMESMINNPMPTRAEVMDVANAVLDGSDAVMLSAETASGKYPIETIKVMSKVCMGAEKMPSINVSQHRIHDKFHDIEEAIAMSAMYAANHLSGITAIITMTESGKTSLMTSRITSGLPIFALSSHIQTLKLTALYRGVTPIFFNSSKEGVSAANEVINLLVKRGFLEPGNLVIITQGDIMGKVGKTNTSRILKV

SEQ ID NO: 18493 - protein, 371 aa, Buchnera aphidicola str. Bp (Baizongia pistaciae)
MTLKNALLAFRNAINILDKNLINLLAKRKQLSLNIAHTKVKNNYPVRDIEREQMLLKNLTILGEKHFLNKKYIESLFSIILEDSVLTQKKWIKKYNLNKYKLEKISFLGSFGSYSHLAAQKYAKKHSKILTDKIYKNFSDVITSVEQQQSTYAILPIENQSSGLIIEVYKLLQKTPLFIIGNIYIHANHCLLAKKYTPILKIQKIYSHIQPFKQCSKFISLFPNWKLSNTTSTSEAIQHVAKENDNTIAALGNESYGELNKLEVIAKNISNKRNNITQFIILAQKKTYITNKKTHLKTIILISKKNENCEKIIRNILHKNKITLLKLKYYVTSKVLLEKIFFIEIENIYCIKHILKQFTIEIKCIKILGCF

SEQ ID NO: 18494 - protein, 431 aa, Buchnera aphidicola str. Bp (Baizongia pistaciae) [sequence omitted]

SEQ ID NO: 18495 - protein, 393 aa, Buchnera aphidicola str. Bp (Baizongia pistaciae)
MSIIKITDLNLLNKKVLIRSDLNVPIKNNKISSYARIHASLPTIKFALKNLAKVIVTSHLGRPTEGIYKKKFSLFPVFKYFKKILPETNIYFSQNLTECSSIKSGELIILENVRFNQGEKENSKILSKKYATLCDIFVMDAFGAIHRNEASTNGIIKYAKLACSGLLLESELKTLNSALTNPVRPMVAIVGGAKVSTKFKTLTTLAKISDTLIVGGGIANTFISIDHNIGKSLHDPKFIEQAKILKEKYNIFIPTDSRVSTTFTYDSIATIKSTSDIHANEEIMDFGDISIKNMINIIKKAKTILWNGPIGVFEFKNFSKGTEQLSKAIASSDAFSIAGGGDTLSVVEMFKVQNNISYLSTGGGSFLKFLEGNKFRIIELLEKHFNKFKNNNF

SEQ ID NO: 18496 - protein, 215 aa, Buchnera aphidicola str. Bp (Baizongia pistaciae)
MHIVLIGGPGTGKGTQAELLSKKYMLPVISTGHILRKISTKKTLFGEKIKNIINSGKLVPDTIIIKIITNEILHKNYTNGFILDGFPRTIKQAKNLKNTNIQIDYVFEFILPTKLIFKRIQTRTINPITGTIYNNVIQKNSELKNLKINTLKSRLDDQYPIILKRLKEHKKNIVYLKDFYINEQKHKSLKYHEINSQNTIKNVNIEIKKILENKL

SEQ ID NO: 18497 - protein, 251 aa, Buchnera aphidicola str. Bp (Baizongia pistaciae)
MILLKIIHIIFVMIFLSIFFPKSLYASTSLIRKDHIIQKNLENFDDQSAYALGVSLGNYINHSFREQKRLGVILDKNSLLSGIRDSLSGKTILSDQEISMELIKLEKKLKYFEDIVLKKEAHNNKIQGDLYIKKMLKKKDARHTSSGLVFFIKKKGSGKFLHDSDVITVHYKGSLINGNEFDNSYKRGQPLSFSLDSVIPGWIEGLKYIKKGGLIKLVIPPKLAYGETGVPGIPGNSTLIFEIELIDIQSK

SEQ ID NO: 18498 - protein, 228 aa, Buchnera aphidicola str. Bp (Baizongia pistaciae)
MKKFLLSSSVLSANFSRLGEDIFDVLKSGSDMIHYDVMDNHYVKNLTFGPIVLESLRSVEKIKSMVIDVHLMTCPVDDLIIKFAKLDVNIISFHPESTNNVEKTIKLIKSYGCKVGLALNPLTPLCVLDNVLDKIDLILLMSVNPGFPGQKFIPSILNKIRIVRELIDKSKKNILLEVDGGINLSNIFKIASFGTDIFVIGSAIFNSINYDLTIRSFRDVLKNINCKK

SEQ ID NO: 18499 - protein, 454 aa, Staphylococcus sciuri
MKKFDVVFIGSGHAAWHAALTLKHAGKSVAIIEKDTIAGTCTNYGCNAKILLEGPYEVLEEASHYPQIIESDQLHVNWENLMQYKKAVINPLSNTLKSMFEQQGIEVIMGAGKLVDAHTIDVEGTPIQADNIVIATGQHSNKLDIEGSALTHDSRDFLSLDKMPNNITFIGAGIISIEFASIAIKSGAEVHVIHHTDKPLEGFNEKHIAKLIHKLESEGVQFHFNENVQSVQQAGNSYNVTTESGLSIDTEYVLDATGRKPNVQNIGLDELGIEYSEKGIRVDDHLRTNIHNIYASGDVLDKTIPKLTPTATFESNYIASHILGINPNPIQYPAIPSVLYSLPRLSQIGVTVKEAEDNEAYTIKDIPFGKQMVFEYKNEIEAEMTIILNADKQLVGAEIYADDAANLINLLTFIVNQKLTAKDLNQLIFAFPGSSSGVLDLLKSCYDVIYKKQR

SEQ ID NO: 18500 - protein, 503 aa, Staphylococcus sciuri
MKKFDVVFIGSGHAAWHAALTLKHAGKSVAIIEKDTIAGTCTNYGCNAKILLEGPYEVLEEASHYPQIIESDQLHVNWENLMQYKKAVINPLSNTLKSMFEQQGIEVIMGAGKLVDAHTVDVEGTPIQAENIVIATGQHSNKLDIEGRALTHDSRDFLSLDKMPNSITFIGAGIISIEFSSIAIKSGAEVHVIHHTDKPLDGFNEKHIAKLIHKLESEGVNSISMKMFNQYNKLGNSYHVTTETGLSVDTDYVLDATGRKPNVQNIGLDELGIEYSEKGIQVDDYLRTNIHNIYASGDVLDKTIPKLTPTATFESNYIATHILGINPNPIQYPVIPSVLYSLPRLSQIGVTVKDAEQSEAYTIKDIPFGKQMVFEYKNETEAEMTIIINADKQLVGAEIYADDAANLINLLTFIVNQKLTAKDLNQLIFAFPRIIKRRARFIKSSNDFRYINTEVRLPSLTRKTYLCFCFGKSSARNYLVSLLRQMHHFICAICKYAINAPVC

SEQ ID NO: 18501 - protein, 193 aa, Methanosarcina mazei
MPEIRQLSEGIFEVTKDKKQLSTLNLDPGKVVYGEKLISVEGDEYRTWDPRRSKLGAMVLKKFDIPLKRNSKVLYLGAASGTTVSHVSDIVSEGAVYSVEFAPRSMRDFIGLASRRKNIFPILADAGKPDSYAHIVEPVDVIFQDVAQPNQAEIAARNAVRFLKKDGYLLLSIKARSIDTAASPKEIFKEEVK

SEQ ID NO: 18502 - protein, 230 aa, Acinetobacter calcoaceticus
MNTLNEVSSTLNASEILSRQRKAFLKAEPPTLQQRKTSLAKLRAAVIEYRSELQVAASEDFGHRSYHETDVMELVGIVQSIDYLIRNLRRFMKPEKRHVSLFYRSASAHIEYQPKGVIGVMAPWNYPISLTLIPFATAIAAGNRAMLKPSELTPRTSEVISRMLAANFPIEEVAVVLGGPEVGAEFSALPFDHLLFTGSTPVGRKVMKAASDNLVPLTLELGGKSPAIVG

SEQ ID NO: 18503 - protein, 177 aa, Musa acuminata
  misc_feature (7)..(8): Xaa can be any naturally occurring amino acid
  misc_feature (88)..(88): Xaa can be any naturally occurring amino acid
  misc_feature (98)..(98): Xaa can be any naturally occurring amino acid
  misc_feature (144)..(144): Xaa can be any naturally occurring amino acid
CGPGHGXXIGSLGKSNSYSQVHDVKVENSLISNTENGVRIKTWQGGSGYARKIVFRGIRMSNVSNPIIIDQYYCDSSRQCQNQTSAVXVHQISFIEIXGTSTTKDAIKFSCSDSSPCEKIYLQDVNMSLGSGGNASAYCWKASXFSSGWVIPPSCLTRAVVGLINQNVGSSKKVDVA

SEQ ID NO: 18504 - protein, 432 aa, Amycolatopsis mediterranei
MTMTVQKAPSQLLAAKLQIPPIPYSHAAGSWVYASDGTRYLDGASGIVNVNIGHAHPTVVAALRDQVGICTYASPGTFAPDLMEQLAAAAARAVHRPDDRVMFTPTGTHATESAIALARLVQRARGEEGRHKILTSTLGYHGNSAFVLALSGHRSRRPHEDDSFGLAPAFNPPYPGQHLGCPFDACRVECVRAVRDAIVAAGPESVAAVLMEPVNGTTGGGYVPPAGYLRALREVCDEFGVLVIHDEVLTGLGRCGLPLASHHTPGSAADIVTLSKGLGAGYVPLAATMLSPDLAEDIMTSGKWLPLMGTMSATPLQGRAGLAVLSVLEELGALDRDEVRGAALGRLVADAVRGRQVVTDVRGLGYFYGIELAPGTLGDVMRITRSRGLLLYPYVGFRPDRTGEGLLVAPRSTRPTAISASSARRWARHWTS

SEQ ID NO: 18505 - protein, 479 aa, Fusarium sporotrichioides
MAENLTSDVPGPAGIPYFGNYLEIYPDHLGNHQRLFEKYGPLFTTSSMGNRLYQTNNSELSNIFLSEDHYFTKDIVPGHPLHPIKNQEAGVFLADTNTEQWRLAHKFLPPALGPKAVRHYAPTMQRTVESSFKVFDELDQKGEAWNVYQYMLKLGSQAVGKLVLGMDFAHFEQVDSPLHEMVLKIAENLELNKRVSSMGAWYAQMPFGDPKKVRQTMARIMEMMDESIARASKGQEDLELQDAALKADNVVDYFLRATDNKGNKLPPSQFAPALLVATAAGFTTTSSLLSWLIYSLVKYPGNQERLLQELIDNDWDEDTQVTADTTSKLTFLEKFIKETQRLHNPSFQPGRTAKVDMILPGGYRLPKGAVVISALHHMHNNKDVWENPGRFDPDRWDTEQVKNRPPGSYIPFATGPRMCIGFNFALQEIKVFLPKLVYRYKFSLAQDGPIEYDPYFQLIRPNNLYVQAEKRVKWPPKSE

SEQ ID NO: 18506 - protein, 379 aa, Hordeum vulgare subsp. vulgare
IPWERLQITRKDYRKARLEQYKNYENFPQSGELMDKLCKQVESSSKYYEFQYNTRIVKPSILHFQLRNLLWATSKHDVYFMSNSTVGHWSSLSHKMTDVLDFSGHVAPAKKHPGCALEGFTGVQVSTLAVNEGLLVAGGFQGELVCKSLGERDVKFCTRTTLSDNAITNAMDIHRSTSGSLRITVSNNDSGVREFDMERFQLLNHFRFNWPVNHTSVSPDKKLLAVVGDDRDALLVDSRNGKVTSTLVGHLDYSFASAWHLDGVTFATGNQDKTCRVWDIRNPSTSLAVLRGNIGAIRCIRYSSDGRFLLFSEPADFVHVYSTAECYRKRQEIDFFGEISGISLSPDDESLFVGVCDRVYASLLNYRLVHANGYLDSYM

SEQ ID NO: 18507 - protein, 483 aa, Hordeum vulgare subsp. vulgare
  misc_feature (396)..(396): Xaa can be any naturally occurring amino acid
MERYNIITEVGDGTFGSVWRAINKESGEVVAIKKMKKKYFSWEECINLREVKSLRRMNHPNIVKLKEVIRENDMLFFVFEYMECNLYQLMKSKGKPFSETEIRNWCFQVFQALSHMHQRGYFHRDLKPENLLVTKELIKVADFGLAREIISEPPYTEYVSTRWYRAPEVLLQSSVYSSAVDMWAMGAIIAELFSHRPLFPGSSEADEIYKICNILGTPNQHTWAGGLQLAASIHFQFPQSGSINLSEVVPTASEDALNLISWLCSWDPRKRPTAVEVLQHPFFQPCFYVPPSLRYRSTGYATPPPSVGAKGAMDQKNARRYPVGTLSNGRPAVNNSYLSTNAPARAAGVQRKLELDHQVKPEGNHKLTTKENAMNQPWSRLPPAPVRNNMNYLAAXEQIPRGGAPDIAEKLSQLSMSSTTNRAPIMPSDRFVDLKATTRAHGEPVRRPVPLGPRDTWHARNDPFRRTYEMPGERALLQRKLVS

SEQ ID NO: 18508 - protein, 338 aa, Medicago truncatula
MASIKQIEIEKKKACVIGGTGFVASLLIKQLLEKGYAVNTTVRDLDSANKTSHLIALQSLGELNLFKAELTIEEDFDAPISGCELVFQLATPVNFASQDPENDMIKPAIKGVLNVLKACVRAKEVKRVILTSSAAAVTINELEGTGHVMDETNWSDVEFLNTAKPPTWGYPVSKVLAEKAAWKFAEENNIDLITVIPTLTIGPSLTQDIPSSVAMGMSLLTGNDFLINALKGMQFLSGSISITHVEDICRAHIFVAEKESTSGRYICCAHNTSVPELAKFLSKRYPQYKVPTEFDDFPSKAKLIISSGKLIKEGFSFKHSIAETFDQTVEYLKTQGIK

SEQ ID NO: 18509 - protein, 198 aa, Brassica rapa
MSASRFIKCVTVGNGAVGKTCLLISYTSNTFPTDYVPTVFDNLSANVIVDGNTINLGLWDTAGQEDYNRLRPLSYRGADVFLLAFSLVSKASYENVSKKWVPELRHYAPGVPIILVGTKLDLRDDKQFFVEHPGAVPISTAQGEELKKLIGAPAYIECSAKTQQNVKAVFDAAIKVVLQPPKNKKRKKRKSQKGCSIL

SEQ ID NO: 18510 - protein, 287 aa, Lupinus albus
GKEQDVSLGANKFPERQPLGIAAQSQDEFKDYQEPPPAPFFEPSELTSWSFYRAGIAEFVATFLFLYITILTVFGVQRSPTKCQSVGIQGIAWAFGGMIFALVYCTAGISGGHINPAVTFGLFLARKLSLTRAVFYIVMQVLGAIVGAGVVKGFEGKHRYTQYNGGANFVAPGYTKGDGLGAEIVGTFVLVYTVFSATDAKRSARDSHVPILAPLPIGFAVFLVHLATIPITGTGINPARSLGAAIIFNKDLGWNDHWIFWVGPFIGAALAALYHQVVIRAIPFKSK

SEQ ID NO: 18511 - protein, 295 aa, Acinetobacter calcoaceticus
MDLVMLKNSFYEKTARARIQAVVDENSFKEILKPTEIEVSPHLSALDIPGSFDDGVIIGTAAINQTPIHIIAQEGQFMGGAVGEIHGAKIVGLLHKAIQDQSQAVVFFVDSGGVRLHEANAGLIAISEIMRAMLQVRHAGIPIITVIGGTCGAFGGMGISACLSSTIIMTEEGRLALSGPEVIETVKGVEEFDSKDRALVWRVTGGKHRFLLNHAQVLVEDDITDIRDAISAQLNQAAPRLDLEHLLQQQQQLEQQQQRWFGKNDGLQIWHEMGIAHPEQIPMLSAQEVKLLKQG

SEQ ID NO: 18512 - protein, 145 aa, Streptococcus pneumoniae
DSIRVIGRDNARTPMQWDESKNAGFSTDQPWLAVNPNYEMINVQEALANPDSIFYTYQKLVQIRKENSWLIRADFELLDTADKVFAYIRKDGDRRFLVVANLSNEEQDLTVEGKVKSVLIENTLAQEVFEKQILVPWDAFCVELL

SEQ ID NO: 18513 - protein, 145 aa, Streptococcus pneumoniae
DSIRVIGRDNARTPMQWDESKNAGFSTGQPWLAVNPNYEMINVQEALANPDSIFYTYQKLVQIRKENSWLIRADFELLDTADKVFAYIRKDGDRRFLVVANLSNEEQDLTVEGKVKSVLIENTLAQEVFEKQILVPWDAFCVELL

SEQ ID NO: 18514 - protein, 232 aa, Arabidopsis thaliana
MAKTLSRSTASCVAKRFFSTSNAVASPSPLPSHLISRRFSPTIFHAVGYIPALTRFTTIRTRMDRSGGSYSPLKSGSNFSDRPPTEMAPLFPGCDYEHWLIVMEKPGGENAQKQQMIDCYVQTLAKIVGSEEEARKKIYNVSCERYFGFGCEIDEETSNKLEGLPGVLFVLPDSYVDPEFKDYGAELFVNGEVVPRPPERQRRMVELTNQRGSDKPKYHDRIRNVRRRENMR

SEQ ID NO: 18515 - protein, 374 aa, Kluyveromyces lactis
MLRLTSARSIVSPLRKGAFGSIRTLATSVPETQKGVIFYENGGKLEYKDIPVPKPKPNEILINVKYSGVCHTDLHAWKGDWPLPTKLPLVGGHEGAGVVVAMGENVKGWNIGDFAGIKWLNGSCMSCEYCELSNESNCPDADLSGYTHDGSFQQYRTADAVQAARIPKGTDLAEVAPTLCAGVTVYKALKSANLKAGDWVAISGAAGGLGSLAVQYAKAMGYRVVGIDGGEEKGKLVKQLGGEAFVDFTKTKDMVAEIQEITNGGPHGVINVSVSEAAMNASTQFVRPTGTVVLVGLPAGAVIKSEVFSHVVKSINIKGSYVGNRADTREAINFFANGHVHSPIKVVGLSELPKVYELMEQGKILGRYVVDTSN

SEQ ID NO: 18516 - protein, 428 aa, Cupriavidus necator
MFAWYKAGSPQQKKTFWACYSGWALDSFDMQMFSFLLPALTLTWGLTKAEVGVLGTVALVVTAIGGWGAGILSDRYGRARILVLAIIWFTLFGVLAGFAQSYQQLLIARTLQGLGFGGEWAVGAALMAEVIDSRHRGKAIGFVQSGFALGWALAVVVATLLLAWLPKEMAWRVAFWSGIIPALIVLFIRRHVKDSSMFERARQSRAPRASLSSVFNRKYARTLALSSVLVIGLQAGCYAILVWLPSLLNQRQVAAGSMIVTVFIMAFGSFCGFAVTADLSDRIGRRPTLILLSVCAWIVTVSYMLLPLNTTLTAILGFLVGFSAIGMFAALGPFLSELFPTNVRTTCMGFAYNVGKSIGAGSVVGVGVLSTHIGLANAMGTFCLVAYAFAVFGIMLLPETRGIAIENIGEADAHSPAAPLAQPASARS

SEQ ID NO: 18517 - protein, 216 aa, Daucus carota
MAAPPARPRADYDYLIKLLLIGDSGVGKSCLLLRFSDGSFTTSFITTIGIDFKIRTIEMDGKRIKLQIWDTAGQERFRTITTAYYRGAMGILLVYDVTDESSFNNIRNWIRNIEQHASDNVNKILVGNKADMDESKRAVPTSKGQALADEYGIKFFEASAKTNMNVEEVFFSIAKDIKQRLAETDSKTEPQTIKINQQEQGAGTSAASQKSACCGS

SEQ ID NO: 18518 - protein, 168 aa, Methanosarcina mazei
MKFFLKVLQRVCSLYERRKQIEAYIESSMEILAPNLALLAGPMLGARLISIAGSLEKLAAFPSSTIQVIGASKALFKHLRSRAPSPKHGIIYSHPLINTSPWWVRGKVARALAAKLSLAARIDFYSAKRNPSLENELEEKIRKIRAENPRPPQKRQEIRAKPKKKRRK

SEQ ID NO: 18519 - protein, 375 aa, Kluyveromyces lactis
MFRLARAQTALANKASVSRSFLRLNSSFAIPETQKGVIFYENGGKLEYKDLPVPKPKANEILINVKYSGVCHTDLHAWKGDWPLPVKLPLVGGHEGAGIVVAKGENVKNFEIGDYAGIKWLNGSCMSCELCEQGYESNCLQADLSGYTHDGSFQQYRTADAVQAAQIPKGTDLAEIAPILCAGVTVYKALKTADLKPGQWVAISGAAGGLGSLAVQYRKAMGLRVLGIDGGDGKEELFKQCGGEVFIDFRKSKDMVADIQEATNGGPHGVINVSVSEAAVSMSTEYLRPTGLVVLVGLPADAYVKSEVFSHVVKSISIKGSYVGNRADTREATDLFTRGLVKSPIKIIGLSELPEAYALMEQGKILGRFVVDTYK

SEQ ID NO: 18520 - protein, 513 aa, Cucurbita pepo
MASYHSKAAFLCLFLLVSFNIVSSASNDGLLRVGLKKIKLDPENRLAARVESKDAEILKAAFRKYNPKGNLGESSDTDIVALKNYLDAQYYGEIAIGTPPQKFTVIFDTGSSNLWVLCECLFSVACHFHARYKSSRSSSYKKNGTSASIRYGTGAVSGFFSYDNVKVGDLVVKEQVFIEATREPSLTFLVAKFDGLLGLGFQEIAVGNAVPVWYNMVEQGLVKEPVFSFWLNRNVEEEEGGEIVFGGVDPKHYRGKHTYVPVTQKGYWQFDMGDVLIDGEPTGFCDGGCSAIADSGTSLLAGPTPVITMINHAIGAKGVVSQQCKAVVAQYGQTIMDLLLSEADPKKICSQINLCTFDGTRGVSMGIESVVDENAGKSSDSLHDGMCSVCEMTVVWMQNQLRQNQTKERIINYINELCDRMPSPMGQSAVDCGQLSSMPTVSFTIGGKIFDLAPEEYILKVGEGPVAQCISGFTAFDIPPPRGPLWILGDVFMGRYHTVFDFGKLRVGSAEAA

SEQ ID NO: 18521 - protein, 510 aa, Pyrococcus woesei
MFPEKFLWGVAQSGFQFEMGDKLRRNIDTNTDWWHWVRDKTNIEKGLVSGDLPEEGINNYELYEKDHEIARKLGLNAYRIGIEWSRIFPWPTTFIDVDYSYNESYNLIEDVKITKDTLEELDEIANKREVAYYRSVINSLRSKGFKVIVNLNHFTLPYWLHDPIEARERALTNKRNGWVNPRTVIEFAKYAAYIAYKFGDIVDMWSTFNEPMVVVELGYLAPYSGFPPGVLNPEAAKLAILHMINAHALAYRQIKKFDTEKADKDSKEPAEVGIIYNNIGVAYPKDPNDSKDVKAAENDNFFHSGLFFEAIHKGKLNIEFDGETFIDAPYLKGNDWIGVNYYTREVVTYQEPMFPSIPLITFKGVQGYGYACRPGTLSKDDRPVSDIGWELYPEGMYDSIVEAHKYGVPVYVTENGIADSKDILRPYYIASHIKMTEKAFEDGYEVKGYFHWALTDNFEWALGFRMRFGLYEVNLITKERIPREKSVSIFREIVANNGVTKKIEEELLRG

SEQ ID NO: 18522 - protein, 405 aa, Candida albicans
MVSIITFTKNVLVTLAFALLAQGLAIPEDIDKRAEKVVSLDFTVTRKPFNATAHGQHHQSQQQQQQQQQQPAQKRGTVQTSLINEGPSYAATITVGSNKQQQTVIVDTGSSDLWVVDSAAVCQVTYPGQSPTFCKQDGTYKPSSSTTSQNLGKAFSIRYEDGSSSQGTVYKDTIGLGGASITNQQFADVTTTSVDQGILGIGFTGDESSPTYDNVPVTLKKQGIINKNAYSLYLNSASASSGTIIFGGVDNAKYTGSLTALPITSSNELRVQLSTINIAGTTVSASTTPVLDSGTTLTYFSQTIADKLAAAVGAKWNSYYQLYTSSCNLAGNIVFNFAKGVTISVPLSEFVLQDGNSCYFGVSRDSATILGDNFLRRAYAVYDLDGNTISLAQVKYTTSSSISTL

SEQ ID NO: 18523 - protein, 179 aa, Chrysanthemum x morifolium
MASISSSAVATVNRTTSAQASMVAPFTGLKSNVAFPVTKKSNDFSSLPSNGGRVQCMKVWPPLGLKKYETLSYLPPLTETQLAKEVEYLLRNKWVPCLEFELEHGFPYRENNRSPGYYDGRYWTMWKLPMFGCNDASQVLKELNECKKEYPQSWVRIIGFDNVRQVQCISFIAHKPDGY

SEQ ID NO: 18524 - protein, 481 aa, Elaeis guineensis
LTFVDLSRNNLSGEIPAEIAGIRILNYLNVSRNHLEGSIPPSIATMQSLTAVDFSYNNLSGLVPSTGQFSYFNVTSFVGNAELCGPYLGPCGFTNSSGSTHARGPLSASFKLLLGHWSPPLFHCLRHRRHHQKLGSFEEGRARPGHGSLTAFQRLDFTCDDVLDWLKEENIIGKGGAGIVFQGCDAQRRTVAVKKLPAINPGSSHEHGFSAEIQTLGRIRHRHIVRLLGFCSNHETNLLVYEYMPNGSLGEVLHGKKGGHLRWDTRYKIAVEAAKGLCYLHHDCSPLILHRDVKSNNILLDSDFEAHVADFGLAKFLQDSGTSECISAIAGSYGYIAPEYATLKVDEKSDVYSFGVVLLELVTGRKPVGEFGDGVDIVQWVRKVTDTNKEGILKIIDPRLSSVPLHEAMHVFYVAMLCVEEQSVERPTMREVVQILTELPGTPAKQGEDPPPPPPVGGETPPRESKPRQEQQSPPPDLLSI

SEQ ID NO: 18525 - protein, 170 aa, Brassica rapa subsp. pekinensis
  misc_feature (18)..(18): Xaa can be any naturally occurring amino acid
GIQSDVAASALVGASNVXGTAVASSLMDKMGRKSLLLTSFGGMALSMLLLSLSFTWKALAAYSGTLAVVGTVLYVLSFSLGAGPVPALLLPEIFASRIRAKAVALSLGMHWISNFVIGLYFLSVVTKFGISSVYLGFAGVCVLAVMYIAGNVVETKGRSLEEIELALTSG

SEQ ID NO: 18526 - protein, 230 aa, Streptomyces coelicolor A3(2)
MTQVVTETMVRVEDVRKSYGRDSAAVHALRGVSFDVPRGELIALKGRSGSGKTTLLNIVGGLDTPDAGRVEVDGRDLAELDEDGLLALRRDRVGFVFQSFGLIPILTAAENVGVPMRLRRAAAREREERVELLLSLVGLADHAAQRPGEMSGGQQQRVAIARALANNPALLIADEPTGQLDAETGHSVMELLRAVVRSEQVTALVATHDATLLDLADRVLELRDGEIVEE

SEQ ID NO: 18527 - protein, 336 aa, Candida parapsilosis
MSIPSSQYGFVFNKQSGLNLRNDLPVHKPKAGQLLLKVDAVGLCHSDLHVIYEGLDCGDNYVMGHEIAGTVAAVGDDVINYKVGDRVACVGPNGCGGCKYCRGAIDNVCKNAFGDWFGLGYDGGYQQYLLVTRPRNLSRIPDNVSADVAAASTDAVLTPYHAIKMAQVSPTSNILLIGAGGLGGNAIQVAKAFGAKVTVLDKKKEARDQAKKLGADAVYETLPESISPGSFSACFDFVSVQATFDVCQKYVEPKGVIMPVGLGAPNLSFNLGDLALREIRILGSFWGTTNDLDDVLKLVSEGKVKPVVRSAKLKELPEYIEKLRNNAYEGRVVFNP

SEQ ID NO: 18528 - protein, 303 aa, Physcomitrella patens
MDQYEKVEKIGEGTYGVVYKARDRLTNETIALKKIRLEQEDEGVPSTAIREISLLKEMHHGNIVRLQDVVHSEKRLYLVFEYLDLDLKKHMDTCPDLAKDPRLIKTFLYQILRGIAYCHAHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRTLGTPNEEVWPGVTSLPDFKTAFPKWPPKPLSSVVPSLEPAGIDLLEVCDLSTPASEFCVVLFFFIISTFSLIVRLKQCMQSYAS

SEQ ID NO: 18529 - protein, 298 aa, Triticum aestivum
FSLKPLVPRLSELLGLEVVMAPDCIGEEVEKLAAALPDGGVLLLENVRFYKEEEKNDPEFAKKLASVADLYVNDAFGTAHRAHASTEGVTKFLMPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADK

SEQ ID NO: 18530 - protein, 298 aa, Triticum aestivum
FSLKPLVPRLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLPVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADK

SEQ ID NO: 18531 - protein, 298 aa, Hordeum vulgare subsp. vulgare
FSLKPLVPRLSELLGLEVVMAPDCIGQEVEKLAAALPDGGVLLLENVRFYKEEEKNEPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADK

SEQ ID NO: 18532 - protein, 299 aa, Zea mays
YSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSSKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFNEALDTTKTVIWNGPMGVFEFEKFAAGTEAIAKKLAELTTTKGVTTIIGGGDSVAAVEKAGLADK

SEQ ID NO: 18533 - protein, 1367 aa, Neurospora crassa
MASELSPRAVRFSQTDDEPIARLDKHKTVSRPNPRANDSDNSNPSTDAHDDLHVREQIDELGSLSRYVESHSGSVPSLVPGSLTSSLPLANGSSSRRGASSETYANGTPSRPQRPTAPARTPSNTYQPYNQRRPPQGQPSSYMANNPHARDGSRPRPLAGTSTFRAQEREYVRRLRQQDYNNDYFDAYGSGEQYDSDSEGETPSSEGAFDSYDDAHIMFASNEDIQITEEDLRDPESRERLEWHGMLEAVLTGDVVRQEKKRLIGSNDEAFGKSAHNVELWLGIRARLCGRHLPVQKRVVEDARAALDRSINDIINFAIAGESEAGKPPFEQVRDVVNKIERIESLYPSSRELMTALKPGVYSAYQETCDAVISWYNVNEMINTELSILKKWVGNDALDFSRTKEKSPSGNGLSDESSFLDRLMKEEGLKSLHEDKGSEPKSLKKKSRLDGISRVITKAKDTLIQNAEGFQKRHLPPYIEELLTLISFPSRLIEEIIKMRLAYAKKMKDSAQQNPMMQDQMISQFQVLLKLAIKIKREYMEIARPEPGWDLPPCIDEDFDRVILEALKYYFKLLNWKLSGNKNTFKEAELLFQEWGFGNEIGRYLAHGDVEVAEQFSSLTYKAWNRLSQTFEKEVQRRPKESVPEMTKRYKQILDSVRVRQRMLQRFSRMLNDNYENACDYTIAFEQPQMLHQLYDRLIETGHFQVYSASPEHKDILIIASPTLHNRDDEIQVLMGTFTYEAAIEDPSDPYLLIIKAEDPPQWLGPVHTLRVRNEPLDIKLGHMRLIAGGCQPRLLNARKAFVDRIDMQVDPVVEQRSNLQKVNFRLMEIRKVAFKLSNAFMDSVEAIRRQTRGLNCQELIQTCFIFATEFGQRSLLYMDNNRRTMNNLKLTKLALDWVSFICDDCISSDRKTFRWAVQALEFAMGMTRGRHILGLGEDEYARLRAKVAGCMALLISHFDIMGARSSVAAQAEKKRLEGLVNQIKRLNKGQMLDDNEAAKYYQEHRLEELAKVDNYRKEILLQQSAMGRVLEASNEVDRSLAWLSSTATNFTMRWQQGHFVGGGTFGNVYAAVNLDTGQLMAVKEIRLQDPKLIPTIAGQIRDEMRVLETVDHPNVVSYYGIEVHRDRVYMFMEFCSGGSLANLLEHGRIEDEQVIMVYALQLLEGLAYLHELKIAHRDIKPENILLDHNGIIKYVDFGAAKLIARQGRTLVQDVASTKPNKSMTGTPMYMSPEVIKGENAGHFGAVDIWSLGCVILEMATGRRPWANLDNEWAIMYNIAQGNPPQLPSQDQLSPEGIDFLRRCFMRDSTKRATAMELLQHEWIMTIRNRVVEPATPSSDAGSSTTSQGALNPGNSSRGGFPGDGMY

SEQ ID NO: 18534 - protein, 483 aa, Arabidopsis thaliana
MSRYLARYMVSRYFSSASSRPLHVCIVGSGPAGFYTADKVLKAHEGAHVDIIDRLPTPFGLVRSGVAPDHPETKIAINQFSRVAQHERCSFIGNVKLGSDLSLSELRDLYHVVVLAYGAESDKDLGIPGESLSGIYSAREFVWWYNGHPDYSSLKPDLKTSDSAVILGQGNVALDVARILLRPTTELASTDIATHALSALKESSIRKVYLIGRRGPVQAALTAKELREVLGIKNLHIRIKQTDLSVTPADEEEMKTSRARKRIYELLSKAAAAAKTSEADPDQRELHFVFFRQPDQFLESDERKGHVSGVNLQKTILESVGTGKQIAVGTGEFEDLNCSMVLKAIGYKSVPVNGLPFDHKKGVVPNVKGRVVSHTSGDISQTEPGLYVCGWLKRGPVGIIATNLYCAEETVGSISEDIEEGVWKSSKAGSKGLMQLLEKRKVKKVEFSGWEKIDAKEKQMGIERNKPREKLVTWEDLLAAAAN

SEQ ID NO: 18535 - protein, 450 aa, Streptomyces carzinostaticus subsp. neocarzinostaticus
MNGRRPVSPPLRALPGLLRKLAVDRLGMMRDAAALDDAVLVSMGPKKLFVFNRPDYAKHVLADNAANYRKGIGLIESRKMLGDGLLTSEGELWREQRRTVQPAFRPARVAAQADAVAEETMNLRDLLMRRGADGPVDVLQEVTGFTLGVLGRTVLNTDLGGYGGIAHAFEAVQDQAMFDMVTQNMVPTWAPLATQRRFRRARRELIRTVDELVADRSARMTDGEEADDAFSLMIAAARRQTDPRTGQGRLRDELVTLLLAGHETTASTLAWTLLLLARHPHMRDLVREEARGVLADGRAPDAGDLRKLTYTTQVVQEAMRLYPPVWILPRVARQSDEVGPYSVSAGADVLICPYTLHRHPDLWERPEQFDPGRFDPARVADRPRYAYIPFGAGPRFCVGSNLGMMEAVFVTALLTRDLVLEVVPGDERTPEPMMSLRMRGGLPMTVRPVR

SEQ ID NO: 18536 - protein, 370 aa, Streptomyces hygroscopicus
MTDAATSHTELVSGLIGDRADAWDLAGELPRDLLVKLGASGVLCAQVGAEHGGTGLDSHANGELTAAVGARCSSLRSVMTSQGMAAWTVRRLGGAEQWGTFLPRLTSGDLAAVGFSEPGAGSDLAAMETEIADDGTHVVVTGRKVWITAAHYADLLVVFGKYRGGAAAVVVPAQAPGVRITRVPDPLGCRAAGHADITLDAVRVPAGHVLGGTGLPLPLATTAALTYGRMSVAWGCVGILRACLDAAATHTASREQSGRKLAEHQLVARHLAELYVAERHATRACEHASASWDTGSPDMAVDAVHAKYVASREAAEGAARAVQLLASAAASDGHVVARAYRDAKLMEVIEGTSEICQLVLAQHTRKKVQA

SEQ ID NO: 18537 - protein, 285 aa, Brassica oleracea
STEANKAAISILVRNLAHGSELAAGEIRVLTRTVTETRTLIVEAGAIPYLRSLLKSENAVAQENAVASIFNLSIDEANRSLIMEEHDCLEPIMSVLVSGLTMRAKEIATAALYTLSSVHDYKKTIANADGCIESLALVLRNGTVRGKKDAVYALHSLWLHPDNCSLVVKRGGVSALVGALGEESVAEKVACVLGVMATESLGAESIGREETVVTGLMELMRCGRPLGKEKAIATLLQLCTLGGAVVTEKVVKTPALAVLTRKLLLTGTDRAKRKAVSLSKVCKGC

SEQ ID NO: 18538 - protein, 104 aa, Brassica rapa subsp. pekinensis
YSSMFHPFNGSMDAEERRHISSTTEHSAIDNHCSANSSSVGRTQQSLQREAALNKFRMKRKDRCFDKKVRYESRKKLAEQRPRIKGQFVRQVQSTETSTQEAPQ

SEQ ID NO: 18539 - protein, 208 aa, Oryza sativa (indica cultivar-group)
MASYHQQQGGSTFMAIPTINFQMYSEIAGDDEWWEYIPCPFCYIEVEVPFLCDHLQEEHCFDMKNAVCPICADNLDKDTDEHFRVQHSHLLKRRKSSSFSCKPSSAAADKGSYEEDSYFEAPSHCMGRPAPDSSPDPLLSQFICCSLAPPVDSPRRSEADAEGHGSSSSDDQKRREQGVMDDASKEELEERLQRIEFVKQMLMTTIAY

SEQ ID NO: 18540 - protein, 466 aa, Sinorhizobium fredii
MSKRFRSRSAARAARHRLRRGEQDMSNRLNTTPNDLSAFWMPFTANRQFKKEPRLFVGAKDMYYTTHDGRTVLDGTAGLWCVNAGHCRPKITEAIREQAGELDYAPAFQLGHPKAFELANRLVDIAPEGLNHVLYTNSGSESVDTALKVALAYHRAKGNGSRFRLIGRERGYHGVNFGGISVGGIVANRKMFGTLLTGVDHLPHTHLPAKNAFTRGEPEHGGDLASELERIVTLHDASTIAAVIVEPVAGSTGVLIPPKGYLQKLREICTKHGILLIFDEVITGYGRLGTPFAAQYFDVKPDIITTAKGLTNGVIPMGAVFVTSEIHDAFMTGPEHLIEFFHGYTYSGNPIASAAALGTLDTYKEEGLLTRAAELASYWEEALHSLKDCPHVIDIRNIGLIGAVELEPIAGEPTKRAFSAFLKAYEKGLLIRTTGDIIALSPPLIIEKKQIDELIDKLRDVLKNNI

SEQ ID NO: 18541 - protein, 358 aa, Cryphonectria parasitica
MAEFVRAQIFGTTFEITSRYSDLQPVGMGAFGLVCSARDQLTNQNVAIKKIMKPFSTPVLAKRTYRELKLLKHLRHENIISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLASKFKNADEQAVDLLERMLVFDPKKRITASDALAHEYLAPYHDPTDEPVAEEKFDWSFNDADLPVDTWKIMMYSEILDYHNVDASGASAAMGEFNGQ

SEQ ID NO: 18542 - protein, 368 aa, Xylella fastidiosa Temecula1
MSQREWVASSICKIEADFNRSVDTHLIPLQLPGFPDIDFYLKDESIHPTGSLKHRLARSLFLYALVNGWLSPGRPVIEASSGSTAVSEAYFARLLGLPFIAVIPTSTSPEKVAAIEFHGGRCHAVERACDLHDAAHQLARETGGHFMDQFTYAERATDWRANNNIAESIFKQMADEPHPIPAWIVCSPGTGGTAATLGRYVRYRRHVTRILCADPEISVFFDHYRAACKGSDHRNSVTDTGGSRMEGIGRPRLEPSFIHNCIDAMIKVPDALSLAAMRYISARLGRRVGGSTGTNMVGVLQTAARMRAEGMKGSIVTILCDGGERYAHSYYSPAWYAAHGIDVSDSDAVIAAVVAGDTLPLLPCAALE

SEQ ID NO: 18543 - protein, 285 aa, Xylella fastidiosa Temecula1
MTTNDTWFTEHFQTTGSAIGFRVTGKLDEVQSPFQKIEIYNSTDWGKLMVIDGALMLTSRDNFLYHEMISHPALFTHTAPKCVVIIGGGDCGTLREVLKHPDIEQVTQCDIDEQVTRMAEKHFPELCTSNNDPRATLLFSDGVAYMADCPTNSVDVIIVDSTDPVGPAKGLFNRTFYESCFRALKNDGLLIQQSESPLALLELIKEMRHEMSKAGFKAFKTLPFPQPCYPTGWWSVTLSSKQPNANFAFRQTDAQTKPFDTLYYNAHLHHGVLVPPPFIAHALGE

SEQ ID NO: 18544 - protein, 486 aa, Xylella fastidiosa Temecula1
MMHHNVHQSEILADPCDLQRAERWRQRDLRVLWHPCTQMREHPDTLPLVPIVRGEGVWLVGHDGRRYLDAVSSWWTNLFGHADPRISAAIAAQARTLEHVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEALFKRYSGQICALILEPLLQCAGGMRMHHPVYLHRVRELCDAHGALLICDEIATGFGRTGTLFACEQACSAISTDTDDKDLGIMPDLLCLSKGLTGGFLPLAAVLTTQQLYEEFLDDSRERAFLHSHSYTGNPLACIAALTTLDIFENDCIIERNQVTAARMTQLAASLSGHPHVADVRQTGMVVAFELTRDGNKRTPFPPQARLGLHVYRAALARGVILRPLGDVVYWMPPYCVDEQQLHLLAETTRVAIDEAIACV

SEQ ID NO: 18545 - protein, 223 aa, Xylella fastidiosa Temecula1
MSNCLIAPSILSADFARLGAEVDAVLAAGADWIHFDVMDNHYVPNLTFGPMVCKALRSYGITAPIDVHLMVEPVDRIVPDFAQAGASMISFHMEASRHVHRTIQLIKSHGCMAGLVFNPATPVDMLDWVLPELDLVLLMSVNPGFGGQRFIPGTLDKLRLVRKKIDLLGRPVRLQVDGGVGIDNIGAIAEAGADTFVAGSAIFHARDYADVVAQMRAAVAAVR

SEQ ID NO: 18546 - protein, 502 aa, Xylella fastidiosa Temecula1
MHNGFDALQLHANRLRGVTIPDLLAAELKRPEQYARQVGPLYFNFARQKYDCVALEALFALARNHNVTGAFQRMFCGEQVNVTEGRAVLHTALRGDLSGTSVAVAAYTAAAKVRERMYALIAGLDASEVTDIVSVGIGGSDLGPRLVVDALRPISQGRFRVHFVSNVDGAAMRRTLDMLDPSRTAGILISKTFGTQETLLNGRILYDWLGGSERLYAVTANPERAANAFDIVPTQVLPIWDWVGGRYSLWSAVGFPIALAIGSQRFEELLAGAAEFDAYALRVPLEENVAVLHGLTAVWNRNFLGCATYAVMAYDQRLALLPTYLQQLVMESLGKRVKCDGTPVDRDTVPVWWGGVGTDVQHSFFQALHQGTNIVPADFIGTIRNDDLYTENHFALNANLLAQIEVLANGQLSDNPHRVYPGGNPSTLILLDALTPQALGGLIAMYEHSVYVQSVIWGINAFDQFGVELGKHLAVQLLPALKGESVEVADPVTRAVLLRLRG

SEQ ID NO: 18547 - protein, 467 aa, Xylella fastidiosa Temecula1
MNDILPVILSGGSGTRLWPLSREAYPKQFLPLVGHHSMLQATWLRAAPVTTHSPIVVANEEHRFIAAEQLQHLGVYPSAILLEPTGRNTAPAIAVAALEATRTGNDPLLLVLPSDHVIRDETAFQTAVHVAAAAAAQGKLVTFGITPNTPEIGYGYIKATGNDTIRPVERFIEKPDLATAQSYLASGDYFWNSGMFLFRASRYLAELSTFQPAIAEACQRAWSAAKRDTDFIRLDKEAFESSPADSIDYAVMEHTADAVAVPLDAGWNDVGSWSALHEVSKQDNDGNAHQGDVIQIDCRNTYAYGSRLIAMVGLENVVVVETDDALLVGHRDSIQTVKEIVGKIKANGRPEATWHRKVYRPWGAYDSIDTGQRFQVKRITVKPGGTLSLQMHHHRAEHWIVVSGTAEVTRGSEILLLTENQSTYIPLGVTHRLRNPGKLPLELIEVQSGSYLGEDDIVRFEDTYGRT

SEQ ID NO: 18548 - protein, 187 aa, Xylella fastidiosa Temecula1
MRLVLLGPPGSGKGTQAAQMQETLQIPHISTGDLLRSEVVAGTPLGLQAKQVMAQGDLVSDAILLGMLESRLSHTDVVKGFILDGYPRNLSQAAALDGLLAKFGHPLNAVVQLEVPTDVLVERIAGRAQAEGREDDTPDAVRKRLQVYNDSTAPVIGFYQQRGILLRVDGVGRLDEVSQRIAVALGC

SEQ ID NO: 18549 - protein, 249 aa, Xylella fastidiosa Temecula1
MRPKIVAGNWKLHGSHAFAQALVAQVAAGLPLPGVSVIILPPLLYLSDLAQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 18550 - protein, 352 aa, Xylella fastidiosa Temecula1
MNVMGFAALSATGPLERFAFGRRAPRPDDVVIDILYCGVCHTDLHLARNHSGFTTYPIVPGHEIIGCVREIGKTVTRFKRGDLVGVGCMVDSCQHCQPCLKGWEQDCIEGSTFTYNSIDRRDGSITYGGYSDVIVVRDKFVLLLPDGLDPAGAAPLLCAGITTWSPLRRWNVGKDSKVAVVGLGGLGHMALKLAKALGADVTLFTRSSGKEGDAFRLGADRVVLSSDLEQMKAVYSRFDVIIDTAPYDHDVNPYMPTLVLEGVLVLVGYMGPLSTPVNAGGVVRGRRAISGSFIGGVPETQQMLDFCGQHGIVSDVEIIPIQKINEAYERMLKSDVKYRFVIDMTSLTSSGA

SEQ ID NO: 18551 - protein, 430 aa, Xylella fastidiosa Temecula1
MTVIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGTEIFHALKSVLKGQGLSTAVGDEGGFAPDFRSNVEALDAILEAIGRAGYIAGEDVLLGLDVASSEFRNNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 18552 - protein, 279 aa, Xylella fastidiosa Temecula1
MKLMSKITTHPIAAEHKEANLAIRVRGLINHFGTQTVHDGLDIDVHRGEILGVVGGSGTGKSVLMRTILGLHTPNAGSIEVLGVNPHSQSSEDRRIIARNTGVLFQDGALFSSMTVGENVQVPMKEHHGEFPKRLYYELALLKIKLAGLPANALDKLPSQLSGGMRKRAGLARALALDPPLLFLDEPTAGLDPIGAASFDQLIKTLQKALGLTVFLITHDLDTLYTICNRVAVLAERKVIANAPLAEIENIDHPWIREYFHGPRGRAARTAQHTSTGSS

SEQ ID NO: 18553 - protein, 348 aa, Xylella fastidiosa Temecula1
MGIRIQELRKQFEDFTALAGIDLDIRQGELLALLGPSGSGKTTLLRIIAGLEHADAGRVLFGDEDATTMSVQARRVGFVFQHYALFKHMSVYENVAFGLRVRRGKARWPESQISARVFELLSLVQLDGLEQRYPMQLSGGQRQRVALARALAIEPRVLLLDEPFGALDAQVRRDLRRWLREIHDRTGLTTVFVTHDQEEALELADRVAILNQGGIEQVASPDEVYNRPSSPFVYSFVGAVNRLPGCVGADGLEVAGIVLSCPPQLSGWGAVDLYVRPEDLVLDAQEGWSAIVLWSQRSGPRMRVRARLEHSAHEVEIELSSATDEYVEGQKLRLIPRHYGVFFSESGS

SEQ ID NO: 18554 - protein, 268 aa, Xylella fastidiosa Temecula1
MHRIDETFRRLRAQSRKALIPFITAGDPSLEAAVPVMHALVRAGADVIELGVPFSDPMADGPVIQHSSERALQRGVGLAYVLQTVDVFRQSDAVTPVVLMGYLNPLEIYGIARFTQQALASGVDGVLLVDLPPEEADEIRAIFSAAGLALIVLASPTTSASRLATLSGVAQGYLYYVSFAGVTGADRLDAQSAGDRLRGLRAQTQVPVVVGFGIRDAASAVVMAVDADGVVVGSALVTALSDAPDVDTACRRADAFLAPLRQALDAVK

SEQ ID NO: 18555 - protein, 463 aa, Xylella fastidiosa Temecula1
MTKNAASKARIAYVCTECGTEYSKWQGQCTECGTWNCLSQITLGNAGSVKNPTMKHGNWTGQLDPPKITALKDVQHSEQARISTGIGEFDRVLGGGLVAGAVVLIGGDPGIGKSTLLLQALARMASNLPTLYVTGEESLAQVAGRAVRLDLPLEGLNALAETGIESILQHASSARPRLIVADSVQTLWTEALTAAPGSVSQVRESAAQLVRYAKETGTTVFLVGHVTKEGGIAGPRVLEHMVDAVLYFEGESGSRFRLLRAFKNRFGAVNELGVFAMSEKGLKEVANPSAIFLSGRNSDQPGSCVMVTREGTRPLMVEVQALVDTSPLSNPRRVTVGLEQNRLAMLLAVLHRHGNVLVGDQDVFINIVGGIRVQETAADLPVLLAVRSSLCNRALPEKTIAFGEVGLSGEIRPVPNGEERLREAATHGFKHAIVPKANAPKSAIKDMQIIAVERLDQALEASY

SEQ ID NO: 18556 - protein, 411 aa, Xylella fastidiosa Temecula1
MSAVSESVLSLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWAAAQGRLPEHRTIVTFRGSFHGRTLGAVTATAQPKYQEGYEPLPGGFRYVDFNHIEALEAAMVGGDVAAVMLEPIQGEGGVMPIAPGYLAQVRALCDRYGALLVLDEIQCGMGRTGTLFAYWQEEVVPDIVTLAKGLGGGFPIGAMLAGPKVAEVMQFGAHGTTFGGNPMAAAVARVALRKLASVEIAANVQRQSVALRAGLEEISEAFGGVFTQVRGRGLMLGAVLAPLYAGQASAILEVAAEHGVLLLQAGPDVLRFVPALNVSDEELADGLVRLRAALGDYVSRCRG

SEQ ID NO: 18557 - protein, 478 aa, Xylella fastidiosa Temecula1
MSEHYDVVVIGAGPAGYHAAIRAAQLGLKVACVDAALGKDGKPALGGTCLRVGCIPSKALLDSSRQYWNMGHLFNEHGISFKDAKMDIATMIARKDKIVKQFTGGIAMLFKANKITPYYGFAQLQPGNVVKVKQHEGKNIELKGANVILASGSDSVELPFATFDGETIVDNIGALDFTKVPKRLAVIGAGVIGLELGSVWKRLGAEVTILEAMPNFLAAVDADVAKTAAKEFKQQGLDIKLGAKVSRTEISSKNNKKEVIVTYTDASGKQTLTVDKLLVAVGRKAATKGLLADGTGVQLNERGQIVVDEHCHTGVDGVWAIGDCVRGPMLAHKGFEEGIAVAELIAGLPGHVNFETIPWVIYTEPEIAWVGKTEQELKADNIPYKAGSFPFAAVGRAVAMAEPSGFAKVLAHAETDRVLGLHLIGVNVSELVHEGVLAMEFSGSADDLARICHAHPTLSEAIHDAAMAVSKRSIHKAN

SEQ ID NO: 18558 - protein, 249 aa, Xylella fastidiosa Temecula1
MTRKLVLLRHGQSQWNSMNRFTGWVDIGLTEQGHQEATMAGHLMKKEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVRESLKNTLERVLPYWNDAIAPQLNDNKTVLISAHGNSLRALYKYLNKESDEKILNVNIPTGIPLLFELSDTLQVVSYRYLGDPDAAQRAAEMVANQGKAK

SEQ ID NO: 18559 - protein, 168 aa, Xylella fastidiosa Temecula1
MSSIYTFTFTRLDGRPQALADWRGQVLLLVNVASRCGFTPQYAGLEMLWQRYRDAGLIVIGFPCDQFAGQEPGDEAKIAEFCTLTYGVDFPMAAKIKVNGADAHPLWQWLKHRRRGLFGVAAIKWNFTKFLIGRNGQPIARYSPIKSPEQLEVHIVRALGEEGGGNTH

SEQ ID NO: 18560 - protein, 469 aa, Xylella fastidiosa Temecula1
MSLENVEKLVKDKKIEFVDLRFVDMRGVQQHVTFPVNILEQSLFKDGKMFDGSSIAGWKGINESDMVLLPDASTAYLDPFYADPTLVMTCDILDPATMQSYVRDPRGIAKRAEIYLNSLGIADQAFFGPEPEFFIFDSVRFANDMGHAFFQIASEEAAWNTGAEFEGGNSGYRPTVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGSVMSDDFINGYIALKMQEVTQFRAATHPLEYQMYYAN

SEQ ID NO: 18561 - protein, 338 aa, Xylella fastidiosa Temecula1
MSVALSIDLSKKKTILCFGEALIDMLAQPLVKKGMPRAFLQCAGGAPANVAVAVARLGGAVQFVGMLGSDMFGDFLFDSFAEAGVVTDGIVRTSTAKTALAFVALDAHGERSFSFYRPPAADLLFRVEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGEVPTFRVQVQDSNAAGDAFVGGMLYTFAQQFDDAAALIDFCHDPESIVSTLRFAAAVGALAVTRQGAFTAMPMLSEVLSLIQEQS

SEQ ID NO: 18562 - protein, 232 aa, Xylella fastidiosa Temecula1
MISEEVAQTTDTALRAMLAARSGQQEASGTAPPAVSKENIGLMLGSYMVGPSLLAIKDDIDLPVLLQALRTRFAKRTPLMDEQEMTTRMQAFVASKNAVVAGKNRDEGSAFLSKNKNEKGVVTTASGLQYMVLRQGSGSRPTPSNNVRVNYEGKLLSGQVFDSSYQRGQPAEFGLGQVIKGWSEGLSLMPVGSKYRFWIPADLAYGQQGTPGGPIGPDATLTFDVELLSILP

SEQ ID NO: 18563 - protein, 192 aa, Xylella fastidiosa Temecula1
MNMLNVLRFPVLALALAFVSSGVLADVGSLLDLDYRPLAGKETVNLQRLYGGKVLLVVNTASKCGFTPQYEGLEALHQKLSPLGFAVLGFPSNDFKGQEPGDEQQIQEFCTLTYGVKFPMFQKVHVKGNEVTPLYQRLTQTTGVAPGWNFHKYLIARDGHVVAQFDSRTRPDDPILLEAIKRELAKSVQVVH

SEQ ID NO: 18564 - protein, 413 aa, Xylella fastidiosa Temecula1
MPPTKTSFPKQDIRILLLEGVSHSGIETFRAAGYSQIKIHTTSLPEEALQAEIAEAHIIGIRSRTQLNAAVLGHAKRLMAIGCFCIGTNQVDLDTAELSGIPVFNAPYSNTRSVAELIIAEAILLLRRIPQKNAECHRGGWSKSAINSHEARGKVLGIVGYGHIGTQVSVLAEAMGMQVIFYDIESKLSLGNARPAASLDELLGIADVVTLHVPETAATKNMLGHAELARMKPGAHLINASRGTVVEIDALDAALVSGHLGGAAVDVFPSEPKGNSDPFISPLSRHDNVILTPHIGGSTLEAQDNIGIEVAAKLIRYSDNGSTLSAVNFPEVSLPEHVGSMRLLHIHRNVPGVLSHINELFSRHNVNIDGQFLRTDATLGYVVIDIGASQTQALALKEALTQVPGTLRTRLLY

SEQ ID NO: 18565 - protein, 206 aa, Xylella fastidiosa Temecula1
MCNEPATSDVALPDLDWAKGDGLLPVIVQDADTLRVLMLGYMNSQALEVTQRSRLVTFYSRSKQRLWTKGERSGHVLHLVAIDADCDADTLLVQARPRGPTCHLGRTSCFPAAPGQFLGALDALVAERERERPQDSYTTALFEQGVRRIAQKVGEEGVETALAGVVQADDALLDESADLLYHLIVLLRARGLSLADAVTVLEARHR

SEQ ID NO: 18566 - protein, 275 aa, Xylella fastidiosa Temecula1
MNRKMFGELISEAIAMFIIIALGESAAAMYILYDPSPYQNAYWGLCICWGLAVTIAIYVTASVSGTHANPAVTLALALYRGFPWKKVLPYWAAQVIGAFIGAMIVYQLYSPVIDYYNHIHQLTRDAGGAAGVFFTSTGMAITPIHALGDEIILTAFLVFGIFAITERFNEAAPTANSGALVIGLLVATIGACMGYLEGWAINPARDLGPRLFAFLAGWGESAFPGKDHYWWIPIIGPLIGGVMGATAFQCLIYPFLPARVQAKQQAAILLHRKHP

SEQ ID NO: 18567 - protein, 444 aa, Xylella fastidiosa Temecula1
MNHSRSHALFVQAQTRIPGGVNSPVRAFRSVGGEPFFVARADGPYLFDVDGHRYIDYVGSWGPMIVGHNHPAVREAVQVAISNGLSYGAPCAAEVTMAETIARLVPSCEMVRMVNSGTEATLSAIRLARGATGRNYIVKFEGCYHGHGDSFLVKGGSGMLTLGIPSSPGVPAELSKLTITLTYNDFDAATALFEEMGHHIAAVIVEPVIGNANCIPPQPGYLQHLRTLCTQYAVLLIFDEVMTGFRVALGGAQALYGVTPDLTTFGKIIGGGMPVGAYGGRRDLMQHIAPTGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPNIIETTLEAARTAFQTIANEAAILSKSETPIKMR

SEQ ID NO: 18568 - protein, 349 aa, Xylella fastidiosa Temecula1
MFINAYGAHAGDKPLESMQIARRAPGAHDVQIDIHYCGVCHSDIHQVRAEWAGTLFPCVPGHEIVGRVSAIGTHVQGFKAGDLVAVGCMVDSCKDCQECDAGLENYCDGMIGTYNFPTQDAPGHTLGGYSQKIVVHERFVLRIRHPEAQLAAVAPLLCAGITTYSPLRHWNAGPGKKVGIVGIGGLGHMGIKLAHAMGAYVVAFTTSESKRQDAKALGADEVVVSRDEERMAAHVKSFDLILNTVAASHSLDPFLTLLKRDGTLTLVGAPVTPHPSPEVFNLIFKRRSIAGSLIGGIAETQEMLDFCAEHGIVADIELIRADGINEAYERMMKGDVKYRFVIDNATLAA

SEQ ID NO: 18569 - protein, 485 aa, Xylella fastidiosa Temecula1
MLRILAEALTYDDVSLVPSHSTVLPKDVKLETRLTRNIRLKLPILSAAMDTVTEARLAIVMAQLGGIGIIHKNLTIEQQVAEVTKVKKYESGVIRDPITVDPETSIRDVLALTRAKNISGVPVVDKGQLIGLVTHRDMRFERELDDPVRHIMTKKEALVTVKEGADSQEVLQLLHKHRIEKILVVNDAFELRGLITVKDIQKKSDYPNAAKDAVTRLLVGAAVGVGGETEKRVETLATAGVDVIIVDTAHGYSQGVLDRVAWIKRYFPQLQVIGGNIVTGDAALALMDVGADAVKVGVGPGSICTTRMVAGVGVPQITAVQMVSDALQDRIPLIADGGIRYSGDIGKALAAGASTVMIGGLFAGTEEAPGDVELFQGRTYKSYRGMGSLAAMEKGSKDRYFQEASDVDKLVPEGIEGRVPYRGSVSGIVHQLMGGLRATMGYVGCATIEEMRTKPQFVKITGAGQVESHVHDVQITKEPPNYRMR

SEQ ID NO: 18570 - protein, 456 aa, Xylella fastidiosa Temecula1
MVIHSSVLELIGNTPIIKAQRLDTGLCDLFLKLESANPGGSIKDRVGLSMIEAAECRGHIKPGATLVDGAASSTSMGLAFVARQKGYRLILVVPDNMAWEKISNLKAMGAEVILTRSDVSKGHPEHYQDLAEKLAAETPGAYFINQFGNADNPAAHEFGTGPEILKQMGGHVDAVVLGCDSAGTITGLSRAFDSVASDVELILADPVGSILTQYINEGTRSDKSGTWLVEGIGSDCLPPISDFRRIKKTYAISDAESFHTARELLSKEGILGGSSTGTVLAAALKYCREQIEHKRVLVFVCDTGNKYLLNMYNDDWMLDNGFLKRPHYGDLRDLILHPYSQRHTVVVDPNDLLTVAYQRMKRYGVSQLPVIEDRQLVGILDESDVLLHVYGDETRFCDPVSTAMVSKLHRLDVKSPIEALLPVFERGQVAIVMEDDQFLGLITRIDLLNYLRRRIQ

SEQ ID NO: 18571 - protein, 264 aa, Xylella fastidiosa Temecula1
MILPTPAVQLSGVRIERGGRTVLSNVALQVPRGSITTVLGPSGSGKSTMLAALTGELRPTEGEVRLFGDGIPQGTQALLEMRRNLGVLLQGNGLLTDLSVAENVALPLRAHTRMPEPLLQRLVLMKLHAVGLRAAAEAMPRELSGGMARRVALARALALDPPLMIYDEPLTGLDPIASGVIVSLIKRLNDSLGLTTIIVSHHVHETLPICDQAVVIANSTVIFAGTPAQLEASNDALVYQFMHGQPDGPIPFDAAPRTSERSSA

SEQ ID NO: 18572 - protein, 190 aa, Xylella fastidiosa Temecula1
MIDPDGYRPNVGIVLIRRDGQVFWGRRVRRDGWQFPQGGMHSDETPVEAMYRELNEETGLLPEHVQLVGATPGWLRYRLPSQAVRCNRSQMCIGQKQVWFLLQLIGDESHVQLDQSENPEFDHWRWVSFWYPIEHVVMFKRSVYARALCQLASLAQQVVGLEVGTMPQYVQDICLLNVGYKHLPNWVSRY

SEQ ID NO: 18573 - protein, 402 aa, Xylella fastidiosa Temecula1
MKLTDLSNPAFLENPYPLYETLRAQAPFVSIGPNALMTGRYSLVDSLLHNRNMGKKYIESIRLRYGDTAADMPLFQAFSRMFITINPPAHTHLRGLVMQAFTGRESESMRPLAIDTAHQLIDNFEQKPSVDLVAEFAFPFPMQIICKMMDVDIGDAVTLGMAVSKIAKVLDPSPMSADELVHASTAYEELAQYFTKLIELRRTHPGTDLISMFLRAEEDGEKLTHDEIVSNVIMLLIAGYETTSNMIGNALIALHRHPEQLALLKSDLSLMPQAVSECLRYDGSVQFTMRAAMDDIEVEGELVPRGTVVFLMLGAANRDPAQFTHPDQLDITRKQGRLQSFGAGIHHCLGYRLALIELECALTTLFERLPHLRLAHLDALNWNQRSNLRGVNTLIVDLHAKN

SEQ ID NO: 18574 - protein, 321 aa, Xylella fastidiosa Temecula1
MHYRRLGSTGLQLSVLSFGTWVTFGNQVARDEARNLVACAWDHGVNFFDGAETYAQGRAEQVLGDVIADLRLPRDGYCVSSKVFFGAVNEPRPTQCGLSRKHVHDACHAALKRLRVDYLDLFFCHRPDADTPIEETVRAMTTLIRQGKVLYWGTSEWSAAQIAEAIAIASREHLERPWVEQPQYNLLHRERVEREYVSLYAQGLGTTIWSPLASGLLTGKHNVGVASGSRLVQPGYEWLQRQVLGEGEARLVQARRFSEVAADLGQLPTQLAIAWCLRNPHVSTVILGASRVAQLKENLQALQVVAALDAAAWRCVEAAME

SEQ ID NO: 18575 - protein, 319 aa, Xylella fastidiosa Temecula1
MTIYNTILDTIGHTPVVKLNRIAPAHVDLYIKVESFNPSGSVKDRLALAIILDAEQQGLLKPGDTIVEATSGNTGVALAMIAAARGYTFVATMVETFSIERRKLMRAYGAKVILTPAAERGSGMVRKAKELAQQHGWFLASQFSNPANPAYHRNTTAAEILRDFAGRRLDHFVSGWGTGGTLTGVGEVLKIARPDIKITASEPASAALLQGKEWQPHKIQGWTPDFVPEVLNRSVPHHILSVTDDDAITVARRLAAEEGVFSGISGGASVATALQIAQQAEPGAVILAMLPDTGERYFSTPLFADINEHSDDAWLASLG

SEQ ID NO: 18576 - protein, 334 aa, Xylella fastidiosa Temecula1
MSIEQLAETAQAMVASGKGIIAIDESAGTIAKRFSSVGIENIEENRRAYRELLLTTPKLSDYISGAILFDETIRQSTKAGVPFPKYMAEHGIIPGIKVDKGAYPLAGCPGELVTEGLDGLRARLEEYYKLGARFAKWRAVINIGDDIPSGMCIDANVHALARYAALCQEQGLVPMVEPEVIMDGNHDISAAYEVTEATLRSLFNALYEQNVVLEGTILKASMVIPGTDCEEQASIDEVAESTVMCLKSTVPAILPGIVFLSGGQTDAQSTAHLNAMNQFDPLPWPLSFSYGRAMQQAALKLWSQDMKGNFAKAQQVVYERAKENGLAALGKWKG

SEQ ID NO: 18577 - protein, 488 aa, Xylella fastidiosa Temecula1
MSERQRRTRILATLGPATDPPGVLDALFKAGVNVVRLNFSHGDVSDQARRVAEVRAAAAHVGVEIGILADLPGPKIRIGRFTGGKVRLVAGARFDLLADSNASLGDTTQVGVSYLGLPQDVAAGDVLLLDDGLMQLQVVQVQGARIVTTVLNDGVLSDRKGLNKQGGGLSLGALTDRDRELIGIVARMGIDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPIPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGCVSGLWEL

SEQ ID NO: 18578 - protein, 391 aa, Xylella fastidiosa Temecula1
MSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLKHPVKPLLAIVGGSKVSTKLELLSNLVNNVEQLITGGGIANTFLAAAGYPIGKSLYEADLIETAREIITVAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 18579 - protein, 496 aa, Xylella fastidiosa Temecula1
MSAPFALYDTAAAAALDARLAAHLGDDGDLLMQCAGRAAWDLLRQRWPDARQVLVACGTGNNGGDGYVLACLAHRAGLQVQVVHLPGCGPASLLAQRAYDAYLAAGGQVMLFSGVLETADVLVDALFGIGLNRPLDVPTQGLINALNAAGRPVLALDVPSGVDAERGAVFGTPVCAHVTLQFMVPHVGLYTGPALDAVGERVLAALDVPPALRDALPPCAERWGPQRLASLFRSRRRNSHKGEFGRVLCVGGNWGSGGAIMLSAEAALRSGAGVVHVATREAHVAPLLARCPETMPRGVAGSAELMPLLTAADVVALGPGLGQDSWGQALLAATLDSGCALVIDADALNVLAAAPGPLPPGAILTPHPGEAGRLLGCTTAQVQADRRAAAQALAARFAAVVVLKGAGSLIAAPGCLPCVIDAGNPGMAVAGMGDVLTGVIAALRAQGESAFDAALFGALLHAAAGDQVARDGGERGLLPSDVLPVLRRLINPDSAP

SEQ ID NO: 18580 - protein, 448 aa, Xylella fastidiosa Temecula1
MISRFGSEVRPTLLLALPLVLGHVSTGLIGFVLNVIAGHHSTVTLAASTIGTALLWLPMLVPMGTLISLTVLVSQLHGAERERDIGPLFRQALWLAMLLGLVMFTFLSVVPALLPLFGIVPDIVPGAAKFLHVVRWGSLAFPLYFCMRYFCEGMHCTFPTMLLGFGGLLVLVPLSYALTYGRFGFAEYGVEGLGIATVTVMWLQAVVFALYLWRSRRFAHLQLFAHLELPCWARIRDLLNIGLPIGISILMEGGLFIVTTLLIGRFGTDEIAAHQIALSVAQLCFMIPMGVAEATTVRIGHAVGRCDLLVMRRVAWAGYAIVIGTQTLSASVLLLGYDVIVAAYTDDLVVASLASKLLLFAAIFQFPDGLQMLSSGVLRGMKDTRVPMLLAMISYWGLGMPLGLGLGFALEWNSRGMWIGLIIGLTAAALLLGWRFRVVSERMFAGIP

SEQ ID NO: 18581 - protein, 494 aa, Xylella fastidiosa Temecula1
MSRKHAFQFLDLPRQMPQRIPVELRTSGDWRELYGKFDKGEAQYQAGRCLDCGNPYCSWKCPVHNAIPQWLQLVQENRIDEAAALCHATNPLPEVCGRVCPQDRLCEGSCTLEEFGAVTIGAVEKYIVDTALQQGWRPDLSHVQPTGWRVAVVGAGPAGLACADRLARAGVQAVVYDRYEQIGGLLQFGIPSFKLDKAVMSTRRQVLEGMGVEFRLGVEIGKDLGIEALLEDYDAVFLGVGAYRYTDGGLPGQDLKNVLPALPFLVQNGRIISGNDPYGRPIAGWEDQVQLPDVAGKSVVVLGGGDTGMDCVRSAIRLGATKVTCIYRRDEANMPGSAREVANAREEGVRFLFNRQPLSIQSGTDKQAIGVTVVETKLAEPDANGRRNAVPIQGTEAVLEADVVIIAFGFSPMLLEWLTAQGVQASSNGRIVVALSDTGDRLTYQTTHPKLFAGGDCVRGADLVVTAVAEGRDAAESIVRWLRATAQVMDVAVI

SEQ ID NO: 18582 - protein, 177 aa, Lycopersicon esculentum
MPRERDPLVVGRVVGDVLDPFTRTIGLRVIYRDREVNNGCELRPSQVINQPRVEVGGDDLRTFFTLVMVDPDAPSPSDPNLREYLHWLVTDIPATTGSSFGQEIVSYESPRPSMGIHRFVFVLFRQLGRQTVYAPGWRQNFNTRDFAELYNLGLPVAAVYFNCQRESGSGGRRRSAD

SEQ ID NO: 18583 - protein, 175 aa, Lycopersicon esculentum
MPRDPLIVSGVVGDVVDPFTRCVDFGVVYNNRVVYNGCSLRPSQVVNQPRVDIDGDDLRTFYTLIMVDPDAPNPSNPNLREYLHWLVTDIPAATGATFGNEVVGYESPRPSMGIHRYIFVLYRQLGCDAIDAPDIIDSRQNFNTRDFARFHNLGLPVAAVYFNCNREGGTGGRRL

SEQ ID NO: 18584 - protein, 140 aa, Lycopersicon esculentum
MPRVDPLIVGRVIGEVLDPFTRSVDLRVVYNNREVNNACVLKPSQVVMQPKVYIGGDDLRTFYTLIMVDPDAPSPSNPNLREYLHWLVTDIPATTDTRFGNEIVCYENPTPTMGIHRFVLVLFRQLGRETVYPPGWRQNF

SEQ ID NO: 18585 - protein, 479 aa, Gibberella zeae
MAENSTPDVPGPAGIPYFGNYLEIYPDHLGNHQRLFEKYGPLFTTTSMGNRLYQTNSAELSNIFLSEDHYFTKDIVPGHPLHPIKNQEAGVFLADTNTEQWRLAHKFLPPALGPKAVRHYAPTMQRTVESSFKVFDELDQKGEAWNVYQYMLKLGSQAVGKLVLGMDFAHFEQVDSPLHEMVLKIAENLELNKRVSSMGAWYAQMPFGDPKKVRQTMARIMEMMDESIARASKGQEDLELQDAALKADTVVDYFLRATDNKGNKLPPSQFAPALLVATAAGFTTTSSLLSWLIYSLVKYHGNQERLLQELIDNDWDENTQVTADTTSKLTFLDKFIKETQRLHNPSFQPGRTAKVDMILPGGYRLPKGAVVISALHHMHNNKDVWENPGRFDPDRWDTEQVKNRPPGSYIPFATGPRMCVGFNFALQEIKVFLPKLVYRYKFSLAQDGPIEYDPYFQLIRPNNLYVQAEKRVKWPPKSE

SEQ ID NO: 18586 - protein, 225 aa, Arabidopsis thaliana
MMNSTEELSSDSTNNGTVEITYKTIGPARPSQIRVASHIKIRDLRNAIAEKGKFPVSTLRMILRGKALQDEEDGDDLYVTLKDQDSFIVAVIPNPPAGVESFDDDDDDDLKFKLPPSASRWKRKLYYFLRNKLKLPDIILMGLFSLSLKMWVIITLWFILAPIAHRWDLGPIFILGTGFSIILLNLGKRQPGDVSAYSIFNEDFRELPGTYNADRIDRDIRAGQM

SEQ ID NO: 18587 - protein, 181 aa, Clostridium tetani E88
MNWCEGDIKEVLYNEEELRKKIKEMGKKITEDYKGKDLILIGVLKGSVIFMADLMKEINIPCNMDFMAVSSYGNSSETSGVVRILKDLDFEIENRDVLIVEDIVDSGVTLRYLVDYLKGRKPASIEIVCLLNKEERRQSNIDVKYIGFDVPDYFLVGYGLDFAERYRNLPYVAILKEEVYS

SEQ ID NO: 18588 - protein, 355 aa, Clostridium tetani E88
MLYALILAGGKGTRLYPLSREDKPKQFLKIINNKSFLKSTVDRIKTLVNMENIYIVTNEVYLEKIYEELPELNKENIFLEPENKETATCIGLSAVKLLKKDKDAVMMVLPSDHHIQDEKVFIDTMKQAVETVEKKRGLVTVGVKPIRPETGYGYIEAGERVQGSIATYKVERFVEKPNVEVAKDLIMKGNYLWNSGMFVWRADIYLREMEKYLPKMYKSMMNIYSSLGTEEEEEVIRQEYNLIDGISVDFGIMQKTRKAYVIKCEFTWDDIGSFMSLSRFLKNFRGNNVEGNTFLEQSNNCIVFSKEKLIIGFGINDLIIVDSGDVMLIMDKNKDQEIKHLVDELKCSKEFNKFT

SEQ ID NO: 18589 - protein, 359 aa, Clostridium tetani E88
MSSKYVKLKDISKIYKSPGGKTFTAVDNVSLNIEPGEFVTLLGPSGCGKTTTLRMIAGFEVPTEGGIHIGEQRVNNLTPDKRDTAMVFQTYALFPHLNIFENIAYGLKIKKLSKSEIADKVKNILELVGLSGLENRAPNQLSGGQQQRVALARALVMEPSVLLFDEPLSNLDAKLRVYMRTEIRRIQKNIGITSVYVTHDQAEAMSMSDRVIIMNKGIIEQIGTPQEIYNSPATEFVADFIGVANIFDSSVKDIEDDYVSIELFDNIYKVKANKAFKKGEKIKAIIRPEALSFGEENGIKVLVDYSVFMGSYQDYNLKYKDFDIKLTDYNPSSKKVYSQGEYALLSINEDSIHIISTEK

SEQ ID NO: 18590 - protein, 401 aa, Clostridium tetani E88
MVYVAFNKKTIEDIDVKGRKVLVRCDFNVPLKDGKITDENRLMGALPTIKYIMEKGGKVILCSHLGKPKGEPKQELSLAPVAKRLSELLNKEVLFPADNEVVGENAKKAVENMKDGDVILLQNTRYRKEETKNEETFSKELASLADIFVNDAFGTAHRAHCSTVGVTEFVATSVCGYLIQKELKFLGNAVENPQRPFISILGGAKVSDKINVINNLLEKVDTLIIGGGMSYTFQKAQGYTIGSSLLEEDKIDYAKEMIEKAKEKGVKLLLPVDNVAAEKFAEDAEAIITEDQNIKEGYMGLDIGPKTSKLYSQEVQSAKTVVWNGPMGVFEFEKFAKGTIEVAKAMAESQATTIIGGGDSAAAVNQLGFGDKMTHISTGGGASLEFLEGKELPGIAALNDK

SEQ ID NO: 18591 - protein, 255 aa, Clostridium tetani E88
MKGVYGLRKAIIAGNWKMHNTIDESVKLVEELIPKVKEAECEVVVCPPFICLPKIREITEGTNIKVGAQNMYFEEKGAFTGEVSPLMLEKLNIDYVIIGHSERRQYFKETDQTVNKKLKAAFEHNLIPILCVGETLDEKENGVTEEVVSKQVKLGLFELKEEQVEKLVIAYEPIWAIGTGKTATSEEANEVIALIRSTVKSLYGDKVAESLRIQYGGSVKPSTIKEQMSMSDIDGALVGGASLKANDFSAIVNYK

SEQ ID NO: 18592 - protein, 513 aa, Clostridium tetani E88
MNKKPVMLMILDGFGITNHEDGNAVKMANKPNFDKLLREYPHTQLKASGLNVGLPEGQMGNSEVGHLNIGSGRVIYQELTRITKDINDGVFFENTEINYAIDEAIKNNSSLHLLGLLSDGGVHSHIDHLKAILKLAKDKGLNRVYVHAFLDGRDVPPSSAKEYIINIENYMKELSVGQIATLAGRYYAMDRDKRWERVELAYNALVYGTGELSNSAVEAIEKSYKDNTTDEFVLPTVILKDGKPTGTIKDEDSIIFFNFRPDRARQITRALNDKDFDGFERKRLKLNFITMTQYDKTIENVRIAYKPQSYKNTLGEYVSSLGLNQLRIAETEKYAHVTFFFNGGVETPNKGEDRALIPSPKVATYDLKPEMSAFEVKDEVINRIESNKYDMIILNFANPDMVGHTGVFDAAKTAIEVVDKCVGEISDKILEKEGTVFITADHGNSEQMIDYSTGKPMTAHTTNEVPFVYVSKDAKDKRLKSEGILADIAPTMLTEMGVKIPEEMTGRNLIEGK

SEQ ID NO: 18593 - protein, 431 aa, Clostridium tetani E88
MKNYIEIIDVSARQVLDSRSNPTVEVDVILEDGTTGRAAVPSGASTGIFEAVELRDGDKSVYNGKGVLKAIENVNTIIAEELVGMNVLDQIAIDKTMIELDGTDNKGKLGANAMLGVSLACAKAAAEYLGLSLYQYIGGVNAKVLPVPMMNIINGGEHADNNVDLQEFMIMPAGASSFSEALRMCSEVYHSLKSLLKAKGYDTGVGDEGGFAPNLNSNEEAIQVIVEAIEKAGYKPGVEIFIALDPASSEIFEDGKYNLKGEGKVLTPQEMVDYYANLVAKYPIISIEDGMAEEDWEGWRLITERLGTKIQLVGDDLFVTNTDRLTMGIERGVANSILIKLNQIGTLTETLNAIEMAERAGYTAVVSHRSGETEDTTIADLVVAVNAGQIKTGAPARSERVAKYNQLLRIEDELGEMGEYRGLKAFYNIKK

SEQ ID NO: 18594 - protein, 431 aa, Clostridium tetani E88
MKKIIEKIFYLTKYKTTVRGELLAGLTGFFSVVYIIAVNSSILSDAGIALEAGIIATILASFLGCMIMGFLGNAPIMMVPGMGVNALFSYTIIKSMGLSVTEALTAVFIAGIIFSAITFTKLGDIITKSISHSLKEAITVGIGIFITFIGFQKGGIIVAHQSNFVTLADLKNPLVLATLINLAITLFLFIKDIKGNFLISIILGTGVSYLLGLVDLYSISFGGVSFKGYENVFFKLDFGGLTSISFWTAVFSLVLVLVFENLGLLNGYVNIMLKQPEKFKNSFKSTALSSITCGILGTSPTIATVESAAAIAAGGKTGLTSIFTGILFIFSIFFLPLIKVIPNSAVAPILIIIGSLMIKNVLNINFKDYTEGFPAFLIITMIPLTYSIVDGMAFGFIAYPIAKLAANKKEDVSLPMYIISIIFLINFILSV

SEQ ID NO: 18595 - protein, 456 aa, Clostridium tetani E88
MENTLKGKVNNSEFYKVLGRLALPIIIQNFITAFLNMVDTVMVGKLGEVEIASVGVANQYFFFFNLLALGISSGGGIFISQFWGKRDEKNIRKILGVNVIAGVTISLLMTLIALLMPETIISLFNKDPQVIHFGAKYLKTIAISYILTAITLAYSISLRCIGEAIIPMAISGIALITNIFFNYGLIFGNFGLPALGVKGAALATVIARLVECVALLIYVYSKKGVLAASIKEMTDINMKFINKIYRTIASVLFNEACWGLAMVMYAAIYGRIGTKAIASIQICTTVQNLFMVVTLGVANASAVMIGNKIGEGKEEEGKEYAKKFTKMGIILGIILGVSMAISAPFILNLFNVSQEVMRSSLLILYITSIIMVMRVFNAVMIVGVLRGGGDAKYALISEAVTMWLVGLPLTLIAAFIIKLPVYVVAGMAGIEEFGKFILSYKRVKSNKWIKNVIYNL

SEQ ID NO: 18596 - protein, 339 aa, Clostridium tetani E88
MNYIKFDEKKPLDVIPIGRVTIDFNPNEINRPLEESRTFTKYLGGSPGNIAVGLARLGKKVGFLSTVSDDQFGNFVVNYLKNEGIDISQINRAKNGEKLGLTFTEILSPKESSILMYRKGIADLQLSSKEVSEDYIKSAKAIVISGTALSKSPSREAAFVALEYAKKHNTRIIFDLDYREYTWNCKEEIAIYYSLAARMSDVIMGSREEFNLMEGLISPEESNDKETAERWIGYGNKIVVIKHGKDGSTAYLHDGTSYKIKPFPVKLLKSFGGGDAYASAFIYGIMEGWDVIDALEFGSASAAMLVASHSCSEAMPKVEEIKQFIKEKKEEHGEMVVRG

SEQ ID NO: 18597 - protein, 243 aa, Clostridium tetani E88
MNVIETVDITKRFNILTVFEKLNINVKKGEVLVIIGPSGSGKSTFLRCLNNLEKIDEGKILIDGEELNPKDKAKMRNMIIKMGMVFQNFNLFPHMTALENVMEAPITVKGENKEKVIKRAEDLLKKVGLADRADAYPSKLSGGQKQRVAIARALAMEPEIMLFDEPTSALDPELVGEVLSVMKDLAKEGMTMVVVTHEMSFAKDVGDRVIFMDGGKIVEQGSPEEIFTNPKEERTKEFLKKVL

SEQ ID NO: 18598 - protein, 306 aa, Clostridium tetani E88
MMQSKIESIIEECRKYTREGEVASYIPELKKADKDALGIYIDKLDGNEFCAGDYDTKFTIQSISKIIALIIAIMDNGMEKVLSKVGVEPSAYSFNSIVTLEVKNANKPLNPMINAGAIATVSLIKGNSPEEIIERILEFTRKVTGNKNIKVNEEVYQSEKKTGDRNRSLAYFMKGTGIIEKDVEKVLDAYFQQCSIEVTCKDIAKIASFLANDGVLPSTGERIIPAEVAKIVKAVMVTCGMYDASGSFAVKVGIPSKSGVGGGILATVPGVMGIGVFGPALDKKGNSIAGVKILERLSEELNLSIF

SEQ ID NO: 18599 - protein, 422 aa, Clostridium tetani E88
MNNLEIFKESEKYMPGGVNSPVRAFSNASINPPIIKKGLGSRIVDEEGKEYIDFVASWGPMILGHNDPEVVEAIQNTVEDAISFGAPTELELKLAKHMVETLDNIDMVRMVNSGTEATMSAIKLARGYTRRDRIIKFAGCYHGHFDGFLVEAGSGVLTERIPGSPGVPKGSIENTLIAEYNHIDTVEALFEKYPEEIAAIIIEPIAGNMGTIPAKTEFLQRLREICTKYGALLIFDEVMTGFRVAYKGAQSRYGVKPDLTTYAKIMGGGLPSGAYGGRRDIMEKLSPIGPVYQAGTMSGNPVVMAAGYTTLRKLYNNPSYYEHMEKIGAELQKGIEIVAKEKGLPVVVNRCGAMLTPFFSKRDKVADYEDAKSSDTELYGRFFEHMIKSGIYIAPSQFEAMFIGVKHDIYEVERFLEAMRKF

SEQ ID NO: 18600 - protein, 423 aa, Clostridium tetani E88
MEKNNYSKEVKKTYTPLLAIEEASRCLLCYDAPCSKNCPVDTKPDEFIRSLRFKNLKGAAETIRKNNILGGVCSRLCPYDKYCQKNCTRGKIDKPIDIGSLQRYLIEFEKNIRLDTLNKVEINKEKVAIIGSGPGGLSAAASLAQKGYKVNIFEKKEKFGGWLTYGIPEYRLPQNLVDYEIDIIRKLGVEFKANCNVGKDITIDDLKEKGFEAILLACGQQQSKELNIEGIKLKGVLKGTEFLSEAKLSNGNLEVGQKVIVIGGGDVAIDSAVTAKLLGAEDVKIVYRRNIEKMPSNKNERIYAHNLNIPIFTGIKPYSLIGNNEKVISFKGVGMFDDSSLELEVDTVIFAIGQELEDLSYIDELKIENNEVLVDENLNTSIEGIFACGDIIKGNKTVVDAVATGKRVAIEIEEYIRRKGDVR

SEQ ID NO: 18601 - protein, 473 aa, Clostridium tetani E88
MSADTSTKGGGMKKTLSLWNFFTIGFGAIIGTGWVLLVGDWMIIGGGPIAAMIAFLIGSLFLLPIGAVFGELTSAIPISGGIVEYVSRTFGNKPSYFTGWFLALGNGILCPWEAIAISSLVGEFIPALKVIPLYEVMGATVYLPPLLISLAFAIYVIRLNFKGASEAAKLQGFLTKLLLAGMVIAMIISLFRGGPKNLQPIYQPKASNARSIWAGILPVLVMTPFFYAGFDTIPQQAEEASEDLDWNKFGKVISMVLIASGIFYVICIYSFGTIVPWQKFVTYTIPALTILSVIGLKIFSKVMMLIAIMGPLGPMNSFFGATARILLAMGRKGQLPEKFKELDKNNGTPKTANILMATLTIIGPFLGKNMLVPLTNVSSLAFIFACFMVSLACLRMRRTEPNIKRPYKVPGGKVGIILACMSSLIIIGLLVIPGSPASLNFVEWMVVLTWFLIGFALMLIRGKKVETKDSGAN

SEQ ID NO: 18602 - protein, 493 aa, Clostridium tetani E88
MEYKKNFDIRSNRNLTMLADFYELTMANGYLKNNLGNKIAYFDMYFRRVPDGGGYCVMAGLQQLVEYLSNLTFSEDDINFLRSKSIFCEEFLDYLKNFNFTCDVWAIPEGTPVFPNEPLVTVKGPIIQAQFVETMILLSINHQTLIATKANRICRAAEGRSVMEFGSRRAQGYDGAIYGARAAIIGGCNSTACTIAEQMFGVPSIGTMAHSWVQLFPTEYDAFKAWAEVYPDNCVFLVDTYNVLKSGIPNAIKVFNEILKPMGYRPKAVRIDSGDITYLSKKCREMLDEAGYEDVQITVSNSLDEYIIRSVLKQGAPIDSFGVGERLITARSEPVFGGVYKLVAVEEDYKIIPKIKISENEEKITNPGFKKVYRIFDKATNKAIADLITLQDERIDEEKPLVIFNPVFTWKKKKLTNFYVKNLMVKIFDNGKLIYENPEVSEIRKIAELESNKLWHEVLRFENPHKYYVDLSSELWDLKQNLINEHSKHYDEI

SEQ ID NO: 18603 - protein, 217 aa, Clostridium tetani E88
MVKIAPSILSADFANLGRDIEAIEKYGAHVVHFDVMDGKYVPNISFGVPIMKSIKGLTKLPFDVHLMIEEPSKYIEDFAKAGADIITFHYEAETHLDRTINYIKSFGVKAGIALNPGTPVSLIKDLIPSLDMVLIMSVNPGFGGQKYIYYASDKIRELKKLKDELNKDLIIEVDGGVGKDNIKDIANCGVDLVVAGSAVFKDGKIEENLKVLREALR

SEQ ID NO: 18604 - protein, 305 aa, Clostridium tetani E88
MKIYNNLIELIGKTPLVNLNKFEKKNGLDSNIIAKVEYFNPSGSVKDRAALSMIEEAERTNLINKDTVIIEPTSGNTGIGLALICAIKGYRLILTMPETMSIERRNILKAYGAEVVLTPGNKGMNGSIQKAEELAKEMGNVFIPQQFNNPSNSAIHKITTAKEIINDLDGKVDIFIAGVGTGGTVTGVGEGLKEYNKNIKIVAVEPENSPILSGGKPGPHKIQGIGAGFIPEILDMNIIDEIFKAPNEESIEIMKKIVKLEGLFVGISSGAALYAAKEIGKREENKGKNIVVLLPDTGMRYLSSY

SEQ ID NO: 18605 - protein, 318 aa, Clostridium tetani E88
MIEIKDVGKIFGDTKVLENISLDIKEGEVFGIIGRSGAGKSTLLRCLNGLENYDEGSIKVMDKEVKDLNNIELRKLRKDMGMIFQGFNIMNSKNIYDNVALPLQVWKKDKKYIDEKVRELLKLVGLENKAKSYPRELSGGQKQRVAIARALTMEPKVLLCDEATSALDPETTKSILKLIQKINKELKITVVVVTHQMEVIKEICNRIALIDGRKVSAYGEVKDLFLRPEGELKKIIEQEELLPNEGVNIKLFFPSNASQQSVITSMARELNVDFSIVWGKLESFRKEVLGSLIINIEEDKKVAICEYLNKKSILWEVI

SEQ ID NO: 18606 - protein, 265 aa, Clostridium tetani E88
MNEILNDKKDYVVSLKDINLSYSGEKGDVSALQNINLDINEGEFICVLGPSGCGKSTLLKIIAGFLKPSDGTAAMDGQIINEPNWHRGVVFQSPTLYPWLNIHDNVAFGLKMRKFPKNDIEELTNKYLDLVGLNDFKNLKPYELSGGMKQRASLARVLVNKPRMILMDEPFGALDALTRENMQTLIRTIWTKTKNTVFLITHDVDEALSLATRIIVLSKRPGKILKEFNTEFTYEISGTNNENVRYSAKYMEIREEILNIINSQN

SEQ ID NO: 18607 - protein, 326 aa, Clostridium tetani E88
MGYLVIDNINKDINNTSILKDISFGISEGEFISILGPSGCGKTTLLRIISGLEDPTSGEIYLNNNIITNLSSGKRGFGFVFQNYVLFPNMTVEKNIGYGLYNKGLNKSEVNSKINYILDLIDITDVKNKYPGQLSGGQQQRVALGRALILSPKVLLLDEPLSALDAKIRESLRWEIKKIQKELKITTIMVTHDQEEALTLSDRIVVMEKCKVSQIGTPEEIYNNPKNKFVADFIGKVNILKTSNGMAKIIRPENIKYSACKKQGFIDCFIKNMEFKGAFYRLTLQMKGIKTTRILVDVMASEKEKLGLKENMDFYIELSNSLAISC

SEQ ID NO: 18608 - protein, 473 aa, Clostridium tetani E88
MNKQDIGLIGLSVMGSNLALNMADKGYKVAIFNRTTTVIDEVLEKYKHSNLFGKYSLKQLMDSLERPRKIIMMIKSGEPVDMLIEQILPYLDEEDILIDGGNSYFKDTQRRSKYLKEKGIKFLGVGISGGEEGARFGPAIMPGGDFGSYEKVKCIFEDIAAKVNGEPCCNYVGENGAGHYVKMVHNGIEYADMQLISEAYMLLKHLGKFNNKELHGIFAKWNEGELESYLIKITSNIFTVKDRETNNYLLDMILDKASQKGTGKWTNMEAIDLGVDVSIITSALNGRFMSNLKEERLRASKILNGKVESSINIEKEEFAELVRRSLYLSKIACYAQGFQLLKVASKTYNWDLQYGNIARIFRGGCIIQARFLKDIISAYEENNNACNLMITKVFSKVINEYDKSLRKTISIAINQGIPVTAMSSALGYMDTYRSYNLGANLIQAQRDYFGAHTFQRIDKEGNFHYDWVNNYEK

SEQ ID NO: 18609 - protein, 499 aa, Clostridium tetani E88
MIKRALISVYNKEGILEFAKFLEKNHVEIISTGGTYKHLKDNCVRVKEVSQITNFDEILDGRVKTLHPAVHGGILAIRDNKEHMDTIKDKNIEPIDMVIVNLYPFFEKIGKGLSLEEQIEFIDIGGPTMIRAAAKNFKDVVVITDPKDYKRIEEKLEKEDEIDFNNRKTLAGKVFNLMSAYDGAISKFLLEEEYPEYLSLSYKKGKDLRYGENPHQTAAFYTSLTEDGAFKDFEKLNGKELSYNNIKDMDVAWKIVGEFEEIACCALKHNSPCGVAIGDTLLESYKKAYECDPISIFGGIVAFNRKVNKETAKELVKIFLEVIIAPDYDEDALRILKGKKNLRVIKCNTKPLDKMEICKVDVGILVQSTDNALIKDMDVVTAKKPTEEEMENMIFAMKVVKYVKSNAIVVVKDKKAVGIAGGQVNRIWAACQALERGNNSVVLASDAFFPFDDVVKKASEYGIKAIIQPGGSIRDKDSIEECDEKGISMVFTGIRHFKH

SEQ ID NO: 18610 - protein, 399 aa, Clostridium tetani E88
MVASVFAATCISAALGTFIMGFYANLPFAQAPGMGLNAFFAFSVCLTLGYTWQQGLAAILISGILFIIITLTSIREKIVDSIPRNLKFAISAGIGLFIALLGFKSGGIIVANSATLVSFGDFTKPNVILTLIGVTITAILMARGVKAAILIGILATTIIGIPMGITNVIPLSALVSMPPSLAPTFLKLDLPGLLNASGTGIFSSILNIFMVIISFSLVDMFDTIGTLVGTAQKANMVDENGRPRNLNKALMADAVATSVGALLGTSTVTTYVESTAGVSQGGRTGLTSVVTGIMFLLAMFFSGLVGIVPAEATAPALIIVGVLMMGAVTNIDFSDFTEALPAFFTISIMPFTSSIANGIAAGLIFYPIVKLATGRRKEIHPIVYILAILFIIRFTILPK

SEQ ID NO: 18611 - protein, 234 aa, Clostridium tetani E88
MSAFMGELLGTMILILLGNGVVANNVLKHSKGEGSGWIVITTGWAIAVAIPVYIFGPISGAHFNPAVTIAFASIGQFSWADVPGYIIAQLVGAIIGATLVWLTYLPHWEATEDQATKLAAFSTAPAIKNTTANLITEIIGTFFLVFGILGVANTSMADGLAPLVVGLIILAAGVSLGGPTGYAINPARDLGPRIAHAILPIKGKGDSDWGYAWIPIVGPIIGGLIGAIFFNIMF

SEQ ID NO: 18612 - protein, 375 aa, Clostridium tetani E88
MPKKDFYEVLGVEKGANDAEIKKAFRKLALKYHPDKNAGNKEAEERFKEINEAYQVLSDPQKRAQYDQFGTADFNGGGAGFSGFEDFDLGDIFESFFGGGFGGFGGSSRRRNGPQKGPDVQYSINLTFNEAVFGVEKEVSITKSETCETCTGTGAKPGTNSKTCPKCNGSGQIKVQRNTALGSFVSVNTCDMCGGKGTIISDPCSDCKGKGTVRKQKKIKVNIPAGVDTGNVIPIRGQGEAGVNGGPPGDLYISVRVMPDPFFKRRGDDIYIDQHISFAKASLGTELKVKTIDGEVKYDIPSGTQPGTVFRLKGKGVPHVNGRGRGDQYVNIIVDIPKSLNQKQKEALFAYMEASGEIQSSEKEGFFDKIKKNFK

SEQ ID NO: 18613 - protein, 178 aa, Clostridium tetani E88
MEVAMEEKARNILITKEEIQQKVEAMGKKISKDYEGKNLYVLSLLRGSFMFTSDLVRYITVPTRIGFMTTSSYGHGEVSTGKVKVVNDIPDDIKGMDVLIVDDIVDTGITMDFVKNHVKSLGANSVKSCVLLDKPERRKLDLVPEYCCFSIPDVFVVGYGLNYGDFYRNIPYIFNWEE

SEQ ID NO: 18614 - protein, 281 aa, Clostridium tetani E88
MDLWLKEGQISDAVMTYKIKETLVRKKTEYQDLAIVDTYALGRMLVLDGIVQTSIKDEYVYHEMITHIPLYTHPNPKKVLVVGGGDGGTIREILKHPSVEKAVLCEIDEEVVKECKKHLPEISNNALEDSRCEVFIGDGIKYVNEHKNEFDVVIIDSTDPFGAAEGLFGGSFYGKISECLTEDGIFVAQTETPFYLPEIVKRVYDDSKAVFPVTKLFMAAIPTYPSGYWSFTIGSKKHDPEKAPVPEVLPFETKYYTPRLHSASFVLPKFVENLIFANISE

SEQ ID NO: 18615 - protein, 449 aa, Clostridium tetani E88
MNKITVDLNNTKPYIKDEEIKALEPFIKEAHKMLHEGSGLGNDFIGWLDLPINYDKDEFQRIKKASNKIKANSDILLVIGIGGSYLGARAAIEMLSHNFRSLLKKEDKEGTDIIFVGNSISSTYMAELLEVIKDRDFSINVISKSGTTTEPAIAFRIFKEILENKYGIEEAKNRIFVTTDKSKGALKTSSDKQGYETFVIPDNVGGRYSVLTAVGLLPISVAGINIDEMLKGAYDAREDFMYDNIEENQCYKYVAARNALYNKGKNTEILANFEPSLHYFGEWWKQLYGESEGKEGKGIFPASVSFSTDLHSMGQYIQEGLRIIFETFINIEKPRKDLEIKSEKENLDGLNFLSGKTVDFVNKQAFRGTVLAHNDGEVPCIVINVPEVSPYYFGYLVYFFEKACGISGYILGVNPFDQPGVEAYKKNMFALLGKEGFEDRKKELEKRMN

SEQ ID NO: 18616 - protein, 484 aa, Clostridium tetani E88
MAIILKKGYTFDDVLLLPNKSEVLPKDVLLNTNLTKKIKLNIPLISAGMDTVTESRMAIAMAREGGIGIIHKNMSIEKQAEEVDRVKRQENGVITDPFHLSPDKKLQDALDLMSKYRISGVPITVEGKLVGIITNRDIVFEDDYSKKISELMTDEDLITAPENTTIDQAREILKKHKIEKLPLVDENFNLKGLITIKDIDKIKMYPNSAKDDKGRLLCGAAVGVTADMIERVDALVKAQVDVITIDTAHGHSRGVLEGVRKIKELYPELQIIAGNVATPEATRDLILAGADCVKVGIGPGSICTTRVVAGVGVPQLTAVMDCVEEAQKHGVPVIADGGIKYSGDIVKALAAGASVCMMGSLLAGCAESPGETEIYQGRSYKVYRGMGSLASMACGSKDRYFQEDNKKLVPEGVEGRVPYKGYLSDTVYQLVGGIRSGMGYLGSKTLKDLYESARFIVQTSAGLRESHPHDISITKEAPNYSTNA

SEQ ID NO: 18617 - protein, 474 aa, Clostridium tetani E88
MSRRIRGRSLMDRFKRTPIKVQDAKKRIKNFKEVCLGYTEEEAIKEASRCLNCKNPICVPNCPVAINIPKFIQHVKNREFEEAAKVINEASSLPAICGRVCPQETQCEGKCVLGVKGEPIAIGKLERFVGDWSRENNVDLSFKGKKKDKKIAVIGAGPAGLTCAGDLAKLGYNVTIFEALHEPGGVLVYGIPEFRLPKDTVVKHEIDNVKKLGVEIETDVIVGRTITVDELLNEEGFHAVFIGSGAGLPKFMGIPGENLNGVFSSNEFLTRNNLMKAYREDYDTPIKVGEKLAVVGGGNVAMDAARTAKRLGAEVHIVYRRSEEEIPARREEVEHAKEEGIIFNLLTNPTEIIGGEDGWVKAMKCIKMELGEPDKSGRRRPVEIEGSEFILDVDTVIMALGTSPNPLISGTTKGLETDKWGCLVAKDENGETTKRAVFAGGDVVTGAATVILAMEAGKKAAKGIDEFLSDSEKK

SEQ ID NO: 18618 - protein, 502 aa, Clostridium tetani E88
MYMIIGDSFTTKEIDEYCINNLSVPGIVLMENAAIKILKHLDLHKNQCFLIIGGRGNNGGDAFALGRHLLAHGEKVEIFLIGGQKGMSEDCSINYNILKNLDVNINLIDNIKDIEDLRNSIKKSNIVVDGIFGTGLTRKVEGIYDDVISVINENSDYTVSIDVPSGLNCNTGEILGNCIIAQKTISLMTYKKGFLNYTTENYTGEIIVENISVPYNSIKNICKNEFILGEEFVRKNLKIRSKYGHKGNYGRTLIVAGNEGFTGAAYLATEGAVKSGAGLVTLSTHEKIKDILSCKLNEAMIASVENKDEFYRLLINSDSIAIGPGLRNNDDTFELVKEVINKSNCPIVIDADGINCLKNHLYLMKDKKNSIILTPHPGEMSRLTGLSIKEINERRIDIAKDFARKNEVIILLKGYNTVITDGDKTFINSTGNSAMASGGMGDTLTGIIASFLAQGYNPLEAASMGAFLHGYCGDKLSKNMYSVNAREVLNIFPCIMKKFQSN

SEQ ID NO: 18619 - protein, 433 aa, Clostridium tetani E88
MYKKWKCLVCGVIFDGDVPPNPCPVCGASSDNFEEVLVARNDFADDSKLNFVIIGNGAAGFYAADSVRNRNKNCNITMISKEKTYSYYRPLLSEYLNKEKLPSNFYLSKENWFEEKNINLILNTAVNNINPVDKKVLLSNGKTLNYDKLILANGGYNFIPPIEGKDKKGVFTLRGLEDSENIKDYAKKIKHATVIGGGLLGLEAAWELRNIGLDVSVIEFFDRLLPRQLDEKAGKLFQDSIKQSNVDIILGDSLVEILGDNSVESIKLKSGKEIKTDMVLFSIGIRSNKELAENCGLKTDKAVIVNEKMETNIDDIYACGDVAEFNGKNYGNWPAAVQMGKVAGANASGDNLNFKDFVSAIIFRAMNTKMFTCGNCDDNMVNVAYEDPKNGTYKKLFFEKDILVGATLLGDISSSGKLVEQIKNKTSINDIIK

SEQ ID NO: 18620 - protein, 454 aa, Clostridium tetani E88
MNDINYMLENQKKYFNERKTRDLKFRLNKLRLLKNAIKTREEDIMEALKKDLNKPYFESYETEIAMVIDELNYTIKNLPKWIKTKRIKSSILSFPSKGYIYSEPYGVVLIMSPWNYPFQLSIMPLIGAIAAGNCCIVKPSEYSTNTSRIVEDIVKEVFLSCHVCVIEGDKDISKEILRKKFDYIFFTGSEEVGKIVMKAAAENLTPLTLELGGKSPCIIDSECNLSLSAKRVVWGKFLNAGQTCVAPDYVLVHKSIKEKFINEMRRYINIFYKGESKDFPRIINKFHFQRLINLLSSDGNIEIGGQYNKDTLQLYPTIINNIDWESNIMKEEIFGPILPIIEYDSIDEVIDKINSRAKPLALYYFSSNKENQKKLLERTSFGGGCINDTIMHLTSPYMPFGGVGSSGMGSYHGYKSFETFSHKKSILKRSTKLDINLRYPPYGENIKVLKKIIK

SEQ ID NO: 18621 - protein, 216 aa, Clostridium tetani E88
MNIILLGPPGAGKGTQAKLISEKYSIPHISTGDIFRKNISNKTPLGMEAKSYMDKGQLVPDELTIEIVKDRLGEEDCKNGFLLDGFPRTVKQAEALDEFLQNKSSKTDAALLIDVPQELILERMTGRRVCGECGASYHIKFITPKTEGVCDLCGGKLVQRKDDTKETVLERLEVYSKQTQPLIEYYKNKNVLLALDGTKEKNEVFENISNVLGAIN

SEQ ID NO: 18622 - protein, 151 aa, Clostridium tetani E88
MRKYFLGEEFTKQDLKQMNPLVLAYIGDAVYEIFIRTYIISKNKDTCVNKLHKKTIQFVKADAQSYFIREIQKYLNEEEIKVFKRGRNTKSNTSAKNASIQDYRMATGFETVIGYLYLLNEDERLEEIMKLVINLYEESSQNEGENHGSKS

SEQ ID NO: 18623 - protein, 465 aa, Clostridium tetani E88
MFYTYIIGADYMAKIKSCFVCQECGYESPKWLGKCPDCNTWNSMVEEIKSKEADKKFNYNLQINSSESIVDIKSITYERISTGINELNRVLGGGIVRGSLTLISGDPGIGKSTLLLQAANNIAEKYGKILYISGEESQEQIRLRGERLQALCKDVYILAETDINIILANIDKIKPTFIILDSIQTLYNPEISSAPGSVSQVRECSNIIMRLAKTNNIPFFIVAHVTKQGSLAGPKVLEHMVDTVLSFEGERTEEFRILRTIKNRFGNTSEIGVFEMREDGLNEITNPSEVFLEDINFNKEGSIIIGIMEGSRPILVEVQALATKTNAPMPRRTVVGVETSRINLILAVLEKKLKIPFYQFDVYINVVGGLNIEGTFADLGIALALISSVKGVEAKLEKMLVVGEIGLTGEVRPVMFCDRIINEGKKMGFKNFIIPSRNKEKILGNDKSINIIGTQYLKEIINRVF

SEQ ID NO: 18624 - protein, 428 aa, Mycoplasma gallisepticum
MIKLTFNLIKGLDYKKLDKNYQAKLDEIFSQLKNKKTPSANMLGWIDYVDQDHTKIYKSIDNKIAEWDKLKVTDVVVIGIGGSFTGIKAILDVVAYLPSEQKRQIHFIRSLSENSFLKVLEEIKDKNWGIVVISKSGTTLEPSVGFKLFREALYKQYGEQAQKRIVAITDPKKGVLHDIAVKNKYEMLPIYSDIGGRFSTITPSGLLVAGLVGADYKQLIEGAKKAKADLFASSELKKNSAYTYAALRHYLYTEMKKDVEIAITYEEQHEYLMLQHRQLFGESEGKSLNSLFPTYSVFTTDLHSMGQLYQDGKKIFFETVFSFEKANKNKLKLKNSEFNNDDQLDYLTKKSVNQLNYVACEATKQAHASAGVPIIEIDVKENSAYGFGYLYFWLCVATSVSALLLGHDPYNQPGVEDYKQRMFKLLKE

SEQ ID NO: 18625 - protein, 215 aa, Mycoplasma gallisepticum
MSDLLFSILPMLNDYDQNKLASYKQLGLNKIHYDVMDEFVNNKAFDERYVDNLKDLGYQINVHLMVNKVANHILVYAKTRCNQISFHVEPLANNKQLINKYLAYIKTNNKKAGLAFKFNTDVNDYLDQIKLVDYVTLMSVEPGAGGQAFNPLVYRNIAKLIKFNPKLEIEIDGGINFEKAIELKGLVSGFVSGSYFYQLSDQSKLEMLEKIRAFS

SEQ ID NO: 18626 - protein, 293 aa, Arabidopsis thaliana
TRPWFSEISPMWPGEAHSLKVEKILFQGKSDYQDVIVFQSATYGKVLVLDGVIQLTERDECAYQEMITHLPLCSISNPKKVLVIGGGDGGVLREVARHSSVEQIDICEIDKMVVDVAKQYFPNVAVGYEDPRVNLIIGDGVAFLKNAAEGTYDAVIVDSSDPIGPAKELFEKPFFESVNRALRPGGVVCTQAESLWLHMDIIEDIVSNCRDIFKGSVNYAWTSVPTYPSGVIGFMLCSSEGPQVDFKKPVSLIDTDESSIKSHCPLKYYNAEIHSAAFCLPSFAKKVIDSKAN

SEQ ID NO: 18627 - protein, 411 aa, Pseudomonas putida
MIKTIVIIGAGLAGATAARSLRAQGYQGKIHMVGEEACVAYDRPSLSKDVLAGKLGDPPFIMDPFWYASADIDLHLGVRVTSIDVVSRQVLFESGHTLAYDRLLLATGVRARRMAIMGCELAGIHTLRDNADSFALRQVLGPGKSLVIVGGGLIGCEVATTARKAGTTVTILEAGDELLLRVLGHKIGAWCRAELELMGVRIELNAQASHFEGKGHVRAVVCADGRRVAADVVLISIGAEPADELARAAGIACERGVLVDATGASSCPEVFAVGDVAAWPLRAGGRRSLETYMNSQMQAETAAAAMLGTPVPAPQVPTSWTEIAGHRMQMIGDFGGPGEIVLRGDVQNGQPLVLFRLLDGRIEAATAINAAKEFSIATRLVVGRVPVSAKQLQDASLNLRELLKTKAQLCT

SEQ ID NO: 18628 - protein, 445 aa, Bacillus firmus
MSADWSYLREKSASRLAPSMAKDHPNLPVVKEEGCYYYGVDGVKYLDFTSGIAVTNVGHRHPKIVQAIKEAADHLTHGPIGVIQYESILKLADELADILPGDLDCFFFANSGTEAIEGALKLAKFVTKRPYVVSFTGCFHGRTQGSLGVSTSKSKYRKFLQPNGLTYQVPYFKPSDPRILDEEGEVVESLACELLEEEFTNLFKYHVSSEEVAAVILEPVLGEGGYIIPPASWLAKVREICNRHDILLIFDEVQTGFGRTGEWFAAQTFGVTPDIMAIAKGIASGLPLSATVANHTLMQQWPLGSHGTTFGGNPIACSAALATLDVLKEENLLDNAREVGAYARERLNLLKEKYEMIGSIRSVGLMIGIEIIDPQTKKPDGAAVLRILDLALQEGVLFYLCGNEGEVIRMIPPLSVTKEQIDDGLDMLQRALVKYKEETHQPASL

SEQ ID NO: 18629 - protein, 1203 aa, Thermoanaerobacterium thermosulfurigenes
MNKKLFTNRFISFNMSLLLVLTAVFSSIPLHSVHAADNASVVANIVGEFQDQLGDSNWNIDSNITIMQYMGNGLYEFTTPTQLKAGSYQYKVALNHSWDGGGVPSQGNLTLNLANDSYVTFWFDYNTQSVTDSTKYTPIANDKLPRLVGTIQSAIGAGNDWKPETSTAIMTDDNFDNVYSYTAHVPKGDYQYKVTLGNTWDENYGANGVKDGSNIQINVTNDADITFYYDANTHNIWTNYSPILTGLDNNIYYDDLKHDTHDSFFRNPFGAVKVDQTVTLRIQAKNHDLESARISYWDDINKIRIELPMTRIGESPDGNFEYWEIKLSFDHPTRIWYYFILKDGTKTAYYGDNDDQLGGVGKATDTVNKDFELTVYDKNFDTPDWMKGAVMYQIFPDRFYNGDTSNDHAKTLSRGNDPIEFHNNWNDLPDNPNNAGTPGYTGDGIWSNDFFGDLKGIDDKLDYLKGLGVSVIYLNPIFESPSNHKYDTADYTKIDEMFGTTQDFEKLMSDAHAKGIKIILDGVFNHTSDDSIYFNRYGKYPGLGAYQAWKEGNQSLSPYGDWYTINSDGTYECWWGYDSLPVIKSLNGSEYNVTSWANFIINDENAISKYWLNPDGNLNDGADGWRLDVENEVAHDFWTHFRNAINTVKFEAPMIAENWGDASLDLLGDSFNSVMNYQFRNDIIDFLIGQSFDDGNGQHNPIDAAKLDQRLMSIYERYPLPAFYSTMNLLGSHDTMRILTVFGYNSADPNENSDAAKQLAEQKLKLATILQMGYPGMADIYYGDEAGVSGGKDPDDRRTFPWGNEDTTLQDFFKNISSIRNNNQVLKTGDLETLYAQNDVYAIGRRIINGKDAFGTSYPDSAAIVAINRSKSDKQIAIDTTKFLRDGVTFKDLINNNVSYSISNGQIVIDVPAMSGVMLISDDGQDLTAPQAPSNVVVTSGNGKVDLSWLQSDGATGYNIYRSSVEGGLYEKIASNVTETTFEDANVTNGLKYVYAISAIDELGNESGISNDAVAYPAYPIGWVGNLTQVSDNHIIGVDKPTEDIYAEVWADGLTNSTGQGPNMIAQLGYKYVSGTVYDSVYGSVYNSVYGVDDSGFTWVNAQYVGDIGNNDQYKASFTPDKIGQWEYLMRFSDNQGQDWITTSTLSFYVVPSDDLIKPTAPYLNQPGTESSRVSLTWNPSTDNVGNYTIMKFIGPMVEHLIK

SEQ ID NO: 18630 - protein, 495 aa, Catharanthus roseus
FFIFLFFVFLLINGRRKSTRTKTINLPPGPWKLPILGNLHNMMMGSVPHRLLRDLAKKHGDLMLLKLGEFNAIVVSSPRMAKEVLKTHDLSFLNRPIIQAPKILCYDNSDLVFSQYGDSWREMRKIFVLELLSTKRVRSFQPIRQDEGSRLVSLIKESVGKSIDLSEKINSYTTSMVARAAFGKVNDAGVTFLKLVKEASEVAGGFDPADIFPSYKFLNVFFNSRSKLLKIHGKTDMILEEMIDEHIKNHEMGKKANGENGKEDVIDILLSIKDSGELQFPFQMNNVKALIFDMFAAGTETSSSTVEWAMSELIRNPDVMAKAQNEVRQVLKGKQIVDESVLQELEYLKLIVKEVLRLHPSSPLLIPRECGEDCQIDGYDIPVKTRVFVNIWAIARDDKYWKDPESFIPERFENTCFDFTGNNFEYLPFGSGRRMCPGMTFGLANVDLVLALLLYHFNWKLPPGVNDIDMTERVGLGATKKHSLVLIPTLYDPSF

SEQ ID NO: 18631 - protein, 430 aa, Catharanthus roseus
KLGGFNTIVASSPRMAKEVLKTHDLSFLNRPIIQATKILCYDNSALVFSQYGDSWRQMRKIFVLELLSTKRVRSFQPIRQDEGSRLVSLIKESVGKSIDLSEKIKLYTTSMVARAAFGKVNDAGVTFLKLVTEAAEVAEGFDPADMFPSYKFLNVFFNSRSNLLKIHGKTDMILEEMIDEHIKSHQMGKKANGENGEEDVIDILLSIKDSGDLGISHWMNNVKALIFDMFSAGTETSSATVEWAMTELMKNPSVMRKAQDEVRQAFKGKKTIDESDLEELKYLKLVVKEVLRLHPFAPLLVPRECREACQIDGYDIPVKTRVFVNVWAIGRDEKYWKDPESFIPERFEDNSLDFTGNNFEYLPFGCGRRICPGMTFGLANVHLVLALLLYHFNWKLPPGVNDIDMAERPGLGASKKHGLVLVPSFYQPSF

SEQ ID NO: 18632 - protein, 161 aa, Rickettsia sibirica 246
MSNSSKKHLDLPYRPGVGMMILNADNHIFVGKRIDTKISAWQMPQGGIVPGETPSIAAMREMLEEIGSDKGYIIAESKFWYSYDVPSFLIPKLWNGNFRGQKQRWFLIRFTGNNEDININTSNPEFDQWRWASLDELLSIIIPFKRKLYQAVVKEFESLIQ

SEQ ID NO: 18633 - protein, 251 aa, Rickettsia sibirica 246
MSVEEFKIKIRSLYKSFANHKVLDGIDLDVKKGSSLVILGGSGSGKSVLIKNIVGLIKPDKGKIFIDNVEIQDISSKQKFEIMDGIGFLFQGGALFDSLNIRDNITFETKKLSKKEKNDLAGAKLNAVGLSPRILELYPAELSGGMQKRVALARAICSTPSILFLDEPTTGLDPIMANVINELIIKIQEELKATTITITHDMISAAKIAKEVAMIYQGKIKWYGSKDEMRNSDNPYLKQFINGLTTGPIEV

SEQ ID NO: 18634 - protein, 431 aa, Rickettsia sibirica 246
MTNTRSKIKTPRSPYVKKYNSWRVRILYSIIIGYATFYFCRQNFNIATPAIREYFGVTKTQIGWILTASSIMYGVSKACNGFISDKVNARIFMVLGLLFVGIITMLIGFSDSLWFIGILWIASNWFQSMGWPPATKMLTHWFASKELGTKWAMGATSNQIGGALAMISCGYLIDKFDWRAAFFVPGVVACVVSLFLYNRLRNSPKEVGLSTVEEYKEYPLEAIGDYEKLLTPQLLKMVFCNKLIWYVCLANMFVYIIRSGVIYWAPTFLKDLRNISLANAGLQIGLYEMIGIPGALIAGVLSDKLFQGRRGPVASICMVLLSLLLVLFWKLPIHSELLSIVILSLIGFFVSGPQLLVGIAAADFSTRQAVGTANGLSGLFGYLGAAIAGVGVGWISDNYGWNGVFIFFSISALLGGGLFALIWNRSAKKYI

SEQ ID NO: 18635 - protein, 240 aa, Rickettsia sibirica 246
MIILEKVCKRYGKNYAIKNIDLSFTTKETTVIIGPSGSGKTTLLRILNNLEEPSSGTFLVDGKKLLLKNRRKLLLKVGMVFQNFNLFPHLTVGENLIYTPVNVLNLPKEQAISMAKELLAKFKLTQKFDSYPASLSGGQKQRTAIARALMMKPKILLFDEPTSALDPENIKDVIENINLLKDQMSMVVVTHHLKFAKLIADRVIFMDQGQILANQPAEDFFNKPASHRARLFLENISDLR

SEQ ID NO: 18636 - protein, 459 aa, Rickettsia sibirica 246
MEQYDVAVIGGGPGGYVAAIRAAQLKKKVVLVEKEHLGGVCLNWGCIPTKSLLKSAEVFEYIKHAKDYGIDAKGAEINIKKIVERSREISNKLAGGVKLLLKKNKVTVIDGVASLAGNKVININDKPTVKAGNIIIATGARSRVLKGFKPDGKQIWTSKEAMIPQHVPKSMIIVGSGAIGIEFASFYNSIGVDVTVIEAHNRILPAEDMEISGIAHKNFEKKGIKIITNAKLIKQTKSKDKIEVELELADKTQKLQAEILLMAVGITANTENLGLEKTKIKVENGYITTNGLMQTAASGIYAIGDVAGVPCLAHKASHEGIIAAESIAGLKPHTINKHNIPGCTYSSPQIASVGLTEEEATTLGYELKIGRFPFIANGKALVSGDSDGLIKTIFDAKTGELLGAHMIGSEVTELIQGYVVSKNLEGTELDLINTIFPHPTLSEMMHESVFSAYDRAIHI

SEQ ID NO: 18637 - protein, 230 aa, Rickettsia sibirica 246
MKVDSLHNLSYKEEFEGDMKRSTAAYKKVSEDASIGSTYIADTSEVGSQISDEPVQHIKIPEHRQILKFNIPNLEVSKVYKLPLEGGYARSLIKPVIMAGGNGKRLWPLASKDKPKQFKKILSDLTLLQQTLNRNKFLGQPTIITSKKYESITKEQAAEIDVEIALITEPLQKNTAVCAIITALSATALGFDIVVLLPSNHHIADDINYLNTINKALHYVNECGICTIFL

SEQ ID NO: 18638 - protein, 394 aa, Rickettsia sibirica 246
MAKAKFERTKPHVNIGTIGHVDHGKTSLTAAITIVLAKTGGAQATAYDQIDAAPEEKERGITISTAHVEYETKNRHYAHVDCPGHADYVKNMITGAAQMDGAILVVSAADGPMPQTREHILLAKQVGVPAMVVFLNKIDMVDDPDLLELVEMEVRELLSKYGFPGDEIPIIKGSALQALEGKPEGEKAINELMDAVDSYIPQPVRATDKPFLMPIEDVFSISGRGTVVTGRVESGIIKVGEEIEIVGLKDTQKTTCTGVEMFRKLLDEGQAGDNVGILLRGTKREEVERGQVLAKPGSIKPHDKFEAEVYVLSKEEGGRHTPFTNDYRPQFYFRTTDVTGTIKLPADKQMVMPGDNATFTVELIKPIAMQEGLKFSIREGGRTVGAGVVTKINN

SEQ ID NO: 18639 - protein, 212 aa, Rickettsia sibirica 246
MIVIFLGPPGAGKGTQGKKIAKKIDLLHIAIGDIFRTIIKTSTSEAELINNYVKQGELIPNEIVNQVIKNFLLSSEYKNGYILDGYPRNLEQAKFFESFIKEKIKIIYFDVSDELLIKRILGRYSCKNCGKIYNRYFLQPKTDNVCDVCGSSTFDYRKDDNEEVIKKRIEVYKTETYPLIDYYKNSGNFYIVNGSKNEQEIEIDIQKILKIN

SEQ ID NO: 18640 - protein, 1140 aa, Rickettsia sibirica 246
MDTNKLYLFKDRRFLPNFIVQLCGCLNDNILKNALVILITYGISGALSKYNNLLVLIANATFVLPFIIFASIAGQIADKYERANLIKIIKICEIGIIAFAIYGFHHNNLLILFCSICLMGIHSTFFGPIKYSVLPDHLNKDELLGANGFVEAGTFIGIFIGTIIGSYYTISNNFIIYSLITIAFLGFITSLFSPKSKNVNRDIKLNFNIIDESINMIKYAKAKKQIYLAILGISWFWFIGAAIISQIPLLAKITFKADENVANLFLAVFSLGVGVGSFLCSKIFEDEITVKYLFISALGISIFGIDLFFASRISSVNYEPTQLKSILVFLSKRHNWRIVIDLLFLAAIGGLYIVPLFAILQHYANPAHRSRIIAVNNLINSIFMVGSTIILSLLFYLNFTIPWIILFISLANIIVTIHIYRLIPEVKIIPFKLLRRIFQICFDLMYNVEVKGFENFQKAGKKVVVVANHISYLDPPLIATYLREEMTFAISPDIQKIWWIKPFLRMARTLPVDPSNPMAIKTLVKEVQKDQKVAIFPEGRISVTGSLMKIYEGPGMIADKAGATVLPVRIDGTQFTHLSKLKNILKRKIFPKITITVLPPVKFANMDATSNQERRNYISRTLYDIMADMMFESSDYQNTVFSSLIEAAKIHGFKKKIVDDFENNAVTYRDLILKSFILGDLIKKNNIFGRNLGLMLPNTTNTLITFYAMQSSGYVPAIINWSSGISTIINSCKLAQIKVVYTSKQFIEKANLHALITHLLDFGIKIIYLEDFKNQIGTALKLKAKIGSYCAQTYYNYFCRNRDDEKPAVIIFTSGTEGEPKAVLLSHRNLQTNRYQITAKVPFSPEDIVFNALPLFHCFGFSGAIITTLNGIKLFLYPSPLNYRSIPEVIYDIGATILISTDTFLNGYANYAHPYDFYSLRYIFAGSEKLKESTRQFWLNKYGIRIFEGYGITEASPIIACNTPMHNKAGTVGRLLPKIDYKLEKVEGINEGGRLFIKGPNIMLGYLDLGGHRTYKEWYDTGDIVKIDSEGYITTLGRLKHFAKIAGEMISLTKIEELASEIDPDSLHAAISIPDKTHEDKIILLTTGSNINRENFADAVSKAQIPLLHLPKVIITDSEIPLLTNGKIDYLEIMKNVDRF

SEQ ID NO: 18641 - protein, 444 aa, Rickettsia sibirica 246
MTKKHYICSNCGNISPKWSGQCFDCGVWGSIVEEIISTNQAIVKVGSKQDFDKLSGHVTEQLRIPTPIGEFNRVLGGGLVLGSAILIGGDPGIGKSTLLLQLAASNFAPKMNCLYITGEESLDQIKLRAIRLNLTNYNTDILAATNLEDIIASIEANKNNIDLIVIDSIQTITTKELSSPPGTVSQIRTCANELVNYAKQNNIIILLSCHVTKDGQLAGPKILEHLVDTVLYFEGDHNNHFRILRSYKNRFGGVGEIGVFEMSGSGLIEVTNPSELFLMQREQNVIGTSIFAGIEGSRPLLMEVQALIVPSNMVTPRRSAVGWDANRLSMILAVLSSRIGLNLANYEVYLSIAGGLKIADPASDLAVTASLISAATGNPVPEHSVFFGEISLSGEIRKTAKAETRIKEAVKLGFNKIICSKFENLTYDFISSVSHLKDLKEIIK

SEQ ID NO: 18642 - protein, 459 aa, Rickettsia sibirica 246
MQEFDLVVIGSGPAGYTGSIRAAQLGMKVACIEKSDTLGGTCLNIGCIPSKVLLNSSEKYEAALKHFENIGIIADVKLDLQKMLANKDKVVLDLTQGIESLFAKNKVTRIKGEAKISSSNIVEVNKEQIKAKNILITTGSSVIEIPNIKIDEEFIVSSTGALKLSKVPENLIVVGGGYIGLELGSVWRRLGAKVTVIEYAPSIVPMLDKEIATQFMKLQQKQGIEFKLNTKVLSAEVKSGKVNLTIEEDGKSSVVTSNVVLMAVGRKAYTQNLGLESVGIITDKQGSIEINDRFQTAISNIYAVGDVVKGAMLAHKAEEEAVAAVEIMAGQAGHVNYNLIPSVIYTYPEVASVGETEEQLKEKGINYKVGKFPFLANSRARAIGSTEGMVKILADSKTDRVLGAHIIGADAGTLIAALTAYMEFGAASEDIARTCHAHPTLSEAIKEAALSVDKRTINM

SEQ ID NO: 18643 - protein, 299 aa, Nicotiana tabacum
MEMIKDACENWGFFELVNHGIPHEVMDTVEKLTKGHYKKCMEQRFKELVASKGLEGVQAEVTDMDWESTFFLRHLPVSNISEVPDLDDQYREVMKDFAKRLENLAEELLDLLCENLGLEKGYLKNVFYGSKGPNFGTKVSNYPPCPKPDLIKGLRAHTDAGGIILLFQDDKVSGLQLLKDGQWIDVPPMRHSIVVNLGDQLEVITNGKYKSVMHRVIAQKDGTRMSLASFYNPGSDAVIYPAPALVEKEAAESKQVYPKFVFDDYMKLYAGLKFQAKEPRFEAMKSIESDVKMDPIATA

SEQ ID NO: 18644 - protein, 483 aa, Nicotiana tabacum
MGFISSIDNELLSKVATNNGHGENSAYFDGWKAYEIDPFHPTQNSDGVIQMGLAENQLCFDLIQEWVVKNPKASICTAEGSQDFKDIAIYQDYHGLPEFRSAVARFMGKVRGDRITFEPERIVMSGGATGAHELLAFCLADPGEAFLVPTPYYPGFDRDLRWRTGVQLFPVVCESSNNFKVTKEALEAAYQKAQESNITVKGLLLNNPSNPLGTILDRETLKDTVRFINEKNIHLVCDEIYAATIFNKPDFISISEVIMEEDVECDRDLIHIVYSLSKDLGFPGFRVGIIYSYNDVVTNCARKMSSFGLVSTQTQFLISNMLSDENFVTKFIGESSERLQKRHGMFTRGLAQVGINTLKSNAGLFIWMDLRRLLKELTFEAELELWRIIINEVKLNVSPGCSFHCSEPGWFRVCFANMDDETMRIALRRINNFVIQRKGIEGGVKKLQCRRSKLEISLSFRKLDDFMNSPHSPMSSPLVQART

SEQ ID NO: 18645 - protein, 193 aa, Shewanella oneidensis MR-1
MNRRQFFKLCAAGAATSAISALGLMSEKAYAAVREFKLLGAKETRNNCPYCSVGCGLLMYSQGSGGKNSEHAIFHIEGDADHPVNRGALCSKGAGLVDYVNSPHRLQYPEYRAPGSNKWERISWQDAFKRIARLMKDDRDANLIEKNADGVTVNRWLTTGMMTSSGMANESGLATQKFARALGLVAIDTIARN

SEQ ID NO: 18646 - protein, 195 aa, Zea mays subsp. parviglumis
  misc_feature (29)..(29): Xaa can be any naturally occurring amino acid
APLDKVCVLSCGISTGLGASINVAKPPKXSTVAIFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 18647 - protein, 195 aa, Zea mays subsp. parviglumis
APLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 18648 - protein, 195 aa, Zea mays subsp. parviglumis
APLDKVCVLSCGISTGLGASINVAKPPKGSTVAIFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 18649 - protein, 425 aa, Spinacia oleracea
GASFSLHVLSKINSYKSQSTKPIRGVASMAKKSVGDLTSADLKGKKVFVRADLNVPLDDSQNITDDTRIRAAIPTIKHLINNGAKVILSSHLGRPKGVTPKFSLAPLVPRLSELLGLQVVKADDCIGPDVEKLVAELPEGGVLLLENVRFYKEEEKNDPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGMSVGSSLVEEDKLDLATSLLAKAKEKGVSLLLPTDVVIADKFAADADSKIVPASGIPDGWMGLDIGPDSIKTFSEALDTTQTVIWNGPMGVFEFEKFAAGTEAIAKKLEEISKKGATTIIGGGDSVAAVEKVGVAEAMSHISTGGGASLELLEGQTASWSTCS

SEQ ID NO: 18650 - protein, 365 aa, Clostridium acetobutylicum ATCC 824
MAKKPVMLMILDGFGISDKVDGNAVKAASKPNFDKYFNNYPHTHLGASGLSVGLPDGQMGNSEVGHLNIGAGRIVYQSLTKITKAIEDGDFFKNAALNKAVNNVLENDSTLHLMGLLSPGGVHSHTNHLKGLLQLAKKKNVKKVFVHAFLDGRDVPPSSAKEFIKDIEDYMNEIGLGEIATVSGRYYAMDRDNRWEREELAYNAMVLGKGEEAESAIKAVDASYHDNKTDEFVLPTVIVKEGKPVATIKDKDSVIFFNFRPDRARQITRAIAEEAFDGFKRDRLNIEFVTMTEYDASFKGVDVAFGPENITNTLGEYVSNKGLNQLRIAETEKYAHVTFFFNGGVEEPNKNEDRALISSPKVATY

SEQ ID NO: 18651 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 18652 - protein, 351 aa, Arabidopsis thaliana
MVKETVYYDVLGVTPSASEEEIRKAYYIKARQVHPDKNQGDPLAAEKQVLGEAYQVLSDPVHREAYDRTGKFSAPKETMVDPTAVFALLFGSELFEDYIGHLAVASMASTQMASEIENSDQFQDKLKAVQKEREENLSRFLKDFLSQYVHGDKEGFISRAESEAKRLSDAAFGADMLHTIGYVYTRQAAQELGKRALYLGVPFVAEWVRNKGHSWKSQISAAKGALQLLQLQEESNRRLKKDGTSPANELESHIQTNKETLMGSLWKLNVVDIEVTLLHVCQMQEKQSKNGTTSRKEDEDSDDDDSSSDDDSSQPLSYRTPLLTQGIGRLFRCLCNPAFDVDDDEIVYKGK

SEQ ID NO: 18653 - protein, 293 aa, Vitis vinifera
DACENWGFFELVNHGISHELMDTVEKLTKEHYKKCMEQRFKEMVASKGLEAVQSEINDLDWESTFFLRHLPTSNMSEIPDLEEDYRKAMKEFTAHLEKLAELLLDLLCENLGLEKGYLKKAFYGSQGPSFGTKVSNYPPCPQPELIKGLRAHTDAGGIILLFQDDKVSGLQLLKDGQWIDVPPMRHSIVISLGDQLEVITNGKYKGVMHRVIAQTDGNGMSLASFYNPGSDAVIYPAPALVEKEKETSEVYPKFVFEDYMKLYAGLKFQAKEPRFEAMKAMEPTVNLGPIATV

SEQ ID NO: 18654 - protein, 385 aa, Populus nigra
MAIDCIKTMPSITTPHHHPKDQDQCKDDGKSFVFDAQVLRHQTNIPQQFIWPDHEKPNINAPELQVPLVDLGDFLSGNPVAAVEASRLVGEACQKHGFFLVVNHGVDKTLIAHAHNYMDTFFELPLSEKQKAQRKIGESCGYASSFTGRFSSKLPWKETLSFRYTAEKNSSKHIEEYFHNRMGEDFAEFGRVYQDYCEAMSTLSLGIMELLGMSLGVSREHFREFFNENDSIMRLNYYPPCQKPDLTLGTGPHCDPTSLTILHQDQVGGLQVFVDNEWRSISPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQQSFS

SEQ ID NO: 18655 - protein, 476 aa, Sphingomonas paucimobilis
MTAYPSLHMIIDGEAVTGGDRRTQTIVNPATGETLGELPLADTADLDRALETAQRGFQRWRNSTPQERAAVLSGAARLLMERQETLARIATMEQGKTLAESRIEVMMVAGLFNFYAGEVFRLYGRALVRPAGTRSTVTYEPVGPLAAFSPWNFPLGNPGRKLGAPIAAGCSVIMKSAEETPASALGVLQCLLDAGLPSDVAQAVFGVPDEVSRYLLASPVIRKLSFTGSTVVGKHLAKLAADDLKRTTMELGGHGPVLVFNDVDVDRVLEVMVGHKYRNAGQVCVSPTRFIVQEDVYETFRDGFAERAKALRVGNGLEDGIQMGPMANARRPDAMERLNRSAVDAGATLNAGGERIGNQGFFYAPSVLSDVPLDAEIMNEEPFGPVALINPYRTADEMIAEANRLPYGLAAYSWTNDVKMQRRIAREVETGMLGINSVAIGGADSPFGGVKWSGHGHEDGPEGVQACLVTKAVHEG

SEQ ID NO: 18656 - protein, 509 aa, Prunus cerasus
MTDRRAQDNAVSGQPLLKKKPKRNLYAIGCAILASMTSILLGYDIGVMSGASIYIQKDLKISDVEVEILIGILNLYSLIGSAAAGRTSDWIGRRYTIVFAGAIFFTGALLMGLATNYAFLMVGRFVAGIGVGYALMIAPVYNAEVSPASSRGALTSFPEVFVNIGILLGYVANYAFSGLPIDLGWRLMLGVGVFPSVILAVGVLSMPESPRWLVMQGRLGEAKQVLDKTSDSLEEAQLRLADIKEAAGIPEHCVEDVVQVPKHSHGEEVWKELLLHPTPPVRHILIAAIGFHFFQQLSGIDALVLYSPRIFEKAGITDSSTLLLATVAVGFSKTIFTLVAIGFLDRVGRRPLLLTSVAGMIASLLCLGTSLTIVDHETEKMMWASVLCLTMVLAYVGFFSIGMGPIAWVYSSEIFPLKLRAQGCSMGTAVNRIMSGVLSMSFISLYKAITMGGTFFLYAGIATVGWVFFYTMLPETQGRTLEDMEVLFGKFWRWREGYALLRNKRAVVC

SEQ ID NO: 18657 - protein, 328 aa, Egeria densa
MQYKNLGRSGLRVSQLSYGSWVSFGNQVDVKEAKALLQCCRDHGVNFFDNAEVYANGRAEEIMGQAFRELGWKRSDLVVSTKIFWGGPGPNDKGLSRKHVVEGLRASLKRLDMDYVDIVYCHRPDASTPIEETVRAMNHVIDRGWAFYWGTSEWSSQQITEPWAAAENLDLVGPIVEQPEYNLLSRHKVEAEYLPLYEKYGIGLTTWSPLASGVLTGKYTKGNIPADSRFALENYKNLASRTLVDDILRKVNGLKPIAAELGVPLAQLAIAWCASNPHVSSVITGATKESQIIENMKAIDVIPLLTPEVLEKIEAVVQSKPKRPESYR

SEQ ID NO: 18658 - protein, 487 aa, Pseudomonas sp. TW3
MRETKEQPIWHGKVFSSNWVEAQGGVANVVDPSNGNIIGVTGVANGKDVDAAVNAAKRAQKEWAAIPFSERAAIVRMAAEKLKEREHEFADWNVRECGAIRPKGLWEAGIAYEQMHQAAGLASLPNGTLFPSAVPGRMNLCHRVPVGVVGVIAPWNFPLFLAMRSVAPALALGNAVILKPDLQSAVTGGALIAEIFSDAGMPEGVLHVLPGGVDVGESMVANSGINMISFTGSTQVGRLIGEKCGRMLKKVALELGGNNVHIVLPDADLDGAVRCAAWGTFLHQGQVCMAAGRHLVHRDVAQQYAEKLALRANNLVVGDPNSDRVHLGPLINDKQVVRVHALVESAQRAGAKVLAGGTYQDRYYQATVIMDVKPEMEVFKSEIFGPVAPITVFDSIEEAIELANSSEYGLAASIHTTALATGLDIAKRLNTGMVHINDQPINCEPHVPFGGMGSSGSGGRFGGLASIDEFTQSQWISMVEKSASYPF

SEQ ID NO: 18659 - protein, 291 aa, Blumeria graminis
MPTDGIPPMLGQSSPLKLRKYEGRLSDDNFRNHVIAAIGEFLGTTLFLFYGFLAAQIINSKPDNLSDAPSLLQLIFVASAFGVSGAVNVWLFYRVSGGHLNPAITIGLTLIGAVPVTRALLLVSVQLLGGILAASLVLAVTPGSLNVQTALGNATSVKQGFFLEMILTATLVLTVFMLAVEKHRTTPLAPLGIGLILFLDVLLAAQFSGGSLNPARSFGPAVVELNFATYHWIYWFGPIAGAVLAAAIFKVLKFLAYETAVAGQDHDGLDVYRLIDDAGGHEVDREIQLEV

SEQ ID NO: 18660 - protein, 141 aa, Arabidopsis thaliana
MMINAKKLMKLAKKWQQRAALKRKRISFQRSSITTSSQTAVEKGCFVVYTADKIRFSFPLSYLSNTIIQELLKISEEEFGLPTEGPITLPFDSAFLEYLINLIQRRMDEDTEKALLLSISSARSSFQPQQHCSATQQLLVF

SEQ ID NO: 18661 - protein, 143 aa, Arabidopsis thaliana
MMINAKKLMKMAKKWQQRAALHRKRISFQRSNVFTSSSSTVEKGCFVVYTADKIRFAFPISYLSNSIVQGLLKISEEEFGLPTEGPITLPFDSVFLEYLIKLIQRRMDGDTEKALLMSISSAKCSLQCSLLQQEQSTQQLLVL

SEQ ID NO: 18662 - protein, 268 aa, Salmonella typhimurium
MERYENLFAQLNDRREGAFVPFVTLGDPGIEQSLKIIDTLIDAGADALELGVPFSDPLADGPTIQNANLRAFAAGVTPAQCFEMLAIIREKHPTIPIGLLMYANLVFNNGIDAFYARCEQVGVDSVLVADVPVEESAPFRQAALRHNIAPIFICPPNADDDLLRQVASYGRGYTYLLSRSGVVGAENRGALPLHHLIEKLKEYHAAPALQGFGISSPEQVSAAVRAGAAGAISGSAIVKIIEKNLASPKQMLAELRSFVSAMKAASRA

SEQ ID NO: 18663 - protein, 241 aa, Phleum pratense
AIPKVPPGPNITATYGDKWLDAKSTWYGKPTGAGPKDNGGACGYKDVDKPPFSGMTGCGNTPIFKSGRGCGSCFEIKCTKPEACSGEPVVVHITDDNEEPIAPYHFDLSGHAFGAMAKKGDEQKLRSAGELELQFRRVKCKYPEGTKVTFHVEKGSNPNYLALLVKYVNGDGDVVAVDIKEKGKDKWIELKESWGAIWRIDTPDKLTGPFTVRYTTEGGTKTEAEDVIPEGWKADTSYESK

SEQ ID NO: 18664 - protein, 247 aa, Saccharomyces cerevisiae
  misc_feature (1)..(1): Xaa can be any naturally occurring amino acid
  misc_feature (167)..(167): Xaa can be any naturally occurring amino acid
XRTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 18665 - protein, 247 aa, Saccharomyces cerevisiae
  misc_feature (167)..(167): Xaa can be any naturally occurring amino acid
ARTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 18666 - protein, 138 aa, Listeria monocytogenes
QFEGAYNVDGKGLSVQDVTPKGGFGHITDGPTPDNLKLEGIDFYHRYKDDVKLFAEMGFKVFRTSIAWSRIFPNGDETEPNEAGLKFYDDLFDELLAHNIEPLITLSHYETPLHLSKAYDGWVNRKMIDFYENYVRTV

SEQ ID NO: 18667 - protein, 138 aa, Listeria monocytogenes
QFEGAYNVDGKGLSVQDVTPKGGFGHITDGPTPDNLKLEGIDFYHRYKDDVKLFAEMGFKVFRTSIAWSRIFPNGDETEPNEAGLQFYDDLFDELLAHNIEPLITLSHYETPLHLSKTYDGWVNRKMIDFYENYVRTV

SEQ ID NO: 18668 - protein, 429 aa, Deinococcus radiodurans
MTGNEQNPSKWLAAEKKYDSGVYNKHDVVMVRGQGATVWDENGRSYIDCVVGYGVATLGHSHPDVVKAVQEQAGKLMVMPQTVPNDKRAEFLQELVGVLPQGLDRVFLCNSGTEAMEAAKKFAITATGRSRFVSMKRGFSGRSLGALSFTWEPKYREPFGDAVDNKSVDFVTYGNLDELRAAVTEQTAAVIMEPVQGEGGVRPASAEFIQEARRITREKGALLILDEIQTGFCRTGKMFACEHFGVIPDGMTLAKAIAGGTPTAAFAMMSEVADRMPAGGHGTTFGGNPLSMAAGVASLRAMKREGLAEQAREKGAYMMDKLRAIQSPKIREVRGLGLMIGVELKEKSAPYIHAMEHDEGVLCLAATPLVVRFLPPAVISKEQIDQVVAAFERVLNNVNPREERQAELRAQQSEMGQQQVSQGESVQTE

SEQ ID NO: 18669 - protein, 476 aa, Lactobacillus plantarum WCFS1
MMTTINEMHQIFNLQKIQYDRAQPMTYEERVTVLNQIEALIRDNIPELITALQADFGQRDPLQILSADLTGPLATIAYIKKHLRKWILPAKQRSGLMALTGTKQYVYNEPLGVVGIMSPFNAPIDLALDPAVEAIAAGNRVMVKISEYTPKTAALVQKLSQQYLNEKNFAVVTGEADIAAQFSALDWDKLVFTGGSETGKKVLSAAAPNLTPVVLELGGKNPAVVLPDANKQMTAAKIARSRSGNSGQICLDTDYVLLPTDQLDEYVGLITAQLAQVFPTYINNSEYSAIINDRSYDRILGMLTEARQRGTRLITINPNNELVPYVKRRLIPLTLAINPDRDLQIARNEIFGPILSIFTYDSLDEAIAFINSHEKPLAMYLFGRSSRHLNQIISQTSSGGVDINELSLHAGSHSMGFGGVGYSGMGRYKGGKIGFETFSNQKSVYKQGVLAKYTTRLMVPIHNKRNEKLLKRMLGL

SEQ ID NO: 18670 - protein, 334 aa, Lactobacillus plantarum WCFS1
MKAAIITKYKQITPMVTEVPVPTIAPTDVLVKIVAASVNPIDLKTKDGDLRLLLQYTMPLIMGSDFAGVITAVGDQVPDFKVGDAVYGRAPKDRIGTFAEFIAIDHQAIALKPANLNFEEAAAIPLVGLTSYQALHDIMNIQPGQKVFIPGGSGGIGIIAIQLAKYFGAYVATTTSAKHFDLVQSLGADKIIDYHQQDFTDVLSHYDAVLDTRGGQSLEAAFQIIKPGGQIVSIAGLPNARFGKDYGLPIWKQWLLGLATRKLSRLEQQAQATYSFLFMQPSGQQLVRLRQLIEQGVIKPVVDRIIPLTDINAALEYSHSGHTTGKIIISIQPN

SEQ ID NO: 18671 - protein, 325 aa, Lactobacillus plantarum WCFS1
MQALVVPDPSAQTMEQLQWQERPMPNLGPTEVLIKTQAVGLNPVDFKLVAAGNAAWQYPHTLGLDTAGIVEAVGAEVTNFRPGERVCGHANLANNGTFAEYVSLPAAVLAKIPTTVSFEAAAASLCAGLTAYQALLRKANLNAAQTVLIHAGAGGVGSMAIQLAKAAGKTVFTTVSKAKQAFVAPLHPDAQIDYHHEDVTTRIQDLTQQHGVDLIINTIGHADADLPRLAYNGQLVCVLATPDHFPSNQVVTISKLDLGGAHRSGNPAQVADLGQMTAALLALVQAGKVDPLITQVLHRDQLVTGLQQLQAGQVVGKLVVTFDAC

SEQ ID NO: 18672 - protein, 454 aa, Lactobacillus plantarum WCFS1
MQRKLSTGQMQMIALGGTIGVGLFMGSSSTIKWTGPSVLIAYIVSGAFLYLIMRALGEMLYVDPNTGSFAKFASEYIHPVFGYLTAWSNIFQFVVVGMSEMIALGGYCRYWWPNLPDWIPGLIAIVFLCAANLISVKMFGTLETWFSLIKVVTIILMIIAGLGLIIFGIGNGGHPIGISNLWTHGGFFTGGVKGFVFALAIVLASYQGIELIGVTAGEAENPQSTIVKAIRSTVARILIFYVGAIFVIVSIYPWDKLSQIGSPFVQTFAKIGITAAASIINFVVITASLSGTNSGIYSASRMTYTLAESHQLPRKMTLLNRHGVPFYSVIAIATGILIGVVLNVVLPMFFKDASEIFVMVYSSSVLPGMVPWFVILVSQIAFRKQNAAKMANHPFKMPLSPYSNYLTLAFLALTLVFMFINPETRYSILVGVVFLVIMTLIYFRKYAGNKEETL

SEQ ID NO: 18673 - protein, 290 aa, Lactobacillus plantarum WCFS1
MTTINAANAGTYAFDDQFKVNRMGYGVMQLTGPGTWGPYADPENGVKVVKKALEYGVNFFDTADSYGPWFADRYLAAGLKDAANRDQIFISDKVGQTRQGPNVWTPLGEPRYLRQQVEVSMMTLGIDHEDLVFLHRIDPHYSIADQVGELKKLQDEGKIKHIGLSQVTVDQIKEAQQVAKIDAIENLYNVANHGDDDVVDYAASQKMAFLPWFPLATGELAQAGSVLSTMAQKYQVSPAQIALAWLLKRSDNIIPIPGTSSIEHLRDNVAAANVDLTTADFNGLSQLSVK

SEQ ID NO: 18674 - protein, 375 aa, Lactobacillus plantarum WCFS1
MKGCFIVTSFNEPLKFKSGVTLRNRLMMSPMTTTQSFYNGSITHDEIDYYTQRATGLGAVITGAANVEDLGKGWHGELSIAHDTMLPGLSALAHGIQSQGAKAIVQIFHAGRMTHRAVLNGEQIVSASAVAALRDDAETPRAMSIDEIHATISAFGEATRRAIQAGFDGIELHGANTYLIQQFFSPHSNRRTDEYGGRTPQERFRFIDELLKAVFAAVDQYADRPFIVGYRFSPEEFEEPGIRLEDTLWLLSQLRESRLDYVHVSLNNYDRVSRDPQYQDKSIMTYVHEALQGKLPLVGVGGVRTRDDVKTVLQTAELVAVGQQLLYDPTWAVKLAKNADNTMVTAPFEEAVEVTPLSRPLYEFAASRYHSVINS

SEQ ID NO: 18675 - protein, 440 aa, Lactobacillus plantarum WCFS1
MARDTQTQLRNEMIYSVFVRNYSEAGNFAGVTADLQRIKDLGTDILWLLPINPIGEVNRKGTLGSPYAIKDYRGINPEYGTLADFKALTDRAHELGMKVMLDIVYNHTSPDSVLATEHPEWFYHDADGQLTNKVGDWSDVKDLDYGHHELWQYQIDTLLYWSQFVDGYRCDVAPLVPLDFWLEARKQVNAKYPETLWLAESAGSGFIEELRSQGYTGLSDSELYQAFDMTYDYDVFGDFKDYWQGRSTVERYVDLLQRQDATFPGNYVKMRFLENHDNARMMSLMHSKAEAVNNLTWIFMQRGIPLIYNGQEFLAEHQPSLFDRDTMVADRHGDVTPLIQKLVTIKQLPLLRAADYQLAVVEEGIVKITYRAAGEALTAWIPLKGQVTAVATKLAAGSYQNLLTDGPTEVVDGKLTVDGQPVLIKYVTNTAVTKVADQSN

SEQ ID NO: 18676 - protein, 161 aa, Lactobacillus plantarum WCFS1
MAESVYDFTETEMSGAPLDLSQYRGQVLLIVNTASNCGLAPQFKGLEELYQKYQQEGLVVLGLPSNQFHQEKADDDETHDYCQRHYGVTFPMTKRVMVNGDDADPLFTYLKQAAGHGRIKWNFTKFLIGRDGRVLERYAPTTRPATFEAAIRDALADRSED

SEQ ID NO: 18677 - protein, 303 aa, Lactobacillus plantarum WCFS1
MLIQHVQELIGHTPLMALPIEVPNHSHIYAKLEMFNPGGSIKDRLGAYLIEDGLQRGRVNAKTTIIEPTAGNTGIGLALATQAHHLRTILVVPEKFSMEKQVLMQALGAEIVHTPSEEGIKGAIRKAEALAATISNSYVPMQFKNPANPAAYYHTLAPEILADMPAPITAFVAGAGSGGTFAGVAAYLQAQDSATKAVVVEPEGSILNGGPAHAHRTEGIGVEFIPPFFDQVRIDQTLTIADNDAFAQVRHLARDHGLLIGSSSGAALAASLQLATNLPANSHIVTIFPDSSERYLSQKIYTK

SEQ ID NO: 18678 - protein, 391 aa, Lactobacillus plantarum WCFS1
MKFEESKILQQLPKQFFANLVKKVNAKAAAGADVINLGQGNPDQPTPEFVVKAMQTATANPADHKYSLFRGLPRFKQAAADFYEREYGVKLDPETEIAVLGGSKIGLVELPFALLNPGDTMILPDPGYPDYLSGITLAQVKLALLRLTAANHFLPDYQQVDPQVAAAAKLLYLNYPNNPTGAVATSQFFQDTVDFANEHQIGIVHDFAYGAIGFDGQRPVSFLQTPGAKDVGIEMYTLSKSFNMAGWRVGFAAGNADMIEALNLIQDHLFVSVFPAIQDAAIAALNSDQQTVHELVRLYERRRNQFFTTARKIGWEPYPSGGSFYAWMPVPEGYTSEAFADLLLDKAAVAVAPGNGFGAGGEGYVRVGLLIDEPRFTEACQRIAKLHLFDR

SEQ ID NO: 18679 - protein, 443 aa, Lactobacillus plantarum WCFS1
MAEQYDVVVIGGGPAGNAMASGLKAQGKTVLIVEADLWGGTCPNRGCDPKKILLSAVEARQAAQHLQGQGLIGAPKIDWPALMAHKRGYTDGINDGTLNGLTGQDIATLHGQAHFQSDNQLAVGDRVVSATDYVIATGQRPAILPITGHEYFKTSTDFLDLDQMPKRVTFVGGGYVGFELATIANAAGADVHVIHHNDRPLKAFDADLVKDLMAAMTADGITFDLNTDVQAITKTATGLQLTADNFELTTDLVISSAGRIPNADQLGLANVGVTFDRHGIQVNDHLQTANPHIYAIGDVSDTPVPKLTPVAGFEARYLVGELTHPGAAIKYPVVPTQVFAAPKLAQVGISAAVATEHPDEYRVNTLDMTKWFTYYRFGAQQAQAKVVVAKASGQVVGATLLSDVADEMINYFTLLIEKHVTLPDLQRLVLAYPTPASDLQYLY

SEQ ID NO: 18680 - protein, 240 aa, Lactobacillus plantarum WCFS1
MMKDPLALQLLGEFLGTFILILLGDGVVAGVTLNKSKAQNAGWVAITLGWGFAVTMGVYASSFMSPAHLNPAVSLGMAVAGKFPWAYVIPYSAAQIAGGVIGGLVVWLHYYPHWQATKDAGAILGIFATGPGIRRYFWNFISEVIGTFVLVFGLLAFTKGQFTAGLNPIVVGILIIAIGLSLGGTTGYAINPARDLGPRIAHAVLPIANKGTSDWAYSWVPIAGPLVGGALGALLFNVLP

SEQ ID NO: 18681 - protein, 478 aa, Lactobacillus plantarum WCFS1
MTIKGRAFPEGFLWGGAVAAHQLEGGYKEGGKGLSTADIMTLGTNERPREITDGVVAGKYYPNHQAIDFYHRYPEDIELFAEMGFKCFRTSIAWTRIFPNGDESEPNEAGLQFYDDLFDECLKNGIQPVVTLAHFEMPYHLVKQYGGWRNRKLIQFYLNFAKVCFERYRDKVTYWMTFNEINNQTNFESDGAMLTDSGIIHQPGENRERWMYQAAHYELVASAAAVQLGHQINPDFQIGCMIAMCPIYPLTAAPADVLFAQRAMQTRFYFADVHCNGTYPQWLRNRFESEHFNLDITAEDLKILQAGTVDYIGFSYYMSFTVKDTGKLAYNEEHDLVKNPYVKASDWGWQVDPVGLRYAMNWFTDRYHLPLFIVENGLGAIDKKTADNQIHDDYRIDYLTDHLRQIKLAVLEDGVDLIGYTPWGCIDLVAASTGQMSKRYGFIYVDENDDGSGSLKRYKKDSFTWFQHVIATNGAEIE

SEQ ID NO: 18682 - protein, 389 aa, Lactobacillus plantarum WCFS1
MTMQHVFPTYQRFPFAITDGQGVHLTDNHGKTYLDFTAGIGVCNFGYHQPQIQAAVTQQLTHIWHTSNLYENELQDAVAGLLANGEERLVYFANSGTEANEAALKLARKYTGKTGILAFQHSFHGRTYGAMSMTGNPHIQAGYAPLVPGITFATYNDDAALDKITPELAAVILEVVQGEGGVFAGQTAWLQAVNAKCQATGVLLIIDEVQTGIGRTGYRMAYEGYGLDPDIYTVAKGLANGLPVGAMVGRRQLATAFGPGSHGSTFAGNAVAMAAAKCVLPQLTPALLTTVRAHAKLVWQSLATQVEPIPVVKQITGKGLMIGIHLDEQIPVNQVITRLQVEGLLTLSAGDNTLRLLPPIVMQPADLLAGIALIAKVLTTLTTEVTTNE

SEQ ID NO: 18683 - protein, 180 aa, Lactobacillus plantarum WCFS1
MNNDIERVLYSREDIHQVAQKLGKELTTAYAGKNPLIICVLKGAVLFTTDIIREMDIYADLDFINLSSYGNETISSGEVQLTKDLDADVTGRDVLVIEDIIDTGRTLKFLIDLLKRRDVNSVKVCTLLDKPAGRLVDIKADYIGFEVPNEFVVGYGLDYAERYRNLPYVGILKPAIYEHK

SEQ ID NO: 18684 - protein, 492 aa, Lactobacillus plantarum WCFS1
MTQIYPDDSFTLHTDAYQINMIQTYWEQGIHNKHAVFEVFFRKMPFRNGYAVFAGLERVVNYINHLHFTATDIAYLRELGGYSDGFLDYLANFKFDATIRAVREGDLVFNNEPLLQVEGPLATCQLIETALLNIINYQTLIATKAARIKSVVGEDGLLEFGTRRAQEFDAAIWGTRAAYIGGFDATSNVRAGKIFGIPISGTHAHALVQTYRNDYQAFKAYAETHHDCVFLVDTYDTLRSGVPSAIRVAKEMGDKINFQGVRIDSGDMAYLSKRVREQLDEAGFPDAKIYASNDLDEKTIQNLKMQGAKISVWGVGTKLITAFDQPALGAVYKMVSIENDHHQMVDTIKLSNNAEKVSTPGQKQVWRITKRADGKSEGDYVTLYDEDPRNEESIYMFHPSYTYINKTVSDFDARPLLVPIYDRGQQVYTLPTLDEIKEYSFESLDALWDEYKRDLNPQDYPVDLSQKLYDHKMNIINTVRDHVNHKDEEEAY

SEQ ID NO: 18685 - protein, 225 aa, Lactobacillus plantarum WCFS1
MTELVLVRHGESTANRDNTYTGWSDVPLTAVGIAQAHQAGKRLRATGLQFGAVHTSVLKRAIVTANIMLSEIDQLWLPEYKTWRLNERHYGALRGQNKDVTRQEYGKAQVQQWRRSFYTVPPLLTPAELDHDRRYTKYGAAVEPRGESLKMAYDRIMPYWIDEIAPRLLDGQNQLVVAHGSTLRAMIKYLEHISDTGIDGVEVANGVPICYHLDRQLHVIGKEEY

SEQ ID NO: 18686 - protein, 459 aa, Lactobacillus plantarum WCFS1
MAKAKTQFVCSNCGYSTPRYLGRCPNCGEWNTLTEEHFDTKPDRKSRVSFAGKSAKPQRLKEVSLTKTPRVKTKLKEFNRVLGGGVVPGSLVLIGGDPGIGKSTLLLQVSGQLAETGGSVLYVTGEESASQVKMRADRLAVSSEDFYLYPETDMSNIRSTIESTHPEFVVIDSVQTMQEPDMDSAIGSVSQIREITAELLQIAKTNGITIFIVGHVTKGGAIAGPKILEHMVDTVLYFEGDLHHTYRILRAVKNRFGSTNELGIFEMRTGGLYEVANPSEIFLEERLKDATGSAIVVSMEGTRPILVEVQALVTPTVFGNAKRTASGLDHNRVSLIMAVLEKRASLMLQNQDAYLKAAGGVKLDEPAIDLAIAVSVASSYRDQQTRPSDCFVGEVGLTGEIRRVNRIESRVGEAAKLGFKRIFIPKNNLQGWDIPTGIEVIGVATLKEALQLALQQPNY

SEQ ID NO: 18687 - protein, 470 aa, Lactobacillus plantarum WCFS1
MKIVIVGCTHAGTAAAAQILKDHPEATVTIYERDDNISFLSCGIYLYLGGKVNHLEDMFYSSPETLAKLGAMVRTKHNVLKIDAQSKTLQVVDMTTGKVFGDTYDKLIMTTGSNVAVPPIFGIDESKVLLCKTYSQAQEIYQTAQDNQRIAIIGAGYIGTELSESYANTHHEVTLFQSHDQILNNYISKEISDQAVQLLKDHGVNVLLNHQVTAFTGNDDGELVIETNQGDFNADLAIVGTGFVPNTELLRGQVEMDKHGAIIINDYVQTSDPDIYAAGDSCVVNFNPTGRSAYTPLATNAVRQGALAGANVFGNQQRYMGTQATSAMQLFDHTLATTGLTLAMAKLNHIPAERVTYEGNWRPAYMPSTAKLTIELIYNPENRKILGAQFLSAHEVAQSANALSIAIQNGNTIDDLAFVDMLFSPNFDEPFNYLNLVAQQAIEQERQAGRNHPRITAYGDWAKQNDKDLQ

SEQ ID NO: 18688 - protein, 324 aa, Lactobacillus plantarum WCFS1
MTKVFIAGQLPAQANTLLLQSQLVIDTYTGDNLISHAELIRRVADADFLIIPLSTQVDQDVLDHAPHLKLIANFGAGTNNIDIAAAAKRQIPVTNTPNVSAVATAESTVGLIISLAHRIVEGDHLMRTSGFNGWAPLFFLGHNLQGKTLGILGLGQIGQAVAKRLHAFDMPILYSQHHRLPISRETQLGATFVSQDELLQRADIVTLHLPLTTQTTHLIDNAAFSKMKSTALLINAARGPIVDEQALVTALQQHQIAGAALDVYEHEPQVTPGLATMNNVILTPHLGNATVEARDGMATIVAENVIAMAQHQPIKYVVNDVTPA

SEQ ID NO: 18689 - protein, 400 aa, Lactobacillus plantarum WCFS1
MAKLIVSDLDVKDKKVLIRVDFNVPIKDGKIGDDNRIVAALPTIKYVIEHDGKAILFSHLGRIKSEDDKKGLSLRPVAERLSNLLNKPVTFVPVTEGEQLETAINNMNDGDVLVVENTRFEDVVNGEQVKRESGNDPELGKYWASLGDVYVNDAFGTAHRSHASNVGIASNMDQVAAGFLMEKEIKFLGDAVDNPKHPFVAILGGAKVSDKIGVIDHLISKADKIIIGGGMTYTFYAAKGMGIGNSLVEKDKIELAKSIIEKAGDKLVLPSDSIVAEKFDNDVPSKVVEGSIPDGYMALDIGPKSIEEFEDVLRDAKTVVWNGPMGVFEMSNYAKGTLEIGKFLGTLSDATTIVGGGDSTAAVKQLGVGDKLTHISTGGGASLEYLEGKELPGIAAISEK

SEQ ID NO: 18690 - protein, 252 aa, Lactobacillus plantarum WCFS1
MRTPIIAGNWKMNKTASEALAFVNAVKDQLPDPSKVESVVAAPALFLQEMVEAAKGSDLKIAAENAYFEDAGAFTGETSPAALADLGVDYVVIGHSERRGYFHETDEDINKKAHAIFKNGMKPIICCGESLEQREAGEAESWVSGQIKAALKDLSADQVSSLVIAYEPIWAIGTGKTATSDQAEEICAVVRKTVADLYSQEVADKVRIQYGGSVKPANVNELMGKDDIDGGLVGGASLQPDSFLELVNYQNN

SEQ ID NO: 18691 - protein, 442 aa, Lactobacillus plantarum WCFS1 [sequence omitted]

SEQ ID NO: 18692 - protein, 244 aa, Lactobacillus plantarum WCFS1
MAKVIVKDLHKSYGDNEVLKGLNLEVQDNEVVCMIGPSGSGKSTFLRCLNDLEVPTQGQVVISGYDLSDKETNINLVRENIGMVFQHFNLFPHLSVLQNITLAPTQLKKESQQEAEKTARDLLATVGLSDKADAMPKSLSGGQKQRVAIARALAMHPKIMLFDEPTSALDPEMVGDVLDVMKKLAADGMTMIVVTHEMGFAKEVADRVVFMADGLIQETGKPEDVFEHPQSPRLQDFLQKVINV

SEQ ID NO: 18693 - protein, 435 aa, Lactobacillus plantarum WCFS1
MNKIAAYFNFSELKTSMRTEVLAGLTTFVSMAYILFVNPSVLGASGMDKGAVFTATALASALGCLLMGLVAKYPIAIAPGLGVNAFFTYSVVIGMGIKWQTALAGVFVAAVIFILITIFKLREMIIDAIPRDMKLAISAGIGFFIAFIGLHGGGLIVANKSTVVGLGSLTVGTTWLTIFGLIVTLILMSRKVPGGIFIGMVLTSILGLATGLIKMPSTIVSAAPSLKPTFGVALGHIGDINSLQLIIVVLTFLLVTFFDTAGTLVGLAEQAGFMKNNKMPRVGKALMADSTSMLVGSVLGTSPTSAYVESSAGIAVGGRSGMSAVVTGALFILGLFFSPLLNVVTDQVTAPALIIVGVLRAESLKEISWERFEIAVPAFLTVIGMPLTYSISDGIALGFIAYVITMVATKHAKEVHPLMYVLFFIFIIFLWILNV

SEQ ID NO: 18694 - protein, 465 aa, Lactobacillus plantarum WCFS1
MGIFQRIFQKEDLERYLQKDSHFERTLSAVDLIALGIGAVIGTGIFILPGTVAATKAGPGIILSFVLAAIVCAVAAMCYAEFASVLPIAGSAYSYGNIVYGEMIGWIIGWALVLEYVLAVATVAVGWAAYFNSFIAGFGLKLPKAITGSFDPAHGTYINVIAILIVCLIAWIIDTGLKTSIRLNNIIVVVKLAIIVLFLLVGSFYVKPSNWTPFAPFGGTEILKGAAVVFFAYLGFDAVSSSAAEVKNAKRNMPIGIIGTLVICTIFYILVSGVLTGMVSYKQLNVDDAVAFALQLVHQNFVAGIISIGALAGMFTMMVTMIYSSSRLLYSIGRDGLLPRFLGKIDKHHAPKNAMLTVTIVNSILAGLIPLDQLANLVNIGTLIAFAFVSFGILLLRRNPKLNAIKGFRVPLYPVLPIISGLLCLFMMTQLSMETWLASLVWFLLGLIIYFGYGIRHSRMNKADE

SEQ ID NO: 18695 - protein, 244 aa, Lactobacillus plantarum WCFS1
MIEFHDVEKYYGDFHALKNINLTINEGEKVVLIGPSGSGKSTLIRTVNGLERVQSGQLLVNGFDLADRKTDMNKIRKNVGMVFQHFNLYANKTVLENIMIAPRLVLKRPEDENKKLAMDLLDSVGLADKANSLPSQLSGGQSQRIAIARSLAMKPKCLLFDEPTSALDPEMIDDVLNVMKSVAEDSSMTMLVVTHEMGFAREVADRVIFMADGEILEDDAKEKFFDGQPSNERARQFLSKIITH

SEQ ID NO: 18696 - protein, 500 aa, Lactobacillus plantarum WCFS1
MDVYKTSPNFMWGVATAANQVEGAWNEDGKGMSIADCLRYRPQIDSSDYQAVNQMDSAEIENALNDESTKGWAKRHGVDFYHHYREDIKQLAETGINTYRFSISWARIFPNGDDKCPNQAGLDFYLSLVKELAKYQITPVVTLSHYEMPLNLVLNYDAWYDRRVADFFGRYARTVIDYLHDYVKYWIPINEIDSIIRHPFSSAGLVADRFASHDFKTVIYQAMHHQFVAAAQVVKYCHRHYPQMQVGSMITRTMVYPYNSDPNNVLAATQTMREVYAFSDIQVRGEYPEFLLTKLKKAHITIEFQEGDQEVLRENTADFVAFSYYSSICTASNVEGLRVTKANRTVGVYNRYLPESEWGWQIDPVGLRLSLIDLFDRYQKPLFIVENGLGAVDELSSDLRVHDIYRISYLRQHIRQMLIAIANDGVDLMGYCMWGTTDMISASSNQMSKRYGLIYVDLDDNGDGSYNRYLKDSYFWYQELLSYKNQIPAIFLDENSIVIQ

SEQ ID NO: 18697 - protein, 380 aa, Lactobacillus plantarum WCFS1
MKSGKHRVSLLILLCLMVVGLAGCHNKAYSQSIEKGLNAVAENKYQKALTYFDNALAQKPKDEKAQAYRDQTQAYLTTTSELKAGKVKTALTTVDKGVKITNGATSLTNKLKQLKVTVTSDYQEYQQLSDDVKAQLKVKNGNYSADVLKRCAAINWDKKPYLKPLKAKVKQLLAAAKKAKTNMKVSAAEAKRAAALRRKIAAAKNKWNMAALDDVPDWFILALFADDSDVDDAAEELDDEYADQADDNDDYSDWDEQTTDSNDDTNDTDADSADDDWSDQDTDSNDDTDDDSDTNSDADSDSDYSEDDDDEDSNRDDADDSETQSDDDYDDDTDSESDDDDYDTDDQYDDDDDYDDAESLLNPAPVQPSVADRLFASASC

SEQ ID NO: 18698 - protein, 483 aa, Lactobacillus plantarum WCFS1
MAEKQHQEVHRSLQTRHLSMIALGGSIGTGLFVASGSAISTAGPGGALLAYVGIGVMVYFLMTSLGEMATYLPVSGSFSTYATKFVDPALGFAMGWNYWFNWAITLAVDISTAAIVMQFWLPSVPGWVFSLIALVLIFTINALSVRSFGETEYWLSLIKVVTVLVFLVIGVLTIVGIMGGHATGLSNFTYKKAPFVGGIPTILSVFVVAGFSFQGTELIGITAGESATPEKSIPAAIKQVFWRILLFYILAIFVIAAIIPYTSKDLLGSSASDIAISPFTLVFKRAGLAAAASVMNAVILTSVLSAANSGMYASTRMLYSLSLQGYAPKTFGRVNRRGIPIMALLGTTVIGLLTFLSSLFGERIYIFLVSASGLTGFIAWLGIAISHLRFRRAFVKQGHQLSELRYHAKWFPFGPWFAFILCVVVIIGQDLHSFATLDWQAIGVTYMSIPLFIILYVYYKIRYHTKMIPLDKVDLTRKRHHQD

SEQ ID NO: 18699 - protein, 216 aa, Lactobacillus plantarum WCFS1
MNLILMGLPGAGKGTQAQKILEDFDIPHISTGDIFRAAIKNETKMGLEAKKYIDAGNLVPDEVTNGIVRDRLAEADTKNGFLLDGYPRNIDQAHALKQIGEELNKPLDGVINIHVEPAVLVERLSGRFICRTCGATYHKLYNKPKVEGTCDVCGGHDFYQRDDDKPATVKNRLDVNIKLNTPLIDYYGQEKLLYNVDGDRDIDDVYKDIKKILDNL

SEQ ID NO: 18700 - protein, 298 aa, Lactobacillus plantarum WCFS1
MKLGLIGLGKMGMNLALNMQDNGHTPVGMDLNPTNLSTASAHGLATATDLTNLLDQLPTPRIVWIMVPAGKATNSVIEQLAQTLSAGDIVLDGGNSHYQDSIRHGELLASHHINFLDVGTSGGQAGARHDGNFMIGGDLATFQVVEPLFKAIAAPDGYLYTGPVGSGHYLKMVHNGIEYGMMAAIGEGFDVLQHSQFTYDNAAVAKMWNNGSVIRSWLMGLAQDAFSKDGNLDDIKGVMHSSGEGRWTLDTALDQQVATPVIAMALMMRYRSETDDTFTGKVVAALRNEFGGHAVDHE

SEQ ID NO: 18701 - protein, 440 aa, Lactobacillus plantarum WCFS1
MSEKFDVVYLGSGHGTFDGAIPLAARGKKVAVIEADSIGGTCPNRGCNAKITLDQPVALKNQVANFQGYGLRGEPTIDWQANFDHERDVIAGLPDMIAGLMTSAGVTLINGRGTFVDDHTIQVADKTYTADKIVIATGQHPHRLDIPGTELAHDSNDFLNLTTLPHHITVIGAGYIGLEFANMALTAGSQVTLLMRGDQALRQFHQPFVERLLAILVEQGLVLKREWVPTAIKSTGDHFEVLSADDKVTTDWILDATGRQPNTANLGLEKIGVDYTAAGITVDDHLQTSVAGIYASGDVLAKDQPKLTPTAIFESQYLTHLFMGDTNAPIKYPAIPSVVFTSPRLAQVGTLPTSDTHDIKVTVNDLKDDWFRQTTRDVTGHNLLVTDDQHRLIGAAELGEQAENTINTLLPAIQYQLTPAQREQLVTLFPSIGAAVWSAI

SEQ ID NO: 18702 - protein, 460 aa, Lactobacillus plantarum WCFS1
MSKQTHLSRQMESRHVLMISLGGVIGTGLFLSSGYTIHQAGPIGTLLAYTIGAILVYLVMLCLGELSVAMPYTGAFHVYAKKYIGPGTGFTVAILYWLTWTIALGSEFTAAGLIMQTWFPHIATWIWSLVFMVVIFTVNALSVRWFAETEFWFASIKVIAIIAFIVLGGLAMVGILPLHGHTSAPFLSNYTRNGWFPNGFGGVFTTMLTVNFAFSGTELIGITAGETKDPAHTIPTAIKTTLWRLIIFFIGSMFVMAALIPYKQAGVTQSPFVLVFKAIGIPYAADLMNFVVLTAIMSAANSGLYASTRMLWSLANEGTIPKVFKRTTKRDVPLVALITSMLGGILALLSSVYAAGSVYLVLVSISGLAVVIVWMAIALSEINFRKAYLKSGQSLDQLTFKTPGYPVVPWLAFILSGLSCILIWFDPNQRIALYYTIPFVAICYLGYYLNQRYRRTHAAK

SEQ ID NO: 18703 - protein, 278 aa, Lactobacillus plantarum WCFS1
MQPITTEIVSRTIIKRPADSHKGNYGRIMLIGGNQNFGGAIIMAATAATYSGAGLVTVATDPSNFTSLHARLPEAMVIDYHQTDTLLNLLAGMDVIVIGPGLGTDTVADQLLTAVLAATHVPQRLVIDGSALTLLAQQARPLPATDIVVTPHQMEWQRLSGIAIKDQTPTANHDAQQRLGVMAVVKAHRTTVYTDERVWFNPGGTPAMATGGMGDTLAGMIGGFVSQFHNFTDAVLSAVYLHSAIADDLAATRYVVLPHQISTRIPTYMHRFSQIERP

SEQ ID NO: 18704 - protein, 371 aa, Lactobacillus plantarum WCFS1
MQAKYKKLFEPYTLNNDVVLKNRLVVAPLTIYDSGPDGELTPAAHNFWRNRFRGFGTWIVPFTNVHPSGIGFESPNAFHEENLPTLKAYATISHEQGAKAIIQLAHAGIHADPAMTKGYDLMGPSNLPYMGVRAMTDSEVREMVNAFAYATELAISAGLDGVEIHGANGWLIQQFVSETYNQRTDHWGGSVEKRFNFPLAIIDAIEAVRHKYHRPDFIVGYRFSPEEPGEVGLTMTETLALVDRLLDKPLQYIHISLWNFYKKIRRGGDVKKTRMEAVHDRINGRLPFIGVGDLFAEEQGLKAFNTGWADLLAVGGSVELNPNLIELIKTGQEDQIQSEFDWNEMDSYRFTPAMLYGTLAGNAMFPKVKQN

SEQ ID NO: 18705 - protein, 490 aa, Lactobacillus plantarum WCFS1
MQFPADFYWGGATAANQCEGAYDVDGRGLTMKDITTMGGLNQRRQVTYLQADGTPGKGDSIPAGAHGAVLPDDYYPNQTSIDFYHRYQEDIALFAEMGFKMYRMSISWSRIFPRGDENEPNQAGLDFYRRVFETLKKYEIEPLVTISHFDMPLYLEETYGGWNDRRMIGFYQHYAETLFTAYRGLVKHWITFNEINNTIMFLALRAKAGDADYQRAYQQLHYQFVASALAVQQAHAIDGENKVGCMICGITSYPLTCDPADVLQNRYVWEQNIYYCGDVQCQGQYPTYARRLWNEHQVDLDITDSDLEALKAGTVDWYTFSYYMSTAVTTHEVSATVGGNFSMGARNPYLQYSEWEWADDPAGLQYYLELMNDRYHLPLMVVENGLGAKDYLTVDGQIHDVYRISYLRKHIQAMATAIHHGVKLIGYTSWGCIDLVSAGTGQMSKRYGLIYVDRQDDGSGTLARIPKDSFYWYQRVIASNGQDLGPSASN

SEQ ID NO: 18706 - protein, 396 aa, Lactobacillus plantarum WCFS1
MTVEDAQTSTRWRAYLALGLATVAMIVCFMSWSNFAPLAGELAIKFHLSVSQRTLLLATPVLLGSIMRIPVGILSDRYGGKKVYLILMAFILIPLLMITKVHTYGMLLVAALLVGMAGTSFAVGVSYASVWFPPEKQGLALGIVSMGNMGNAVAALTLPSISTSYGFNMVYYFLMVLTVILAVLFAIFCREMPVDKTKTVTGALAVAKESSTWYLSLFYFLTFGLFVSFTNLTPLFLEDIFRVPQVTAGLYAALFAGLCTVVRPIGGAAADKWRPMQMLQWIFIGITVFAVIITLTFSNQSLFIFGIVGAGLIAGFGNGVIFKMVPYVLQGNTGAVTGFVGALGGLGGFFPPLLVGWIHTWTGSYRLGIVLLALTGLVCWYALWRRFIHGDVHIVK

SEQ ID NO: 18707 - protein, 478 aa, Lactobacillus plantarum WCFS1
MSNEKPQIGVIGMAVMGKNLALNIESRGYKVAIFNRTGAKTEKVVKDHADKQLVPSYKIEDFVASLETPRRIIMMVKAGKPTDAVIDELLPLLDKGDVLIDGGNTNFNDTMARNARLDKSGINFIGMGVSGGELGALQGPSLMPGGQKEAYDLVAPILEKISAKAPQDGAPCVTYIGPNGAGHYVKMVHNGIEYGDEELIDESYNIMRNVAGLSVDEMSDIFTDWNKGELSSYLIEITADILSRKDDLGADKTKPIVDMILDRGNNKGTGKWSSEDALNVQVPQSVITEAVYARYISMMKNERVAASKKLAGPTADVDLPAKEELVEKIRQALYFSKIMSYAQGFEQLRFASEHYGWDLKFGELAQIWRAGCIIRAQFLQNITDAFDKKPDLNNLLMDDYFADIAAKYQQSTREVLSLAIQAGVPVPSFSAALSYYDSYRAEVLPANLLQAQRDYFGAHTYERTDREGLYHYSWYEEQ

SEQ ID NO: 18708 - protein, 448 aa, Lactobacillus plantarum WCFS1
MAKQSYSKDDIRRIVKEENVNFLRLMFTDLFGTIKNVEVPVSQLDKLLDNKLMFDGSSIDGFVRIEESDMYLYPDLSTWLIMPWNTEHGKIARIICEVYTSDRKPFEGDPRNNLIRVLNDMREAGYTSFNCGTEPEFFLFKMNEKGEPTTELNDKGSYFDLSPMDLGENCRRDIALELERLGFNVEASHHEVAPGQHEIDFKYADALSAADHIQTFKLVVKTIARKYNLWATFMPKPLNGVNGSGMHVNMSLFHDQGNAFYDANDKNGLELSSDAYHFLGGLMKHARSYTAVTNPTVNSYKRLVPGYEAPVYVAWSASNRSPMIRIPSARGLSTRLELRSVDASTNPYLAFAAVLEAGLDGIKNGIEPPKSVDRNIYVMDEDERAAAGIADLPSTLHNALKEFQTDPTMKKALGPHIYQSFLEAKRLEWASYRQQVSEWERDQYMELY

SEQ ID NO: 18709 - protein, 217 aa, Lactobacillus plantarum WCFS1
MIKVAPSILSADFANLQRDVQMAENAGADALHIDVMDGQFVPNLSFGMSTVADLRPVTSLMLDCHLMIMDPERFVGQFAKAGADLIGVHVESTRHIYHALQLIKDAGVKAEVVVNPGTPLSMISELLPLVDQVLIMTVNPGFGGQHFLDQMVAKIAALNELKQQHGYRFEIEVDGGINDQTVKACYDAGATVAVAGSYVYDSADPAQRIQDLKVATN

SEQ ID NO: 18710 - protein, 265 aa, Lactobacillus plantarum WCFS1
MMTDLTTIFKNHKAFIAFVVAGDPNFEATVDQVVALAEAGCDLVEIGIPFSDPVADGPEIQAADLRAFDQHITPQRVFELVVAIREKTTIPLVFLTYANIVYQFGYAAFAQQCQSLNVAGLIIPDMPLEASGELRPTLDHYGIALIPLIAPTSDDARIAAIAQQARGFIYVVSSLGVTGTRRHITTDLATLVAKIRHATTLPVAIGFGIHEPAQAQAMAQIADGVIVGSAVVHLIATHQPATAVLRDYTRRMRRALDGRTADTVD

SEQ ID NO: 18711 - protein, 449 aa, Lactobacillus plantarum WCFS1
MISQNHRLDQQLIEREDHYMATAARINYYDLVIDHAHGALLTDVDGNQYIDLLASASAINVGHTHPRVVKAIQEQAAKLIHYTPAYFHHQPEQRLAERLAKSAPGTDNEVVFGNSGSDANDAIIKFARAYTNRQYIVAYTDAYHGSTYGSMSLSGVSLNMVRKMGPLLPGIVHVPYPDCYRTLPHETEHELALRYFEAFKAPFDSYLPAEETACVIIEPIQGDGGIRKAPAEYVQLVYDFCHQHGILFAVDEVNQGMGRTGKMWSIQNFPGIRPDLMSVGKSLASGLPLSAVIGRREVMESLAAPAHTFTTAANPVCCAAALATIDVLADEQLVARSANYGRYAKEQFLALQQRHPKIGQVRMYGLNGGIELVTDRQSQQPDPDFASDVIYAAFERGVVMITLKGNILRFQPPLVITKTQLDTALTVLDEAMAAAEQGLVKRPQGKIGW

SEQ ID NO: 18712 - protein, 499 aa, Lactobacillus plantarum WCFS1
MQRLLKRLTLKEDPSIYEDKDSHLARVLTVKDFLALGVGTIVSTSIFTLPGVVAANHAGPAVVFSFIVAAVVAGLVAFAYAEMAAAMPFAGSAYSWINVMFGEFFGWIAGWALLAEYFIALAFVGSGLSANLRGLLSPLGLTLPKALSNTFGTDGGVVDLIAVLVIALVSLLLSRGISKASRVENVLVVLKVLAVLTFIVVGATAIHVQNYVPFIPKYHLNADGSAFGGWQGIYAGVSMIFLAYIGFDSIAANSAEAKNPGKTMPRGILGSLVIAVVLFVAVALVLVGMFKYSSYANNAEPVGWALRQAGHPIVASVIQAIAVLGMFTALIGMTLAGSRLIYSFGRDGMLPKWLGKLHRNQPNNALLVLTIVAIIIGAFCPFAFLAQLISAGTLIAFMFVSLGIYALRRREGVDIAVPAFKMPFYPVLPAIAFLGALFVFMGLDIQAKLYAGVWFIVGLVIYFSYGMRHSYLAEKRLSETDTAAKSASKVADSTVEERD

SEQ ID NO: 18713 - protein, 446 aa, Lactobacillus plantarum WCFS1
MENQQLARKLKRRHVQMIALGGAIGTGLFLGSGLAIKQAGPSILLAYAIGGFFCYLMMRALGELLLSDTRLHSFLEFINRYLGKRFEFAIGWTYWLCWISLAMADLTASGIYIRYWFPWIPQWVTPLIIILILLVFNMLSVSAFGELEYWFSMIKVVAIIALIVTGAILIGSSAHVGGQTVSVTNLVSHGGFFPTGVQGFLMSFSLVIFAFTGIEMVGITAGEAENPEKELPRAINSLPIRISFFYVGALFVIMAIYPWNQITTSQSPFVQVFSDVGIKAAASIINFVVLTAALSACNSAIFSTSRTLFTLAHGDNAPKWMGKVNRYNVPARSLLFSSLILLVIVALNYVIPSTVFTLISNVATTNFIIVWCALLVCHYVYKRTTDSTHNPFKLPLFPVTNIATLAFFIAVTVVLCFDQVNRWAVIGSVVWFVILLVIERSMHRTV

SEQ ID NO: 18714 - protein, 449 aa, Lactobacillus plantarum WCFS1
MADYDTIFIGSGHATWHAAVALAHAQHKVAIIEEDTIAGTCTNFGCDAKILLDGPFELTEQLKQYQGIGVNTTPTIDWSQLMAYKQQVIQPLSVQMTAVFKQLGITIITGHGELTDTHTVQVADSTYTADTIVIGTGQRPAKLAIPGADLMHDSRDFLDLPTMPKRLTLIGAGIISLEFANMAVLLGSEVHIIEFADRALPAFYSEHVKKMITHLQAAGVHFHFGEALSQVTKTATGLMATTASGLKIESDDIIAATGRIPNIEHLGLTKVGIKTDRHGIIVDDHLRTSIPNIYASGDVISKTLPKLTPTAIFESNYIAGQLLGSTAAIDYPVIPAVVFTLPRIAQVGVSVEAAQHDTEHFHVQALPYGKLLAFQYQNEVDADLQLVFDQENYLVGASIYGNGALDLINLLTMIIADHVSATTLSQKIFAFPSASVGIIDMLTPLLHHD

SEQ ID NO: 18715 - protein, 261 aa, Lactobacillus plantarum WCFS1
MVKVIVAGYKGRMGSTAAQMVIDNPDFELVGVYDARSEEQNLGEDDRFKGQNVPAFHDLDQIKTDATVWIDFTIPTAVYENAKFALNHGISPVIGTTGMTDEQVAELQKLAKDKQVGGLIAPNFGISAVLLMQFAQQAAKYFPDVEIIEMHHDDKIDSPSGTAISTAKKIAEVRQPKEQGNPDATETLPGARGAEYEGMRIHAVRLPGLVAHEEVMFGGPGEGLTIRQDSFDRISFMTGVKVAVEKVNQYHELFVGLEHLL

SEQ ID NO: 18716 - protein, 429 aa, Lactobacillus plantarum WCFS1 [sequence omitted]

SEQ ID NO: 18717 - protein, 468 aa, Lactobacillus plantarum WCFS1
MKVMIIGSTHAGTAAAREILTRHPETAVTIYERNDNVSFVSSGIYLYLTGVIQHLEDMFYTSPSDLKQLGAQVKTRHNVLRIDTGHKTVQVANMQTGEVFDDTYDKLIMATGSSVIVPPIMGIDHEKVLLCKNYEQAEQLYQSLQANQRVAIVGAGYMGTELAESYASMDQQVMLFHSHSHILNNYLGPQMADAATKLLQHHQVDIHLNERVTGFASGSNDQLIVETAQGDYEVDLAVVCAGFMPNTELLRGQVAMDRHGAILINDYVQTSDPDIYAAGDACVVNYNPTGQPAYTPLATNALRQGALAGINVFGDLQPYMGTQATSAMQLFDHTMATTGLTYLAAQRRELPVRHAVYQGNWRPAYMPTTAKVTIELVYNYQNRQLLGAQFWSRHDIAQAANTISVMIQNQNTIDDLAYVDMFFQPNFNQPFNYLNLVGQLAVKQEYQRGNQTPRITARGNWSTSSDKH

SEQ ID NO: 18718 - protein, 508 aa, Lactobacillus plantarum WCFS1
MIKNIITTIDDYARTQPNNVVYDVQGVTHTYAELKAYSDALAAHLDTLDLPAKDPIIVFGGQTFEMIATFLGVVKSGRAYIPIDTHSPNERLTMINEIAKPAAVIAVADLPTGVGTTPVITPDQLAAIFATPVDYQADHVVSGDDNYYIIFTSGTTGMPKGVQISHDNLVSYVDWMLSDDFGLPDQPNSLSQPPYSFDLSVMDVYPTLALGGTLYALPKAVTDDFKQLFAALPTLPINVWVSTPSFMDICLLEPKFNAENLPTLTHFLFCGEELTHKTAATLKKRFPDARIFNTYGPTETCVAVTQIEITDAALAQYDRLPIGYAKADTRILVVDENGEAVPNGTEGELIIAGPSVSKGYLNNSEKTAKAFFELDGQPAYHSGDIGTMDADGLFRYRGRVDFQIKMHGYRIELEEVDHFLAQQQHIKQAVAVPKYDKEHKVTQMIAYVVPKPNDFESDFALTTAIKKDLQGMMMEYMIPQRFVYQTSLPLTPNGKIDVKSIIKEVNPE

SEQ ID NO: 18719 - protein, 380 aa, Lactobacillus plantarum WCFS1
MAEQDLYKVLGVEKDASQDEIKKAYRKLSKKYHPDLNHEPGAEEKFKAVNEAYETLGDAQKRAQYDQFGSTGGQQGFGGAGGFGGQDFGGFGGGGGFEDIFSSFFGGGAGGSRRSNPTAPQQGRDLQYEMTLKFEDAIFGKKTTITYNREEQCETCGGSGAKPGTSPVTCSKCHGAGYIQVQTNTPLGRMMSQQVCDVCHGTGKEIKDKCATCGGSGHTEQSHSIKVTVPAGVEEGQQMRLQNQGEAGTNGGPYGDLFIIFRVEPSKDFERDGATIYFKLPIDFVQAALGDEVQVKTVHGDVKLKIPAGTQTGTTFRLRGKGAPRLRGNGNGDERVTVNIETPTHLNKGQKEALKTFAKASGKSVAGNGKSSLFDKLRGV

SEQ ID NO: 18720 - protein, 263 aa, Lactobacillus plantarum WCFS1
MKKAVLLDVDHVSKSFILSKQRQSELILEAVSLQVQTHQFISIIGSSGVGKSTLLRMIAGIIRPSYGAITFDGNLVTAPNRRMSMVFQNFALFPWLTVRQNIMFGLESQLNSDCQYVDNQIDNLINLIGLKGLKNAYPYELSGGMKQRVGFARALAVEPELLLLDEPFSALDVLTGQRLGQDLITLWERRKFKMQAIVLITHNISEAVRLSDVIYVLGGKPAQIMNTYQIKTPRNQRTEQQIWAKTMAITDQFKRDMNEMRGD

SEQ ID NO: 18721 - protein, 246 aa, Lactobacillus plantarum WCFS1
MTKPVIEVKDLAKSFGENDVLKDITEKVEPGQVIVVIGPSGGGKSTFLRCLNLLETPTSGQVAFEGQDLTTLDTKSVNALREKMGMVFQGFNLFPNMTVLENIKLAPMKVKHVDDAAATKQAHELLQRVGLDDHADAFPSSLSGGQAQRVAIARALAMNPEVMLFDEPTSALDPEMVGEVLNVMQELAKDGMTMVVVTHEMGFAKSVADRIWFMADGYIQENNTPEEFFANPQTERAQDFLSKILM

SEQ ID NO: 18722 - protein, 470 aa, Lactobacillus plantarum WCFS1
MVVGDFAEERDTMIIGAGPGGYVAAIRAAELGQKVTVVEKEYIGGVCLNVGCIPSKALISAGHRLQEAKDSKIFGIKNIQDPVLDFKVTQDWKDHQVVDRLTGGVEMLLKKHKVEVVRGEAYMHDNHTLRVMNGDHTGQTYKFKHLIIATGSRPVEIPGFKFSGRVVDSTGGLNLPEVPKELVVIGGGYIGSELAGAYANLGAHVTILEGTPQILPNFEKDMVKLVLNSFKKKGVDVITNAMAKNSEQDDSGVTVTYAVDGKETEIHADYVMVTVGRRPNTDDMGLEYTDVKLTKRGLIEVDEQGRTAAEDIFAIGDIVAGAALAHKAFAEAKVAAGAISGKKTANDYVSIPAVCFTDPELATVGMTKAEAEEAGLQVKTSKFPFAGNGRAISLNAMDGFFRLVSTKDEGTIVGAQIAGPGASDLISELSVAVNGGMNVEDLALTIHPHPTLGEVVQEAADEAMGYPTHI

SEQ ID NO: 18723 - protein, 461 aa, Lactobacillus plantarum WCFS1
MTKENSQPATEQLSRGLKSRHVQLIAIGGTIGTGLFLGAGQSIHLAGPAILIAYLVTGLVCFLLMRALGELLLSDLHTHSYIDFIKQYLGDKTGFVAGWTYWVCWITIAMAEITAAGEYMQFWWPRLPQWLPGLIILILLLGLNSINVSAFGETEFWFAIIKIAAILALIAVGIGMVLLSVKTPVGHASLTNLVSYGGFMPHGIKGLVLSFQMVLFSFIGIEMVGMTASETADPKTVIPKAINDIPVRIILFYVGSLFFLMCMYPWQYFSAAHSPFVQVFTNLGIRSAAAIINFVVLTAAASSCNSALFSTGRMLFSLTYDGKSKFAKRMGILSTRQVPRNALWFSTLVIGLSVILNLLMPGKVFSLIASVSTTCFIFIWGAIVVAHIKYRRQAGSQAKVKFRMPLFPLSDYFILVFLAFIAVVLCLKFETLIALLVSAVWVVGLYIVKIVSDRIRQRTHD

SEQ ID NO: 18724 - protein, 450 aa, Lactobacillus plantarum WCFS1
MAHISFDSSNLTKFVHNNELGEMQAMVTAADKELREGTGAGNDFRGWLNLPTDYDKEEFARIKTAAKKIQDDSDVLVVIGIGGSYLGARAAIEFLHETFWSSLSREDRKFPQVVFAGNSISSSYVNDLIHLIGDRDFSVNIISKSGTTTEPSIAFRVFKERLIAKYGEEAAKGRIYATTDRKRGALKQEADAEGYETFVIPDDVGGRFTVLTPVGLLPIAVSGGDIDSLMKGAADAQNEYKDADLSKNEAYQYAAYRNILYRKGYTTEILENYEPNMAMFSEWWKQLMGESEGKDQKGIYPSSANFTTDLHSLGQYIQEGRRNLMETVVKVDNATSDVDIPKETENLDGLKYLEGKTMAQVNTKAFEGVIMAHVDGGVPNMVVNIPSQDAYTLGYTMYFFEAAVAISGYLNGINPFNQPGVEAYKNNMFALLGKPGYEELTKKLTARLSD

SEQ ID NO: 18725 - protein, 395 aa, Lactobacillus plantarum WCFS1
MVESKRNSAKLLWVIGTAWLFDALDVALLSFVMPVIKESWQLTAGQLGAVSAITTLGMMIGALVCGYLADKLGRKPVLIGTLLLFSLGNLLLTITPNVEWFLVVRLLTGIGLGGELPVAATMIADHYTGTQRSRMLVLVDSFWAFGWIAASLLAFLVMPHIGWRMTVLITALMGLYALLLRRRLPAEQEANRPQKVDFRQALRQVWSAKYRRATICLSILWFVIMFAYYGMFLWLPSVLVLRGFSLVHGFGYTMLMSLAQLPGYYLAAWLIGVVKRKAVLATYLIGTVVSAAAFGTANNPTMILISGAWLSFFTLGAWGIMIAFTPGQFAPAVRGIGMGVAQSIGRIGATIGPFLVGALMAIGFGIPAIFMVFVAVLLLGVGVLLFGLPNQETDD

SEQ ID NO: 18726 - protein, 451 aa, Lactobacillus plantarum WCFS1
MKVIVVGSSHGGYETVRGILAAQPDTEIQWYEKGDFLSFLSCGMQLYLEGAVKDVNSVSYATPAGMQAQGVHVFVNSEISKVDPASHSVHVIDHATGDERDETYDKLVLSVGAVPFDLPVPGHDLANIYAMRGRDWAIKLKAKTVDPSVKNVVVIGSGYIGIEAAEVFAKAGMHVTVIDLLPRLLSLYLDQEFTDILTKTMADHGIYAAVGQGIKAYEGVDGHVTKVVTDQGEYPADLVVTAAGIRPATGFLKGVVDLDDHGLIKINDHLQTSDTDIYAVGDATLVPFAPTGKDNRIALATNARRQGRIAAKNLLGENVPMPAVSGSSALSVFDYHFASTGVKEGTADKLGVKTASVLVTDTIRPKFVSEDAGNTKVWFKLTFDPTDGRVLGAQIMSKYDVTANINAISVAIQAKLTVADLAYTDFFFQPGFDRPWNIINVAAQKAAATLN

SEQ ID NO: 18727 - protein, 286 aa, Lactobacillus plantarum WCFS1
MMKLGWIGTGVMGAAIVRNLMTAGYDVTVYNRTKSKADALVAAGATWADTPAAVAETSDVIFTMVGFPRDVEQVYFGDHGIFSGLAAGKTVIDMTTSQPKLAVKIATYACEHDMHALDAPVSGGDIGAKNATLTVMVGGDADTYEAMLPLFNVLGHKVNHFGDAGTGQHAKMANQIMIAGTMTGLTEMLLYTKAAGLDPEKVLATLSSGGADNWSMDNYVPRILKDDYTPGFFARHFLKDLRIALSEADAMGLNLVATAQAKRLYEVMVDVKGLGDQGTQGLINIY

SEQ ID NO: 18728 - protein, 108 aa, Lactobacillus plantarum WCFS1
MKPDFEKGDGLLTTVVTDADTKDVLMVAWMNAESYQRTLASGQTWFWSRSRQELWHKGATSGNLQDVVSMTLDCDQDTLLVAVHPHGPACHTGHTSCFFNPVELEQGA

SEQ ID NO: 18729 - protein, 435 aa, Lactobacillus plantarum WCFS1
MILEQLFHLRENRTSVRRELIGGLTTFLAMSYILAVNPELLGSTGMSKTAVFTATILAAIVGCLLMGLVANFPVALAPGMGLNAFFTYTVVQEWHIPWQTALAGVFVAGILFILLTLSKLRDKLINLIPSALKYAVSAGIGLFIAFSGLQTSGIIVANKSNAVALGNLHSPTVLLAIFGIIVGIMLVTANVTGGIFWGMFITAAVGMIFGIIPLPTGIISGVPSVQPIFGQAVTHLGNINSFQMIIVILTFFIIGLFDTSGTLVGVATEAGMVDKESGEVKGVGKALFSGALATTLGAVFGTSPTTAYVESTSGVAVGARTGLSSVFVALLFAIAAFFSPILTVITSAVTASALIIVGILMLSNVQYIDWTKFEIAVPAFFTMIMMLLTYSISEGLAVGFIFYPITMTVKGRWREVNALMWTMMVVFILYFAFVA

SEQ ID NO: 18730 - protein, 510 aa, Lactobacillus plantarum WCFS1
MTKRALLSVSDKQGLTDFAKGLVALDYELISTGGTKKALEAADIPVIGIEEVTGFPEMLDGRVKTLHPKVHAGLLARRDLPAHMAQLKAAGIQPIDMVVVNLYPFKATIQQPDVTQAEAIEQIDIGGPSMLRSAAKNFAAVLPIVDPADYEQILADLQTDAVTPALRQRLAAKVFQHTAAYDALIAQYLTTEEFPEKLTLTYDKKQALRYGENSHQKAAFYENALPTHFSITGAKQIHGKELSYNNIKDADAALRMVSEYQQPAVVAMKHMNPCGVGLGTTIEAAWDKAYEADSISIFGGIIALNRPVDLATAEKMHALFLEIIIAPSFDDDAFAILAKKKNLRLMTVDFEQTHTADKFETISVGGGLLRQEVDAAFETPADFTVVTVTQPTPAQLKALAFGQQVVKHVKSNAVVVTTADRTLGIGSGQMNRIDSTKIAIGKAMKQAGYENAILASDAFFPMDDCVEYAAQHGIRAIVQPGGSIRDKDSIAMADRYGIAMVTTGVRHFRH

SEQ ID NO: 18731 - protein, 477 aa, Lactobacillus plantarum WCFS1
MRNLSLLTDLYELSMANGFHHDLPQTNATFDLFYRRVPDNGSFVIAAGLQQVVEALQDFHFTNSDLDYFRQLNLWDESFLAMLANFKLTCQIKALPEGTPVFPREPLLTITGPLEQAQLLETLALNIVNHQSLIATKARRLSYAAAGRPIMEFGARRAQGPDSALYGTRAAIIGGANSTSNVLAAKLFDIPVAGTMAHSWIEAFPDELTAFRKWAEQYPDNSALLVDTYDVLNSGIPNAVTVFKELRAAGHEPVGIRIDSGDVTTLSQAARTQLDAAGFPNAKITISNALDEHIITSLLHEGAPIDNFGIGEKLITSASAPVLSGVYKLAATESNGQSTPKIKVSASREKLTIPGDKQVYRLYEPGTQRAFADLIALATETIVDATSLTVVNSDPLSVDRQQRLTRFEARPLLAPVDLSNTTSIPVTTIQATTQAKLAELPRTTQRLVNPDLYPVYMTTTLSQLQTSLLNKMTILAD

SEQ ID NO: 18732 - protein, 480 aa, Lactobacillus plantarum WCFS1
MATTSGLRSDFLWGGAVAAHQLEGGWQAGGKGVSVADVMTAGANGVPREITDGVIAGKNYPNHEGIDFYGHYKEDIKLFAEMGFKCFRTSIAWTRIFPNGDEEEPNEAGLKFYDDMFDTCRQYGIEPVITLAHFEMPYHLVKEYGGWRSRKVIDFFVHYAETVFKRYKNKVKYWMTFNEINNQTTYTNQFLMATDSGLVLKPDDPDAEALMYQAAHYEVVASALAVKIGHAINPDFQIGNMINMTPIYPATAKPQDIMQAEKAMQRRYWFADVQSWGYYPNNMEAYFKQTGFRPDITAEDRQVLKEGTVDYIGFSYYNSNTVAAQDDNPSYHFVGTEAVDNPYLKTSEWDWPIDPEGLRYSLNWLQDRYHKPMMIVENGLGARDKVEADGSIHDPYRIDYLRAHISEMIKAVTEDGVDLIGYTPWGCIDLVSAGTGQMSKRYGFIYVDKDDEGNGTLERSKKDSFYWYQKVIRTNGADLK

SEQ ID NO: 18733 - protein, 479 aa, Lactobacillus plantarum WCFS1
MTKGYKMPKDFLWGGAVAAHQLEGAWDVDGKGVSIADVMTAGRNGVPRKVTDGVKDGEIYPNHWGNDFYHRYSEDDRLFEEMGFKCFRTSIAWTRIFPNGDESEPNEAGLKFYDDLFDDLLSHGIQPVVTLSHFEIPYHLVKAYGGFSNRKMIDFFVHFAKTVFKRYQDKVKYWMTFNEINNQTAWSDPHPLLQNSGLQLSKDDNWEQAMYQAAHYELVASALAVQAGHAINPDFQIGCMVAMCPIYPLTAKPADVMMAERAMQKRYWFGDVHCLGEYPKWLPKYFERKGFDMDITAADLATLKAGTVDYVGFSYYMSFVTKGRDGDSDYDFKEPDDFVENPYVEKSDWGWQIDPTGLRYAMNWMQDRWHLPQFIVENGFGAYDKKEADGSVHDDYRISYFRDHILAMEQAVVLDGVDLIGYTPWGCIDLVSASTGEMAKRYGFIYVDADDNGQGSFDRSKKDSFNWFQQVIASDGEDL

SEQ ID NO: 18734 - protein, 342 aa, Lactobacillus plantarum WCFS1
MQYRQLGTSDLKVSSIALGCMGFGAGTGTALNQRSWAVGQTQANQVLDRAISLGINFFDTAPVYQAGASERVLGQGLKKFQRDQLVLATKFTNRTTQEIENHVSGREHVLRSLDQSLQNLQTDYVDLYIYHIWDWLTPMAEIMAGLNEAVQAGKVRYIGISNAYSWQIAQINALAVRYGYPQFVSIQSHYNLVYREDERELFSYAHENDLATTPYSPLASGRLAHPFGTQTTRRQQDTFADTKYQATSEMDQPIIDRVEELAHQHHVSMAAINLAWLQQRVTAPIIGATKPHHLDAVAEAAGLALTASEIQYLETPYQPHDLEGVMALNRSRTNNWNQYSGQ

SEQ ID NO: 18735 - protein, 460 aa, Lactobacillus plantarum WCFS1
MDKERQMPKDFFWGNSVSSMQTEGAWDEDGKGRSVYDVRPATATTSDWHDAIDEYHRYEEDLDLMKDLHLNMYRIQISWSRVVPDGDGEFNAAGIAFYDRLVDAMLARGITPMICLYHFDMPLALAENENGFMSRHTVDAFVRFGEKMIAHFADRVKYWIVFNEHNLYFTDEVFNISGYTKGDQSVNDLYRIFHHTMLAHARLDDFVHQNYDDVKIGGMLAYTPVYPETAKPIDIMAARKSDEFLNNNLNDAYVHGHYSPEVLRYVEQQGIDYDLQPGDEAIIGKMKADFLAFSYYRSTVINGDKIPVNAVPNRYLNYSFEANRFLQANEWGWAIDPLGFRNLITKLYDQYEVPVFPIENGIGLREHWDGQHMIEDDERITYHEEHIKAMKDAMLIDGAKVLGYLGWGLIDIPSSHADIEKRYGVVYVNRSNHDLKDLKRVPKKSYYWLQGVLAKNGDEL

SEQ ID NO: 18736 - protein, 339 aa, Lactobacillus plantarum WCFS1
MNKSLVLVTGGNGFLASHIIKQLLTAGYPVRATLRSLDKAAGVKQTLAGTPNLDRLTFVALDLTQDQGWAEAMRDVTYVMSVAAPVFVNQGQASDEVTSAAKVGTIRVLKAATAAGVKRVVMTANLGAVGFSRLDHDHPVTEVDWTREDQPGLSLYEKSKLVAEEAGWAYCKAHADSPEFTTVNAGAMLGPSLNGHVTGSYNLVSRILTGQMMPNLKVNVIDVRDVADLEVRAMTAPAAANQRFLAVAATPISMRDLKTLIQEQRPQLAAGLTKHLIPDWFVRGLAPFSGQLRESSLMIRINHEVSTQKAQQLLGWQARSADTAVLAAVDTLVKNGLNK

SEQ ID NO: 18737 - protein, 373 aa, Lactobacillus plantarum WCFS1
MKIKAAVVDKVNDPFVIKDDIELAEMKATDLQIKMVATGICHSDEAIRRGDASLGYPVILGHEGSGIVEKVGSEVTNFEVGDHVILSFYADGTCDNCLKGMPTKCRNYADYNLSGTRPDGSDHFQENGHHISDMFDQSSFTTHTVVDQRNAVKVPKELDLRRLGPLGCGYVTGSGTVLNSLQPRPGQTIAVFGTGAVGLAAMMAGKISGCTEVIAVDIVDSRLELAKELGATHAINSKEEDPVEAIKKLTHGYGVDFAVDTTGVEPVMVSAIHALAQGGTAALIAVTAKNITISSWNDLCVDDKKVIGVNMGDAIPGVDIPRLIDFYQHGMFPFEKTEKFYKFEDINQANADSGSGKTIKPVLIIDEDYQPGK

SEQ ID NO: 18738 - protein, 470 aa, Lactobacillus plantarum WCFS1
MAYQTINPYTNEVVKTYDNATTDQIEQALTTGDALYHQWRHEPVSSRAASLHKIAALLREHKDELAKIATIDMGKLLSESQGEVELCAMIADYYADHGAELLAPTPISTQATGDAEIEKQATGVLMLVEPWNFPYYQIMRVFAPNYMVGNPMILKHASNTPGSAAAFAKIVEEAGAPAGSLTNLFLNYDQVSDIIADPRIQGVALTGSKRGGQAVAKAAGANLKKSSMELGGSDAFVVLADADIDEAVNLAWRVRLYNAGQVCTSSKRFIVAADVYDDFLAKLKERFAKLVPGDPMDPQTTLAPMNSKRAKEKLQDQVDRAIAGGATVAYGNEPIDLPGQFFQPTILTDIDQDNPLFYEEMFGPVAQVFKVDSEQAAIDLANNSELGLGGIVFAGTAAHGKAVAQQIETGMVFVNTFLSSLPELPFGGVKGSGYGRELSSLGLMAFVNEKLVVTAQKPDYDNGAGGLVVL

SEQ ID NO: 18739 - protein, 345 aa, Lactobacillus plantarum WCFS1
MQKQLVVVTGGSGFIAIHIIRQLLQQGYAVRTTVRSLAKAPVIKEMLTNGGITDLSALEIVVADLAHDEHWSEAMAGATYAIDVASPTPKLNFKNKAEMIRPAVDGVRRVLTASRDAGVKRVVLTSAYGAIFAGHKNRTTPYTEADWSDLNWKAIHPYQESKTRAELAAWDFINHEGRGLELTTVNPVAVMGPVLSAKYSHSNIQIQQFLEGQVKAVPNVDSGYVDVRDVASLHLLAMTAPQANGERFLATTGETLSMLDVANVLRQAFPAFASQLPTKTIPNAAVKLAAKARPELRMVASLVGTYAETSNHKAQTLLDWHPRPAAESIIATAQSMIDLGIVTKP

SEQ ID NO: 18740 - protein, 278 aa, Lactobacillus plantarum WCFS1
MQSKLAVIIGGTSGVGKHTAIDLANQNYHVIIVGSRADKGRQAQADISQATGNQAVQLALADLSTKTGVQQFAHQLAAMTDHIDILLNSIGVILPERHLSADGYDLNLVLNYLTHFWTIQALLPLLKHSDQARILLVGALPFVINHAKVSLPDFDAPATSKYNAMTVTAQATAARVLLTLALSERLTATNVTINIFHPGYVPDSNFGAGGSWVSRLAGRILGESFSRKNSPIGAWLATAPELTHTSGHFYDDRLRQVRLSKQYTRSKANDLWRLSSQY

SEQ ID NO: 18741 - protein, 483 aa, Lactobacillus plantarum WCFS1
MGLRKDFLWGGAIAANQVEGAWNIDGKGLSVADVATYKPNVDVKDYRKQVGVTKSDIEKAIQDTDTKYYPKRRGIDFYHRYPEDLELFHEMGFKALRLSIAWTRIFPTGEEFEPNQAGLDYYKAMFNKMHELGIEPIVTLSHYEMPLALASKYNGWENRKVIDLFVRFCKVCFETYKNDVKYWLTFNEIDSVTRHPFTSAGIIPDQTDNLLQAEYQAFHHQFVASALVTKSCHEVIPGSQVGCMLTKLTDYPNSSDPRDVLASFNKNTMNYFPADVQVFGEYPPLVLNYFKKQKIHIDMTASDLEILKENTVDFVTFSYYMSLVSSYDENNLTLTTGNTIVGGKNPHLPVTEWGWTVDPVGLRISLLQLYDRYHKPLMIVENGMGAKDELTADQKIHDDYRIKYFRAHFNEMIKAVDAGVDLLGYTSWAPIDLVSASTSQMSKRYGFIYVDEDDLGNGSLKRYRKDSFTWYQKVIQTNGTSLD

SEQ ID NO: 18742 - protein, 230 aa, Lactobacillus plantarum WCFS1
MAKLVLIRHGQSEWNLSNQFTGWVDVDLSEKGVEEAKAAGQKVKEAGLEFDYAFTSVLTRAIKTLHYVLEESDQLWIPETKTWRLNERHYGALQGLNKKETAEKYGDDQVHIWRRSYDVLPPLLSADDEGSAVNDRRYADLDPNIVPGGENLKVTLERVMPFWEDQIAPKLLDGKNVIIAAHGNSLRALSKYIEQISDDDIMDLEMATGEPVVYDFDEKLKVLGKEKLGK

SEQ ID NO: 18743 - protein, 444 aa, Lactobacillus plantarum WCFS1
MTNKYDYDVLYIGAGHATFDGAAPLAKTGVRVGVIESGLIGGTCPNRGCNAKITLDEPVKLTRETARLNDILSSAPTINWTANVAHKQEIIDPLPAGLTARLEDGGATIIHGHATFKDAHTVVVDDQQTITAEKIVIATGLKPHRLDIPGTKLAHDSSDFMNLKRLPQSIVIIGAGYIGMEFATIANAAGAQVTVMLHGDQALRDFYQPFVAQVVDDLTERGVTFIKNANVQAFTKQDDQFQVSYGDHQQLTTDWILDATGRIPNLDGLGLDRIGVKYDRHGVYVNDHLQTNVPNIYAAGDVLANDLPKVTPAAYFESKYLMRLFSGQTSAPIDYPVIPSVVFTSPRIAQAGMKIPAAEKAGLTVSDNDLADYWYYQVSKEPIAASKQVHDQDGHLVGVTEISDQAEDAVNALLPAIEYQLDREQIDRLIGIFPTIGYAAWHRA

SEQ ID NO: 18744 - protein, 325 aa, Lactobacillus plantarum WCFS1
MGMEIFDYEDIQLIPNKCVINSRSEADTTVELGGRRFKIPVVPANMATVINDEIAKWLATNDYFYIMHRFAPETRRAFIETMHAAQLYASISVGVKSSEYDFIDDLATNQIVPEYITIDIAHGHADSVIAMIKHIKDVLPDSFVIAGNVATPAAVRDLENAGADATKVGVGPGKACITKVKTGFGTGGWQLAAVRWCAKAARKPIIADGGVRTNGDIAKSIRFGATMVMIGSMLAGHQESPGNILKIDGKTYKQYYGSASETQKGEHKNVEGKQMLVPYRGRLVDTLNEMQEDLQSSISYAGGRDLKAITKCDYVVVKNSIYNGD

SEQ ID NO: 18745 - protein, 460 aa, Lactobacillus plantarum WCFS1
MKITNADGTIRALSNRHVQMIAIGGTIGTGLFLGSGSTISKTGPSVMWVYLVLGFFFFLMMRAIGEMFYSDPTQHTFVAFISRYLGPSVGYFTGWTYWIGLIFVCMAELTATATYVKFWLPNVPAWLIEISFLLILAGVNLTAARLFGEAEFWFAMIKIVAIIALIITGIFMMVGHHPTPLGQASIGNLFHNYQVFPNGIANFISAFPMVFFAFQGIEFVSITIGEAKNPHRVIKKAVNETLLRILLFYIGALIVIMGIIPWTSLSPDSSPFVQVFKLAGYPAAAAIINFVVLTSAASSLNSCLFSAGRHFYQLATEMPVTSRMHQIFGQISKSGVPAAAIVLSAILVLVTPIMSLSAATTAVFTVVTGISSDMYLIVYTLAMLAHRKYRLSNDYLADGFKMPAYRITSPLTIAFFVLIFASLFFIQADIVGAIGAIIWTLLFGGITFAHQARLRAVTRS

SEQ ID NO: 18746 - protein, 250 aa, Lactobacillus plantarum WCFS1
MTGSWEARYAAEFFGTLILVLLGNGAVANAFLKNTTGNDDPGLANGGWLLVASGYGLGVMLPAMMFGSISGNHLNPAITIGQAVIGIFPWAHVAPYLIWQFLGAIAGQCLILALYWPHYRQTTDNEAVLGTFATSDHANSQLNGFVTEMVGTAVLIFGAMGLYRGMFFHQNIDIANIGVGLLIAAMVISLGGPTGPALNPARDLGPRLVHALFPVPNKGSSHWEYSWVPVVAPIVGAVIGIWIYKIFFGL

SEQ ID NO: 18747 - protein, 216 aa, Lactobacillus plantarum WCFS1
MRKYLAEFLGTFMLVFLGTATVVIAKGDVLAIGLAFGLAITVSAYAFGGISGGHFNPAVTTAMLINRRIDAADAIGYIIAQIIGAIVASAAVKSFVSALGLSATLLGQTDFPKIGSGMAFFVEALVTFLFLMVILNVTSNDHGNADFAGLTIGVTLAFLIIVALNLTGGSLNPARSIGPAIFAGGSALSHLWVYILAPEVGAILAAFCARVMGSED

SEQ ID NO: 18748 - protein, 486 aa, Lactobacillus plantarum WCFS1
MYKPTYPKTFPKDFLWGGATAANQVEGAWNEAGKGLTTAEVVKKTTDRKHMSMDDVTIFSIQTALDDQTDTMYPKRRGVDFYHHYKEDIKLFAEMGFKVYRFSIAWSRLFPKGDELKPNSDGLAFYDRVIDELRRYHIQPLVTLSHYEMPIGLTLKQNGWASRATIADFNRFTEVVFKHFKGRVPYYLTFNEINTGTWGFHATGAVDTENSAHDQMQLRYQALHHQFIASALATKQLHAIDPDAKIGSMLARMQTYPATPNPADVQAAQVEDDKNLFFTDVQARGEYPEFMNRFFAENDIQLQMAPDDQTILAKYPVDFISFSYYMTTVTQADAPEQVNGNMATGGRNPYLEESDWGWQIDPVGLRVTLNEMWDRYRKPLFVVENGLGALDQLTTDQQVHDTYRIDYLRKHIAQMKAAVQDGVQLMGYTMWGPIDLISFSTSEMSKRYGFIYVDQDDAGKGSLKRYKKDSFYWYQKVIKSNGEDLA

SEQ ID NO: 18749 - protein, 480 aa, Lactobacillus plantarum WCFS1
MSEFPEGFLWGGATAANQLEGGYQEGGRGLSIADALPGGKDRFKIVSQPDFDWTIDTDKYTYPNHEGIDFYHHYKEDIALFAEMGFKCYRFSIAWSRIFPNGDETQPNEAGLKFYDDVIDECLANNIEPVITISHYELPLNLAKRYGGWKNRYLIEFYETFARTILTRYASKVKYWMTFNEINSAAHFPVMGQGLVPSTGANDKKNVFQAWHNQFVASAKAVKIAHELRDDIQVGCMILYATSYAYDSNPVNQLANLQHNQDFNFFCADVQVRGAYPTYTKRLLAEYNLTFDDLETTDGDLALLQQYPVDYIGFSYYMSSAVETTGSVTDTVAGNLMGGVKNPFLKASDWGWQIDPTGLRIALNELYDRYQKPLFVVENGLGAIDKPDKNFYVEDDYRIDYLKQHIEAMAGAIDDGVDLMGYTPWGCIDLVSASTGEMSKRYGFIYVDLDDQGHGTLARYPKKSFYWYQDVIKHNGLTKK

SEQ ID NO: 18750 - protein, 487 aa, Lactobacillus plantarum WCFS1
MYSKTMPTGFPKNFLWGGATAANQVEGGWNVDGKGLTTAEVVQKATDRKVMSMNEVTKESVQAAIDDQTDKLYPKRRGVDFYHHYKEDIKLFAEMGFKVYRLSLAWARIFPKGDETEPNEAGLKFYDNVFAECHKYGIEPLVTISHYEMPLNLTLTNNGWASRKTIADFTRYTEVLFKRYKGVVKYWLTFNEINASTWGFTGTGAIDSDLSLHDQMQLRYQALHHEFVASAIAVKQCHEIDPEAQIGSMLARMQTYANTPNPADVRAAQLQDQLNLFFTDVQVRGEYPEYMNRYFAENGIELTMEAGDEQLLAEGKVDYLSFSYYMTTITSATDDVEQASGNLSMGGKNPYLKSSAWGWQIDPVGLRITLNEFWDRYRVPLFVVENGLGAEDEISADGKIHDDYRIDYLRQHIEQMKEAVKDGVDLMGYTTWGCIDVISAGTSEMSKRYGFIYVDQDDEGNGSLKRMKKDSFDWYKKVIASNGEDLG

SEQ ID NO: 18751 - protein, 352 aa, Lactobacillus plantarum WCFS1
MEAVVKTESGYDNMELKQIPIPEVTGDKVLLKVAYTGICGTDIHTFKGQYANAVTPLVLGHEFSGEVVEVGPDVKTLKPGDRVTSETTFATDGTCVYCQDKEYNLCPNRVGIGTKANGSMANYVLTREESAHILPDNVSYKMAAMSEPLASCVHAMYQKTPFTLHDTLLIMGPGPMGLLSLQIAKEIGAFVIVSGITKDADRLQIAKELGADIIVDTQKEDLAKVVMDATDGVGVTKVYDCSGATPAVNSALPLIRKGGTFQQVGLFAKPMNELDERSIIQHEITYRGSRSQNPYDWAIALHLESKGAINQDAMITKVFDLEHWRDAFDAMMAGKELKVMIASNPDDPDLAD

SEQ ID NO: 18752 - protein, 466 aa, Lactobacillus plantarum WCFS1
MNKQKKVSSKFIFFFGSFGGILFGYDIGVMTGALPFLKTDWALTNATLVGWVTSAVMFGAIFGAAIAGQLADRLGRRRMILMSSLIFAIGSILCGFSPNNGTYYLIGMRIFLGLAVGAASALVPAYMSEMAPARLRGSLSGINQTMIVSGMLISYIVDYILKDLPENMSWRLMLGLAAVPAIILFLGVLKLPESPRFLIKANRLDEARQVLSFVRKPDEVDSEVKAIQSTAQTEANNLEKTSWATLFNGKYRYLVMAGVGVAAFQQFQGANAIFYYIPLIVEKATGSAASSALMWPIVQGILLVLGSLLYIWIAEKFNRRTLLMLGGSVMALSFLLPAVINSLVPNASPMMIVVFLSIYVAFYSFTWAPLTWVLVGEVFPLAVRGRASGLASSFNWIGSWAVGLLFPIMTASMSQEAVFAVFGVICVLGVLFVRFCVPETRGHSLEEIEAAGTNHHKQVPVQQASH

SEQ ID NO: 18753 - protein, 401 aa, Lactobacillus plantarum WCFS1
MSDLDQTNNYRYVIVGGGMVAGYAIKGIRQEDPEGAILVISQEADVPYERPALSKKLWLDDEFTEENIRIGAENYPNVTFKFKTTVTAINRQDKVITLTDSEQIKYEQLLLATGGEPRQIQGPADPHVLVFRQWSDYRKLRKFSGPNKRVVIIGGGYVGTELASSLTQNGTKVTMIFPEKALGEGKFPESIRAEYEATFKRNGVTLMSGQFVQSYQRQGDHLTLLTKDGTAIAADTIIVGLGVTPRISLAEDSSLDLADGGVKVDEYLNTSDPAIWSAGDIASYPDHILGRQRIEHVDHARLSGELVGRNMAGAHMSYQHTPYFYSMIFDISWQAIGNIDPKLQLIFDRRTHGLLVYFIDADKLVGVLVWNVKVNLDDVRALLANAPATDDLVGSIREQEG

SEQ ID NO: 18754 - protein, 470 aa, Lactobacillus plantarum WCFS1
MDVSESTNKKSNSHTGFLWLATFIAAMGSLLFGYDTGIVNGSLEFMAVKGQLDLTAFQQGIVSSGLTLGAAFGAIIGGPFADKIGRKKILTILGIIFSVGALGCAFATNITILIVFRFILGLAVGSASANVPVYIAEIAPTELRGKMVTTAQVMIVSGQFVAFGVNAALTPLGAQNAAIWRWMLGLGTIPGIILWIGMYLIPESPRWLVSQGKMDKALGVLRRIRSAASVESEMKEIQDKDKADKELNAEQATFKELISKRWVVQILITGAMLGIIQQFAGINSIMYYGGKIIQESGFDTTVAAILNAGNGFLSIVGAVLGMFTIDWLGRRKLEFAGLTICGITLVSAGVIHTVAPNASWAGITIVVLVYLYIIFFQGTLGPVTWLINSEIFPQRYRGIGTGITIFVLWIGNFIVGLLSPVLLEWNMSNTFYIFAVCCVLGIIFVALRVPETKGVPLEEIEKYFRTKYDK

SEQ ID NO: 18755 - protein, 488 aa, Lactobacillus plantarum WCFS1
MSAEKSISSDHVPLSDPALKTINRNAGRNLNHIAFISTLGGLLFGVDTGVINGAIGYMATPAELNLSPNNEGLVTSGITLGAAFGAVFAGHLSDRIGRKRLLKYLALLFFVCTLACSLAPNALFMIISRVLLGLAVGGASVIVPTYLSEISTPEIRGRLVTQNELMIVTGQLLAFIVNAILGNWFGHISNIWRYMIGFGMIPAVALFFGMMVVPESPRWLVMVNQLDNAFDSLRKIRSHPETCNEEITQIQDTLNQESEIKQATFKDLSTPWIRRLVFIGIGLGVMQQFIGINIMMYYGTTILTNSGFAHNAALIANIGNGLVSVIATFIGMSIMNRVNRRSMLIAGIIGTTTSLILIVGVSAFLSQSPLLPILVVLCTMMFLGFFQGFISPLVWLLLSEIFPQNLRGLGMGVSTFFLWFANFLVGYFFPILLSAVGMTWTFLIFVFFNILSFIFAYKYAPETRGKSLELIQMEFKYGDTTGINPEDK

SEQ ID NO: 18756 - protein, 463 aa, Lactobacillus plantarum WCFS1
MTMVEFPEGFVWGAATSGPQTEGNFHKQHQNVFDYWFATEPEQFDAGVGPDTASNFYNDYDHDLALMAQAGVQGLRTSIQWTRLIDDFETASLNADGVAFYNHVIDSMLAHHITPYINLHHFDLPVALYDKYHGWESKHVVELFVKFAEQCFKLFGDRVDHWYTFNEPKVVVDGQYLYGWHYPQVINGPKAVQVAYNMNLASAKTVARFHELCVRPEQQIGIILNLTPAYAASDDPADLAAAEFAELWSNNLFLDPAVLGHFPEKLVERLTMDGVLWDATPTELAIIAANPVDCLGVNYYHPFRVQRPDISPKSLQPWMPDIYFKEYDMPGRMMNVDRGWEIYPQAMTDIARNIQKNYGNIPWMISENGMGVAGEERFLDKQGVVQDDYRIDFMKEHLTALAKGIAAGSNCQGYFVWSGIDCWSWNHAYHNRYGLIRNDIHTQTKTLKKSAKWFAELGERNGF

SEQ ID NO: 18757 - protein, 279 aa, Agrobacterium tumefaciens str. C58
MTVRMDKRFADLRAENRPALITYFMGGDPDFQTSLGIMKALPEAGADVIELGMPFSDPMADGPAIQLAGQRALKGGQTLKTTLDLAREFRKQDNATPIVMMGYYNPIYIYGVEKFLDDAIASGIDGLIVVDLPPEMDDELCIPALARGINFIRLATPTTDGKRLPAVLKNTSGFVYYVSMNGITGSALPDPSLISGAVGRIKAHTELPVCVGFGVKTADHAKAIGAVADGVVVGSAIVNQIAGSLTKDGQATADTVPAVTTLVKGLSTGVRASRLAAAE

SEQ ID NO: 18758 - protein, 279 aa, Brucella melitensis
MTTRIDTKFAELKAEGRPALVTYFMGGDPDLETALKVMKALPKAGADVIELGMPFSDPMADGPAIQAAGLRALNAGQTLAKTLYMAAEFRKEDDTTPIVMMGYYNLIYIYGVERFLTDAKASGVDGLIVVDLPSEMDAELCIPAMKAGINFIRLTTPTTDDKRLPKVLHNSSGFVYYVSMNGITGAAIADTAKVGEAVRHIKKSTDLPICVGFGVKTPEQAAAIATHADGVVVGTAIVNAIAGELDEKGKAKGDPVAAATRLVHALAESVRATRLEAAQ

SEQ ID NO: 18759 - protein, 160 aa, Arabidopsis thaliana
QKHSVRIADEKVTLAMQAYDLVDMHVQQLDQYMKKSGEVIRKEKEAAAATLELENNGKAGNAGEGGRGGRKKTRLATAASTAAASTGMTSSNMDLDLPVDPNEPTYCICNQVSFGEMVACDNNACKIEWFHFGCVGLKEQPKGKWYCPECATVKKSRKGR

SEQ ID NO: 18760 - protein, 502 aa, Arabidopsis thaliana
MTVLWFVSLILLISILLVAVKHSKRRWVRQPPSPPGLPIIGNLHQLGELPHQSLCKLSKKYGPVMLLKLGRVPTVIVSTPGTAKQVLKDYDLHCCSRPSLEGTRKLSYNYLDIAFSRFDDYWKELRKLCVEELFCNKRINSIQPIKEAEMEKLIDSIAESASQKTLVNLSDTFLSLNVNVICKAVFGVNFQGTVLNNDKFQDLVHEALEMLGSFSASDFFPYVGWIVDWFTGLHARRERSVRDLDAFYEQMIDLHLQKNREESEDDFVDLLLRLEKEEAVLGYGKLTRNHIKAILMNILLGGINTSAITMTWAMAELIRNPRVMKKVQSEIRAQIGKNNKTRIISLDEINHLSYLNMVIKETCRLHPVAPLLVPREVISEFKINGYTIQPKTRLHVNVWAIGRDPEIWKDPEEFLPERFMDCDIDVKGQDYELLPFGSGRRICPAVYMGITTVEFGLANLLYHFDWKLPEGVAVEDIYMDEASGLTSHKKHDLLLVPVKSLV

SEQ ID NO: 18761 - protein, 513 aa, Arabidopsis thaliana
MSILSFPHTFFNISPSLFYTILISSLVLLILTRRSAKSKIVKLPPGPPGWPVVGNLFQFARSGKQFYEYVDDVRKKYGPIYTLRMGSRTMIIISDSALVHDVLIQRGPMFATRPTENPTRTIFSSNTFTVNASAYGPVWRSLRKNMVQNMLSSIRFREFGSLRQSAMDKLVERIKSEAKDNDGLVWVLRNARFAAFCILLEMCFGIEMDEESILNMDQVMKKVLITLNPRLDDYLPILAPFYSKERARALEVRCGQVDFIVKLIERRRRAIQKPGTDKTASSFSYLDTLFDLKTEGRITTPSNEELVSLCSEFLNGGTDTTGTAIEWGIAQLIVNPEIQSRLYDEIKSTVGDREVEEKDVDKMVFLQAVVKEILRKHPPTYFTLTHSVTEPTTVAGYDVPVGINVEFYLPGINEDPKLWSDPKKFNPDRFISGKEEADITGVTGVKMMPFGIGRRICPGLAMATVHVHLMLAKMVQEFEWSAYPPESEIDFAGKLEFTVVMKKPLRAMVKPRV

SEQ ID NO: 18762 - protein, 193 aa, Arabidopsis thaliana
MSSSLEQEIFLQWGNKKRLRCLRAKAKKISRSKNSSRFLGQDTVLLQSSRFSRGSEGAILRSGLPDRRRPSPEKEERYYTTRGVVDNIGKDCLDGNINGEDSNNKEESMWPKLFITLSNKEKEEDFMAMKGCKPSHRPKKRAKLIQRSLLLVSPGTWLADLCPDRYDVRVKKSSKKRRARGLKAMGNMETDSD

SEQ ID NO: 18763 - protein, 312 aa, Arabidopsis lyrata
YLSGMDILLTVDPVNIHYILSSNFANYPKGMEFKKIFEVVGDSIFNVDSGLWEDMRNSSHAIFSHQDFQRFWVSTSVNKLRQGLVPIIENAADKNILVDLQDLFQRFLFDTSLILMTGYDPKCLSIEMPKVEFGDAVDGVSDGVFYRHVKPVFLWRLQYWIGVGVEKRLKRGLAVFDQLLEKIITAKREEIKSLGTQHHSRGEAIDVLTYYMTMDTTEYKYLKPSDDKFIKDTILGFLIAARDTTSSALTWFFWLLSKNPEAMNKIRQEVNKKMPRFDPADLDKLVYLHGAVCETLRLYPPVPFNHKSPAKP

SEQ ID NO: 18764 - protein, 513 aa, Pneumocystis carinii
MGFLKTILKVLGIENFTLSFVIIILTFFFLLHIFPQLYQKDSSKPPVVFHWLPFIGSTIQYGMDPYKFFQKQKKKHGNIFTFILLGKKMTVALGPKGNDILFNGKLSSLSAEEAYTHLTTPVFGTDVVYDVPNHVLMEQKKFVKTGFTIETFRAYVPLIIEEVKTYLETSPIFGKDKLSGVSSLMKALPEITIFTASRTLQGKEVRSNFDASFAKLYHDLDGGFTPINFLAPWLPLPKNRLRDAAQKKMAQIYMNIIKQRRKTCQHEEKDMIWNLMNQHYKDGRKLTDKEIAHLMIAILMAGQHTSAATGCWALLHLAEKPEYIKLLLEEQKRVFGDNLDDLTYDNLKDMELLSYVIKETLRLHPPLHSIIRKVKSPILIENSPYIVPKNHYLLAAPGVSSVDEEYFENALEFIPERWKCEKNTEDSDKIDYGYGLVTKGAFSPYLPFGAGRHRCIGEQFAYMQLGTIITIFVHELEWTLPKNQITIPKPDYTSMVVLPERPSNIEWRRRQKR

SEQ ID NO: 18765 - protein, 183 aa, Raphanus sativus
KGKIQGYGSKLANNASGQLEWEDYFFHLVYPEDKRDLSLWPKTPTDYIEATSEYAKCLRLLATKVFKALSIGLGLEPDRIEKEVGGLEELLLQMKINYYPKCPQPELALGVEAHTDVSALTFILHNMVPGLQLFYEGKWVIAKCVPDSIVMHIGDTLEILSNGKFKSILHRGLVNKEKVRVSW

SEQ ID NO: 18766 - protein, 502 aa, Vigna unguiculata
MDFTPPPIEDGFTAEKLFSQGFSYTYDDVIFLPHYIDFAADAVDLSTRLTRRLPLAVPLVASPMDTVSESAMASAMASLGGIAIVHSNVPAAAQASLVRAAKSRRVPILSEPAFAAPSAVIEHEDDFAASPFLLVTDIGAAGGKLLGYVAKRDWTNQKDKSLRVGDYMAPPPRRAPWNADLNKIHEIMENEKSGAVALERDGEVVDLVVREEVERVKGYPKLAAPATVGPDGEFMVGAAMGTREDDKERLKHLVKAGVNVVVLDSSQGNSIYQLEMVKYVKSVYPELDVIGGNVVTMYQAENLIQAGVDGLRVGMGSGSICTTQEVCAVGRGQATAVYKVSSIAYKSGVPVIADGGISNSGHIVKALSLGASTAMMGSFLAGSHEAPGAYVYQNGQRVKKYRGMGSLEAMTKGSDARYLGDTAKLKIAQGVVGAVKDKGSVLNFIPYTLQAVRQGFQDIGASSLQSAHDLLRSRVLRLEVRTGAAQVEGGVHGLVSYEKKYY

SEQ ID NO: 18767 - protein, 486 aa, Cupriavidus necator
MNTSAIASDAPGAGHPAPAGTDAPWTAPTVTRRQVSYATWVCFFAWVFAVYDFILFGTLLPQLGEHFRWSAEQQARLNTWVTLGTVIVAFGIGPIADRLGRRKGIIIAVAGAALCSGLTALAGWVIGLSAGLGFVLLIVVRSLAGLGYAEQSINATYLSELFSLVYTDPASLRRRGFIYSLVQGGWPVGAVLTAVLVALLYPLGERWFGQGGGWALSFVFAMFPALVIAVLGRRLVETPQFLTARRVADLRRAGREAEAMRLAQEHGASPQQEQHTGLSAMFRGASLRPTLSLALGFFLNWFAIVIFAVLGTSVLGTSVLGGAGGTPGKGVDFSSALQVLIISNLAGFLGYVFHGWLGDRIGRRNAVAIGWMLGGLAFALMLNAPSGDFWRIVPLYSLGLFFLIGPYAAALFLIGESFPSHIRATASSFVNAMGQVGAIAAGFGVTWTLSQGSDWVQAALYWGAIPCAASGLLMFLAPHVDPETVK

SEQ ID NO: 18768 - protein, 487 aa, Arabidopsis thaliana
MESAALSRIGLAGLAVMGQNLALNIAEKGFPISVYNRTTSKVDETLDRAAVEGNLPVSGQYSPRDFVLSIQRPRSLIILVKAGAPVDQTIDAFSEYMEPGDCIIDGGNEWYQNTERRISEAEQKGLLYLGMGVSGGEEGARNGPSLMPGGSFQAYDNIKDILEKVAAQVEDGPCVTYIGEGGSGNFVKMVHNGIEYGDMQLISEAYDVLKNVGGLSNEELAEIFTEWNSGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSLEKSWNLNFGELARIWKGGCIIRAVFLDRIKKAYQRNPDLASLVVDPEFAKEMVQRQAAWRRVVGLAVSAGISTPGMCASLAYFDTYRRARLPANLVQAQRDLFGAHTYERTDRPGAYHTEWTKLARKNH

SEQ ID NO: 18769 - protein, 378 aa, Arabidopsis thaliana
MAVVDVHRFAESITCHAWSPDLSMVALCPNNTEVHIYKSLSQDHWERLHVLQKHDQIVSGIDWSSKSNKIVTVSHDRNSYVWSLEGAEWVPTLVILRLNRAALCVQWSPKENKFAVGSGAKTVCICYYEQENNWWVSKLIRKRHESSVTSVAWHPNNVLLATTSTDGKCRVFSTFIKGVDTKDSKAGSPAETKFGEQILQLDLSYSWAFGVKWSPSGNTLAYVGHSSMIYFVDDVGPSPLAQSVAFRDLPLRDVLFISEKMVIGVGYDSNPMVFASDDTGIWSFIRYIGEKKAASSNSSYSSQFSEAFGKFYGSQSKSTTANDASESRGGVHDNCINSIVSLSKAGSPKVMRFSTSGLDGKVAIWDLENMEQELGNQF

SEQ ID NO: 18770 - protein, 347 aa, Schizosaccharomyces pombe
MSSETKSEFGTKSAWLYNRTGKPKDVLYLEKGLHIPNPAELGPYDVLVEVVATSINPLDYKLMNTYQMIAKALFKLPNIPGYDFAGRVLAVGSEVKEFSATQRVWGCQSFPRAGRQGGSCATHIVTGDKDVWHLPDGVSFNEGAGFGIAGLTAWEVLVRQMKVKPGTKLVIEGASGGVGTFAVALAKALECEVTTISSTENLDLCKSLGATHTLDYKKDNLVERLADLGPYDFVFDCVNDNVLYRASSKFVKPDGAFFGIGGDITLSYVGSRLSRTLRPRVLGGSSHSYYNILLHVDQEMLRDFVDFVMKHNIKTVIDSVYDFEDTVEAFNRLMTHRCKGKVIIKTD

SEQ ID NO: 18771 - protein, 312 aa, Arabidopsis thaliana
CLSGMDILLTVDPVNIHYILSSNFANYPKGMEFKKIFEVVGDSIFNVDSGLWEDMRNSSHAIFSNQDFQMFWVSTSVSKLRQGLVPILENAADKNILVDLQGLFQRFLFDTSLILMTGYDPKCLSVEMPKVEFGDAVDGVSDGVFYRHVKPVFLWRLQYLIGVGVEKRLKRGLAVFNQLLEKIITAKREEINSHWTHHPSRGEAIDVLTYYMTMDTTKYKYLKLSDDRFFKDTILGFLIAARDTTSSALTWFFWLMSKNPEAMNKIRQEVNKKMPRFDPADLDKLVYLHGAVCETLRLYPPVPFNHKSPAKP

SEQ ID NO: 18772 - protein, 312 aa, Arabidopsis thaliana
CLSGMDILLTVDPVNIHYILSSNFANYPKGMEFKKIFEVVGDSIFNVDSGLWEDMRNSSHAIFSNQDFQMFWVSTSISKLRQGLVPILENAADKNILVDLQDLFQRYLFDTSLILMAGYDPKCLSVEMPKVEFGDAVDGVSDGVFYRHVKPVFLWRLQYLIGVGVEKRLKRGLAVFDQLLEKIITAKREEINSHGTHHPSRGEAIDVLTYYVTMDTTKYKYLEPSDDRFIKDTILGFLIAARDTTSSALTWFFWLMSKNPEAINKIRQEVNKKMPRFDPADLEKLVYLHGAVCETLRLYPPVPFNHKSPAKP

SEQ ID NO: 18773 - protein, 312 aa, Arabidopsis thaliana
CLSGMDTLLTVDPVNIHYILSSNFANYPKGMEFKKIFEVVGDSIFNVDSGLWEDMRNSSHAIFSNQDFQMFWVSTSISKLRQGLVPILENAADKNILVDLQDLFQRYLFDTSLILMAGYDPKCLSVEMPKVEFGDAVDGVSDGVFYRHVKPVFLWRLQYLIGVGVEKRLKRGLAVFDQLLEKIITAKREEINSHGTHHPSRGEAIDVLTYYMTMDTTKYKYLEPSDDRFIKDTILGFLIAARDTTSSALTWFFWLMSKNPEAINKIRQEVNKKMPRFDPADLEKLVYLHGAVCETLRLYPPVPFNHKSPAKP

SEQ ID NO: 18774 - protein, 312 aa, Arabidopsis thaliana
CLSGMDILLTVDPVNIHYILSSNFANYPKGMEFKKIFEVVGDSIFNVDSGLWEDMRNSSHAIFSNQDFQMFWVSTSISKLRQGLVPILENAADKNILVDLQDLFQRYLFDTSLILMAGYDPKCLSVEMPKVEFGDAVDGVSDGVFYRHVKPVFLWRLQYLIGVGVEKRLKRGLAVFDQLLEKIITAKREEINSHGTHHPSRGEAIDVLTYYMTMDTTKYKYLEPSDDRFIKDTILGFLIAARDTTSSALTWFFWLMSKNPEAINKIRQEVNKKMPRFDPADLEKLVYLHGAVCETLRLYPPVPFNHKSPAKP

SEQ ID NO: 18775 - protein, 312 aa, Arabidopsis thaliana
CLSGMDILLTVDPVNIHYILSSNFANYPKGMEFKKIFEVVGDSIFNVDSGLWEDMRNSSHTIFSNQDFQMFWVSTSVSKLRQGLVPILENAADKNILVDLQDLFQRFLFDTSLILMTGYDPKCLSVEMPKVEFGDAVDGVSDGVFYRHVKPVFLWRLQYLIGVGVEKRLKRGLAVFDQLLEKIIMAKREEINSHGTHHPSRGEAIDVLTYYMTMDTTKYKYLEPSDDRFIKDTILGFLIAARDTTSSALTWFFWLMSKNPEAINKIRQEVNKKMPRFDPADLEKLVYLHGAVCETLRLYPPVPFNHKSPAKP

SEQ ID NO: 18776 - protein, 312 aa, Arabidopsis thaliana
CLSGMDILLTVDPVNIHYILSSNFANYPKGMEFKKIFEVVGDSIFNVDSGLWEDMRNSSHAIFSNQDFQMFWVSTSVSKLRQGLVPILENAADKNILVDLQDLFQRFLFDTSLILMTGYDPKCLSVEMPKVEFGDAVDGVSDGVFYRHVKPVFLWRLQYLIGVGVEKRLKRGLAVFDQLLEKIITAKREEINSHGTHHPSRGEAIDVLTYYMTMDTTKYKYLEPSDDRFIKDTILGFLIAARDTTSSALTWFFWLMSKNPEAINKIRQEVNKKMPRFDPADLEKLVYLHGAVCETLRLYPPVPFNHKSPAKP

SEQ ID NO: 18777 - protein, 473 aa, Tropheryma whipplei str. Twist
MSLVRRLRVSVKKNHKIVVIGGGPGGYSAALSGALLGADVVLIENQAVGGSATLTDVVPSKTLIASAERAVFVAQGADFGIRFQNCVSADIGHINRRIMDLTRAQSADMFSTLTGAGVRVVYGHAALDGPNRVLVSVSGQEKYEFFANTVVVATGSSPRVLPNAIPDGKRILTWKQLYTLEQVPEHIIVVGSGVTGAEFASAFRNLGSEVTLVSSRDRVLPGGDEDAADLIQEVFINSGMKLLNRARAQAAAACNGGVVVTLTDGTEVRGTHCLMAVGSVPNTSGIGLETANIALNPAGRITVNRVACSSVPGVYAAGDCSDFLPLASVAEMQGQVAVYHAMGENANPIELKNLASTVFTTPEIATVGRSEKAIDKARATALKVDLATNSRAKILGIKTGFVKMIVSRETGTVLGGVVVAPNASDLIFPISVAVQNRLSADQLSQSFAVYPSLTISLWHAARASHVRTDSASP

SEQ ID NO: 18778 - protein, 491 aa, Tropheryma whipplei str. Twist
MHLHKLSGVGLTYDDVMLVPGRSDVLPSQVNFGSFLTRRIRLSAPLVSAAMDTVTESGMAVAMARLGGVGVIHRNMSIADQAEHVTRVKLSESGMITRPVSVSPDLTLEEVEQRCSRYKISGFPVVDEDNTLLGIVTSRDMWPYRHEHRASVRVSEVMTRSPLITASPNISSEEARDLLYKHRLEKLPLVDEHGRLFGLITVKDFVNRQRYPFATKDKNGCLIVGAAIGFFGDAYDRALALAAAGVDFIVVDTANGYSDGALKMINRLKNDSTFADIDIIGGNVATGDGAKALIDSGADAVKVGIGPGSICTTRVIAGVGVPQITAIYECAQTSSVPIIADGGLHYSGDIAKALVAGAKSVMLGGLLAGCDESPGELISRGGKQYKIYRGMGSAGAMQARASYSRDRYFQHDLDSHPIAEGVEGQVPHTGSVSTVFYQLLGGLRQSMFYVGCRDINELQDKGRFVRITSAGLKESHPHDIEMIVETPNYRT

SEQ ID NO: 18779 - protein, 482 aa, Tropheryma whipplei str. Twist
MGRGQRCCVFENAKEAAEYIKSNQIEVLDVRFCDFLGAQHHFAVPAHAVDDEFFQSPQVFDASSLRGYADINHSDMLLVADPSTSYIDPFRHHKTLAMIFDVHDPRTGDVYERDSRNVAKKAEKYLAGCRFADTAYFAAEAEFFIFDDVRFKISNHSSSYSVDSEEGIWNSSRRKGGGNLGNQLKHKGGYAPLPPADQHADLRDDIMNALTKVGLRVEKGHHEAGSAGQGEINYRFNTLVNAADDLLKFKYVVKNTAHEWGKSATFMPKPIAGDNGSGMHTHQSLWKNGKPLFYSETGYANLSDIALWYIGGLLKHGPALAAFTNPSTNSYKRLVAGFEAPTSLVYSAGNRSAAIRIPPTIGAEGSKRIEYRVPDSSSNPYLAFSALLMAGIDGIKNKIHPGSPVEQNMYELTKEQSRDLRYLPSSLSDALRALEQDCDFLLEGNVFTREFISAWIDYKRKNELNRIAQYPHPLEFGMYYGV

SEQ ID NO: 18780 - protein, 473 aa, Tropheryma whipplei str. Twist
MFMRRAKIVVTLGPAVSDLDSVRDLISAGADVFRMNLSHGSLDFHREVFLNVRTAAAELDRHIAIFADLQGPKIRLGRFASGPYTLQEGDIFTITTEQVLGTKELSSTTLPTLPDNVSEGDLLLIDDGKVALRAIGNDGVRITTRVEVPGKVSNNKGINLPGVGVKVPALSEKDIDSLRWALSLPVDMIALSFVRCASDVDAVHKVMDEEGIRLPVIAKIEKPQAVSAIEEIALRFDAIMVARGDLGVELPLEDVPVAQKEIVKVARRFARPVIIATQMLESMISSSRPTRAEASDVANAVLDGADALMLSGETSVGEWPVEAVRVMSRVIEKTEEKAISQIVGFGTTPKTQGGALAWAAAKVAEFIDARYLCVFSESGDSIRRVSRLRHDIPIIGFSPVGSVVRQVSLSWGVRCFLIERLHQTDQMMRKAEHVLLTNNLAEIGEKIVIISGSPVGVPGSTNHMRIHELGSTS

SEQ ID NO: 18781 - protein, 395 aa, Tropheryma whipplei str. Twist
MRTLGGFTFPCDAPVFVRVDFNVPMDEVGTITDDLRIRASLPTIESLLGRGAPLILISHLGRPVKNEQQGFSLKPCAERLSEYIGVNVPLVDFLDLDTKLYGELTRHLDKSGIVLFENIRFFAEETSKAQADRRILAEQLAPFAGAYVNDAFGASHRRHASVYELAQAFSNKAAGFLIESEMQAFSHLASEAKRPYTVILGGAKLSDKLRLIENILPTVDRLLLCGGMAFTFLAAQGCETGKSLLEESFIPEANKIIDFAKQNNVELILPVDVIEARSLTSPLGVVSKAESISYMGLDIGPETQSIFRNVIQDSKTVFWNGPAGLFENPSFSNGTRALLDALSSSSAFTFIGGGDTAAAVSLLGFDYGDFSHVSTGGGACLELLEGKILPALEVL

SEQ ID NO: 18782 - protein, 293 aa, Tropheryma whipplei str. Twist
MLPKRAYPVQDSNVHSQEKKIIAGNWKMNINHSQAVSYLQELNWRLIDNGHDFDSCEIAVFPPFTDLRSVQTLVASDDIQISYGAQDVSAFSDGAHTGQISAQFLKDLDCKYVLIGHSEQRCLPCYPGNNSAINELNNKHDGLIANKLLRSFAAGICPILCIGDISPGDHFDATLSRFRSVLSHLKAISDKKHSIGYALGSKTHFLDSDQLHMLVAYEPSSAINSGNCANSGDIVRMAAAIKDIVNVRVLYGGGVNLFNASAVFNEDLLDGILVGRASLNASDFASLIKTCCL

SEQ ID NO: 18783 - protein, 294 aa, Tropheryma whipplei str. Twist
MVSLKFVVLTFGLVALLSGCADQGIKVDGKFGTPVRVSIETVVKVKDVTRTVIDEGDGPELKSGDLVAYQVAYFNGTTGDRIKPGEFGTARGISTYTVGQGAYLDKILQKVKVHSRILAQVPGALLWGSDSRPEGVGERDNAVVVLDVLNVIATKLNGPKKPSPPGLPTVVDSANGPKILPVTAPAPQALSVVTLIEGSGHPVKPTDKVTVHYVGALWSGKVFDSSWNRRAPAEFLLDGLIKGVKDGLVGAKVGSRLLIVVPPALGYGDKAQGDIPANSTLIFVFDILMATSRN

SEQ ID NO: 18784 - protein, 364 aa, Tropheryma whipplei str. Twist
MDCSELYSVIPAGGIGSRLWPLSRAASPKFLHKLTGTETSLLRDTWDRLVPISGVDRIMVVIGSDHFDAVTSQLPELKGHNVILEPEPKDSTAAICLAAAILNTREPDVIIGSFPADHVIKTSPLFQQSVAQAVVAANEGYVVTIAITPTEPATQFGYILCGDSAGIKGAPQVLSVKRFVEKPSQKDADRYLSSGKYLWNAGMFIAKACVLLEQLEKARPDIHSLIIDIANSPDLDSALKKNWPKMPRIAIEYSVAEPCAAEGRMVTVPAKFEWNDAGDFSSIARLNSRGGSDLVILGETSRVLSDSATGIVVSQTDRIISVIGTKDIVVVDTPDSLLVTTKDDAKKVKQIVEALRLSGRDDVL

SEQ ID NO: 18785 - protein, 219 aa, Tropheryma whipplei str. Twist
MEIRISPSILSADFCNLERDLQLISSADMVHVDVMDGHFVPNITFGLPVVKRICEVSPVPLDVHLMVENPDYWALQYADLGVYSVTFHFEAAKDPIATARNIRSNKSKVGLAVSPDTDIGECVHVLPEVDMLQVMTVYPGFGGQKLIRRVLDKFSRITRSEFENLSFSVDGGVTLGNISEIASVGVDTFVAGSSVFLSQLPADSVESLRKLAKVAYKRF

SEQ ID NO: 18786 - protein, 476 aa, Tropheryma whipplei str. Twist
MRADIGVYGLAVMGSNLARNFAGKGIRVAIHNRSSDRSNSLAQQHSECNFIVAKDDKDFIDSLSSPRTVLLMVKAGSIVDEVIARLSTFMQPGDVIIDGGNSLYTDTIRREEELKARGLHFIGLGVSGGEVGALEGPSLMPGGSDYAYSIVGPMLEKIAARANGEPCVAHIGHNGAGHFVKMVHNGIEYADMQIIAESYDLLRRGLGLSPTRISDIFREWNSGELESYLVGVTADILSHRDKRTGKPFVDIVLDQAGAKGTGAWTAQNALDLGVPAGSVSEAVFARSLSSDEQRCQVQQKLSRSQASSHEAPLKEAEFIDAVRNALYLAKILAYSQGFRIISVAAAKHDWGIDLSACARIWRAGCIIRAVFLDKVAHEYSKNPDLTSLMCSPGFSDELVGRLRFLREVVASAARLAIPAPVFSSLLSYIDALASDRLPACLIQAQRDDFGAHTYRRVDVPGIFHTLWSSDLSEVPA

SEQ ID NO: 18787 - protein, 450 aa, Tropheryma whipplei str. Twist
MDYDLIVLGAGSAGYATAIRATQLGMKVALAEGDKVGGTCLHRGCIPTKSLVQCAKAAHIAKNASKFGVINSFSGVDINAVNVFKNGIVESKYRGLQSLLRSYGIHVYPNFATLSSQNSVRIGTEDITGKNIVIATGSRPKGIPGLSGGCIFDSDSILEIDHLPSSLAIIGGGVIGVEFASIFNYLGVDVSILEAQETLIPSEERGVSKQLERVFRRRGIKLYLGHKIMDVSQTDGVVVSLDSNEKVNADLLLVAIGRAPATDAIGKVGIEIDGGAISVDEKLRTSVPNVFAAGDVVGGLQLAHRGYQQGIYLAEQIAGLDPSAVADINIPRVIYTSPEVASVGYTEAGAAEIYGVNEIVTYEYNLAGNAKSSIMGAAGSIKVVQHKNKDVLGVHMVGDGVSELVSEAQLIVNWEANPSDVASLIHPHPTQAEAIGEAMLALAGKPLHGI

SEQ ID NO: 18788 - protein, 186 aa, Tropheryma whipplei str. Twist
MRAIMVGPPGSGKGTQCGLIQSRLGISVIATGDVFRERMKTDMALRDIVSSGGYVSDSTTNRIVEDCLDKEDVSSGFVLDGYPRTLQQLDFLEGFLKRRALTLDAVFSLEVATDLLIERLRARSKESGRTDDRDSVIARRLEIYTEMTLPIIDACEEKGLLHRIDASKGIEEVFQSIKDVFDRVTI

SEQ ID NO: 18789 - protein, 183 aa, Tropheryma whipplei str. Twist
MVITFTCTPYAVNCKHMKPLLSEAVIHRRLAQLALQIDEDYRGTSIVLLGVLKGSIMLMADLSRLLSSDLRIEWVTLSSYGNDTVSSGSIRIVHDLDADIRDRHVLIIEDIVDSGLTLGWLLAKMRERRPASIEACVLLRKPHARGTDVRYLGFDIPDEFVIGYGMDYAEKYRNLKSVYVLEQ

SEQ ID NO: 18790 - protein, 442 aa, Tropheryma whipplei str. Twist
MGGAGLLTDQYELSMVNAARISGIAAKECVFEVYSRALPPGRPFGVFAGLERLLEKIENFSFADDEITWLREKNIVDNETLDWLRGYSFSGSISGHKEGEIFFPNTPVLTVRAPFAEAVVLETLILSCINFDSAIASAAAQLVYRAKNKPVYEMGSRRTNEQAAVAAARAAYIAGFAATSNLAAGKIWDIPTVGTMGHAFILAHKTESEAFYAQLKQGGGNNITLLIDTYDIQEAIDSAVTVAGKNLAAVRIDSGNLPEVVHDVRRKLDLAGATETKIILTGDLDEASIRLVSTAPVDALGVGTSLVTAGGFPSAGFVHKPVACREKNRWRMLSKKSKNKVSTGGQKNVQRVLDKNKKIIKEQVLVFDPDNPPVTTYDTNVLQITSEHIRHGKRVAINSTNEIRAYHKSVINQIPEEVFNLEGKINTERISWHSVQGHRLEA

SEQ ID NO: 18791 - protein, 452 aa, Tropheryma whipplei str. Twist
MEEYDLIVVGAGSGNSILDQRFDSLKIALLDDGAHFGGTCLNYGCIPTKMLLRPATLAYQAKHASKLGVHFSDPRIDWQKIRSRTFSTTDDISAAGLEYRLGCSNIDVYRESYFFIDQRTLQSSSGHRISGEKIVIAAGSRPRLFGIEPDNRLIYTSAEIMRIEQLPESLVILGGGVVAVEMATFFSGYGVDTTTVNRSEFLLSSFDTEVAKSLTAQVPWKHIGQERVQNVSKKDSSVEIELSSGTRLLAQALLLAQGRVSNADKLRCRDVGFDIHSDGRLKTDKYQRVLADNRPLDNVFALGDVSDPNQLKHIANHQARIVGHNLLNGDMLASDLVPPAAAVFSEPQVAWVGTFPNNSIVVRGNYSDTAYGWAFGLRPDDAFVKLFIDKSGVLNGAFVIGPEASIIIQPLIQAVSLNLKVQGLARSQYWPHPAGTEVVENALLKAEEFLRA

SEQ ID NO: 18792 - protein, 432 aa, Tropheryma whipplei str. Twist
MSKIKLVTAIPGPESERLHRMRQATVARGVSSTFPIYIKESHGSILIDEDGNHLIDMGCGIGVTTLGHSHPAVVDAARAQINSVWHTLFSITPYESYVEVCKLLAKNTPGDFPKKSLLLNSGAEAVENAVKISRAYTGRPTVAVLDRSFHGRTNLTSSMTYRGSLYSSDFGPTASNIVSAPNSYPLHDRLSGKEAAARTISYLETRVAARNIACLFYEPIQGEGGVIVPADGFLPALQDWCRENDIVFVADEIQSGFGRTGCFFASETDGLEPDIVCSAKGIANGLPLSAVTGRSDIVDAARPGTLGGTFTGNHVSCAAALEVFEQYKDNAPLDSASRLGDILKELLLNLQSKHPQIAEVRGRGAMFGAEFSGNHAGEMVSRVITRAAELGVIFLSSGVEGNVVRFLPNVFMDKETIEEAIGVLDSAISSVV

SEQ ID NO: 18793 - protein, 221 aa, Tropheryma whipplei str. Twist
MDNLVLLRHGNSLWNQENLFTGWVDVRLSELGEKEAKTAGQLLREANRYPDVLFTSLLTRSIQTAHIALMEIDRVWLPTFRSWRLNERHYGSLQGKNKAQVLEEFGEEQFNSWRRGYDTPPPPLHSQADDPRYEEPPPLSESLKDVQNRLLPYWQGVILPHLVAGKVVLVVAHGNSLRALVKHLECISDTDVCQLNIPTGIPLVYSIDPSGCATHPGRYLP

SEQ ID NO: 18794 - protein, 466 aa, Tropheryma whipplei str. Twist
MRTNFEWFEEAKRFIPGGVNSPVRAYAAVGGTPRFLAKAQGAYVTDIEGREYVDLVSSWGPLILGHAHPKVIDAVINTAHRGMSYGAPTTLEVELAELVCNRICNAQGIKPVERLRLVSTGTESCMTAIRLARCFTGRDLIVKFSGHYHGHADPFLIDAGSGLVGHPSSGGVPESVAKNTLVVPYNDLAVLEYLFEAYPNQIACIITEACPANMGVIPPDPGFNARVADLGHSHGALIIFDEVITGFRVGSGGFWALETSLASQQPTQAVSEGSVSDSAYSAYVPDLFTFAKVLGGGLPIGAIGGRAEIMDLLSPSGPVYQAGTLSGNPLATAAGLATLRLADSNIYEHMNRVARALINEIQSAFHDAGVPCTVQSAGNLFGISFSAIAPRDFTQATSQEHWRYSNFFHSMLNSGVLLPPSVYEAWFVSAAFDDRAIERVVNALPDAVRAAGSAPARPKGFEPPTF

SEQ ID NO: 18795 - protein, 293 aa, Tropheryma whipplei str. Twist
MLYRFRMVSQDWLEKDFYAVLDVDSGVSGSQISKAYRKLARRYHPDSNPGSKEAEARFKEISEAYTVLSDPVQREEYDQLRNQKGAFTTGDFGDIFSNLFTGHRSHFAPSGGDIAASVKVSLESIVLGDYVNMQLSSGETLRVKIPSGIGNGERFRVRGKGAPSPYGGPSGDLIVTVNIRPHPVFELDGKDLRMNLPITFVEAFSGAVIEVPTMQKQTVKIKIQPGTLSGMTLRIKGRGVQSAQQPGDLLAVVQIVPPKNTDDVRKIIEQLAAKTAGDNPRRDVLECVRDSDP

SEQ ID NO: 18796 - protein, 446 aa, Tropheryma whipplei str. Twist
MYSCTGFSRRVCTWWKSVMCLIDSVHARQILDSRGTPTVEVEVTLEDGSMGRSAVPSGASTGAFEAHELRDQDNNEYLGKGVTRAVRSVNSEIAPVLIGFDAFDQVGLDHRMIELDGTNNKSRLGANAILGVSLASASAAARAADLSLFRYLGGPSSRILPVPMMNIINGGAHADTGVDIQEFMILPVGARSFSESLRWGCEVYHSLKVQLRESGLSSGLGDEGGFAPALRSNRTALDLILSAIEKAGFSPGIDIVLALDIAASEFCKAPGHYRFEGKDITSDELISYYEGLLSSYPLVSIEDPLDQDDWEGYRTLTTHIGDRVQIVGDDLFVTNTSRLSRGIQSGVANSILVKVNQIGTLTETFDAVDMAAKGGYTAVLSHRSGETEDTTIADMAVATNCGQIKTGAPARGERIAKYNQLLRIEEKLGRSARYAGWLSYPRWQGK

SEQ ID NO: 18797 - protein, 323 aa, Penicillium janthinellum
AASGVATNTPTANDEEYITPVTIGGTTLNLNFDTGSADLWVFSTELPASQQSGHSVYNPSATGKELSGYTWSISYGDGSSASGNVFTDSVTVGGVTAHGQAVQAAQQISAQFQQDTNNDGLLGLAFSSINTVQPQSQTTFFDTVKSSLAQPLFAVALKHQQPGVYDFGFIDSSKYTGSLTYTGVDNSQGFWSFNVDSYTAGSQSGDGFSGIADTGTTLLLLDDSVVSQYYSQVSGAQQDSNAGGYVFDCSTNLPDFSVSISGYTATVPGSLINYGPSGDGSTCLGGIQSNSGIGFSIFGDIFLKSQYVVFDSDGPQLGFAPQA

SEQ ID NO: 18798 - protein, 1016 aa, Escherichia coli
MQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARVCHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNREYTEAYTNASLIVREDYGFEDGLFTGYDAEKRKYDKSSWTYELDENGFAKRDTTLQHPRCVWNLLKQHVSRYTPDVVENICGTPKDAFLKVCEYIAETSAHDKTASFLYALGWTQHSVGAQNIRTMAMIQLLLGNMGMAGGGVNALRGHSNIQGLTDLGLLSQSLPGYMTLPSEKQTDLQTYLTANTPKPLLEGQVNYWGNYPKFFVSMMKAFFGDKATAENSWGFDWLPKWDKGYDVLQYFEMMKEGKVNGYICQGFNPVASFPNKNKVIGCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPSSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 18799 - protein, 225 aa, Rhodospirillum rubrum
MTRAIRIAPSLLSADFAISRPRCPSDGRTGADILHFDVMDNHYVPNLTVGPLVCAALRPHTSLPIDVHLMTRPVDPLIDSFAEAGADMITFHPEASDHVHRSVQMIRKRGLKAGVALNPASPLSLLDHILEDLDLVLIMSVNPGFGGQSFIPSALPKIAALANGRRRACRGDRVDGGVNPADARALARPGADILVRLAIFGASDRAKAIASIRGAAESGLGQEAA

SEQ ID NO: 18800 - protein, 351 aa, Pneumocystis carinii
MTASSRNVRFNVSDDYEILDVIGEGAYGIVCSAIHKPSGQKVAIKKISPFDHSMFCLRTLREMKLLRYFNHENIISILDIQQPQDFESFSEVYLIQELMETDMHRVIRTQDLSDDHCQYFIYQILRALKAMHSADILHRDLKPSNLLLNANCDLKVCDFGLARSAVSTEDSSSFMTEYVATRWYRAPEIMLTFKEYTKAIDIWSVGCILAEMLSGRPLFPGKDYHHQLMLILDVLGTPTMEDYYGIKSRRAREYIRSLPFKKRVSFASIFPRANPLALDLLEKLLAFNPAKRVTAEEALQHNYLEPYHDPDDEPTAPPISPSFFDFDRIKDSLTKNDLKILIYKEIMSMNN

SEQ ID NO: 18801 - protein, 329 aa, Schizosaccharomyces pombe
MDVVLQYADKYVFDTFYGKIAESFDSSSSFANTAVNSTTLGLAEKVNFAITSGLLDRNNVWRQFTSLFLITWIMGTLSYFLSASFAYYVYFDREEARRHPKFLKNQEHLELMVALKNLPGMAILTAPWFLAEIRGYGYVYDKLDEYGYFYLFFSIALFLLFSDFLIYWIHRALHHRWLYAPLHKLHHKWIVPTPYSSHAFHYLDGYSQSLPYHMFPFFFPLNKYVYLLLFGSVNYWTVLIHDGKYFSNNAVVNGAAHHAAHHMYFNYNYGQFFTLFDRLCSSYRQPDQELFDAELRNEKLQEQRIRFMETVQYTVEGKDDRTYASKKDN

SEQ ID NO: 18802 - protein, 308 aa, Pseudomonas sp. B11-1
MPLDKQIAAVLQQFSELPAPDFSQLDAAQYRQFCDNLLPAIPGDPMIEVRNLRVAAAAGELDARLYRPLEEDNLPLLVFFHGGGFVMGNLDTHDNLCRSLASQTEAVVVSVAYRLAPENHFPAAPLDCYAATCWLVEHAAELGVDGRRLALAGDSAGGNLALAVSRLAAQRQGPKISYQCLFYPVTDARCDSQSYEEFAEGYFLTGAMMYWFWQQYLQDTGQGDDPLASPLRAETLADLPPTTLITAEFDPLRDEGEAFALRLQQAGVSVRVQRCEGMIHGFISMAPFVERAAHALSDAAADLRRALN

SEQ ID NO: 18803 - protein, 341 aa, Zea mays
MPTAEATTPVPPELSSGQGRTVCVTGAGGFIASWLVKRLLEKGYTVRGTVRNPVDPKNDHLRSLDGADDRLVLLRADLLDPESLAEAFSGCDGVFHAASPVTDDPEMMIEPAIRGTRYVMAAADDAGVKRVVFTSSIGTVYMNPYRDPSKPVDDTCWSDLEYCKNTQNWYCYAKTVAEQGAWEVARKRGLDLVVVNPVLVLGPLLQPTVNASTDHVMKYLTGSATTYVNAAQAYVHVRDVAEAHVRVYEAPHAHGRYICAESTLHRGDLCRVLAKLFPEYPVPTKCKDQVNPPVVGYKFTNQRLKDLGMDFVPVLQCLYETVTSLQEKGMLPVLPTKHDHA

SEQ ID NO: 18804 - protein, 346 aa, Zea mays
MPTAEATTPVPPELSSGQGRTVCVTGAGGFIASWLVKRLLEKGYTVRGTVRNPVDPKNDHLRALDGAVDRLVLLRADLLDPQSLAEAFSGCDGVFHAASPVTDDPEMMIEPAIRGTRYVMAAADDAGVKRVVFTSSIGTVYMNPYRDPSKPVDDTCWSDLEYCKNTQNWYCYAKTVAEQGAWEVARKRGLDLVVVNPVLVLGPLLQPTVNASTDHVMKYLTGSATTYVNAAQAYVHVRDVAEAHVRVYEAPHAHGRYICAESTLHRGDLCRVLAKLFPEYPVPTKCKDQVNPPVVGYKFTNQRLKDLGMDFVPVLQCLYETVTSLQEKGMLPVLPTKQDHDQLGKS

SEQ ID NO: 18805 - protein, 328 aa, Shigella flexneri
MPLHNLTRFPRLEFIGAPTPLEYLPRFSDYLGREIFIKRDEVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 18806 - protein, 328 aa, Escherichia coli O157:H7
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASVEILLWDDYFAPGYGVPNDEGMEAVKLLARLEGILLDPVYTGKAMAGLIDGISQKRFKDEGPILFIHTGGAPALFAYHPHV

SEQ ID NO: 18807 - protein, 379 aa, Cucumis melo
MPSLTAPHGLPLFLFLLLFLFSSVSAQFQPAPDPRSDPYQYRLSGSMAVIIVILIAALFFMAFFSVYIRHCNDSPSNTVRPITAAAGRSRRATRGLDPAVIETFPTLIYSDVKEHKIGKSALECAVCLNEFEDDETLRLIPKCDHVFHPECIDAWLASHSTCPVCRANLSPQPTDSVHRADDSNAVVNSDTDGGDIEAQSNDVVSETTAPPTVQIQTESELSTTTSNKALNRTRTRGSRSNRLRWLFPRSHSTGHSLVQPGEDTERFTLRLPVEIRKQVVNRKLHRATSMVVLARQSSSMRGYRFGSGEGSSRGKYYRRLERLDRTSKSDRWVLSMTPPFFTRMSSMKTPRGGSNRAEPGSGRELGQGNTAVDSSRLPV

SEQ ID NO: 18808 - protein, 447 aa, Oceanobacillus iheyensis HTE831
MYQTTTLKDKIKLFIIILLPILITQVSINLMSFFDTMMSGQFSARDLAGVAIGSSLWVPILTGINGIVLSITPIIAHLIGAKNKKDIPQVIQQGIYLSFVLSIIIIVIGGIALDPILQAMSLEKEVQRIAKYYLITLGTGIVPLFLFHTIRSFMDGLGQTRSSMIIILISLPINAVLNYILIFGKFGIPAFGGIGAGIATSLTYWIISGISIFMIHRVYPFHSYKVFQKILPPTLSYWADQLKIGLPIGLAIFFETSIFSAVTLLMSEYNTNTIAAHQAAMNFASLLYMLPLSVGMALTIAVGFEVGAKRLHDAKRYTYLGIMGGLFIAIFAGIILYTFDDVVARLYNSNPEVIELTKQFIIFAIFYQLADAIGAPIQGALRGYKDVNMTLVIALISYWIIGLPTGYLLANYTALEPFGYWVGIIVGLSTGAIALLARLLFIQKKSV

SEQ ID NO: 18809 - protein, 309 aa, Saccharomyces bayanus
FGGIELFVLSINEQANPRKSTPVAAKRSIYRILIIYLLTMILIGFNVPHDNDQLMGSGSSATHASPYVLAASIHGVKVIPHIINAVILISVISVANSALYAAPRLMCSLAQQGYAPKFLNYIDREGRPLRALVVCSFVGLVGFVACSSQEEQAFTWLAAIAGLSEIFTWSGIMLSHIRFRKAMKVQGRSLDEVGYKSNTGIWGSYYGVIFNILVFMAQFWVALSPPGSDGKCDVESFFQSYLAAPLWIFMYLGYMIYNKDFTLLNPLDKIDLDFHRRVYDPEIMRQEDEENKERLRNSSVFFRMYNMWC

SEQ ID NO: 18810 - protein, 506 aa, Saccharomyces bayanus
MPESRLQRLANLKIGTPQELRRTSIIGTIGPKTNSCEAITALRKAGLNIIRMNFSHGSYEFHQSVIDNALKSEQQFPGRPLAIALDTKGPEIRTGRTPNDQDFHILVDHQMIFTTDAKFEHSSNDKIMYIDYANLTKVIVPGKLIYVDDGILSFKVLQIMDDANIRVQALNSGYISSRKGVNLPNTDVDLPPLSAKDIQDLQFGMRNGIHMVFASFIRAPEDVLTIRKVLGTEGEDIKIISKIENQQGLDNFDEILQVTDGVMIARGDLGIEILAPEVLAIQKKLIAKCNVAGKPVICATQMLESMTYNPRPTRAEVSDVGNAVLDGADCVMLSGETAKGDYPVNAVKIMAATALIAESTIAHLALYDDLRDATSKPTSTTETVAAAATAAILEQNGKAIVVLSTTGNTARLLSKYRPSCPIILVTRHARTARIAHLYRGVFPFVFEPKRLYDWGEDVHRRLKFGVEMARSFGMVESGDTVVSIQGFRGGIGHSNTLRVSTVGEEF

SEQ ID NO: 18811 - protein, 298 aa, Saccharomyces bayanus
  misc_feature (281)..(281): Xaa can be any naturally occurring amino acid
MSRLERLTSLNVVAGSDLRRTAIIGTIGPKTNNPETLVALRKAGLNIVRMNFSHGSYEYHKSVVDNARKSEELYPGRPLAIALDTKGPEIRTGTTTNDVDYPIPPNHEMIFSTDDKYAKACDDKVMFVDYKNITKVISAGKIIYVDDGVLSFEVLEVVDDKTLKVKAMNAGKICSHKGVNLPGTDVDLPALSEKDKEDLRFGVRNGVHMVFASFIRTANDVLTIREVLGEQGKDVKIIVKIENQQGVNNFDEILKVTDGVMVARGDLGIEIPAPEVLAVQXKLIAKSNLAGKPVICAT

SEQ ID NO: 18812 - protein, 186 aa, Saccharomyces bayanus
  misc_feature (25)..(25): Xaa can be any naturally occurring amino acid
  misc_feature (57)..(57): Xaa can be any naturally occurring amino acid
ISDVGNAILDGADCVMLSGETAKGXYPINAVTTMAETAVIAEQAIAYLPNYDDMRNXTPKPTSTTETVAASAVAAVFEQKAKAIIVLSTSGNTPRLVSKYRPNCPIILVTRCPRAARFSHLYRGVFPFVFEKEPVSDWTEDVEARINFGIQKAKEFGILKDNDTYVSIQGFKAGAGHSNTLQVSTV

SEQ ID NO: 18813 - protein, 182 aa, Saccharomyces bayanus
EIIQGLKLIPGQIKQVLKLEPRIKKICSTELKDQKSLLLLGRGYQFAAALEGALKIKEISYMHSEGVLAGELKHGVLALVDENLPIIAFGTRDSLFPKVVSSIEQVTARKGHPIIICNENDEVWAEKSKSIDLQTLEVPQTVDCLQGLINIVPLQLMSYWLAVEKGIDVDFPRNLAKSVTVE

SEQ ID NO: 18814 - protein, 489 aa, Saccharomyces bayanus
MSADFGLIGLAVMGQNLILNAADHGFTVCAYNRTQSKVDHFLANEAKGKSIIGATSIQDFISKLKRPRKVMLLVKAGAPVDALIKEIVPLLEKGDIIIDGGNSHFPDSNRRYEELKKHGILFVGSGVSGGEDGARYGPSLMPGGSEEAWPHIKNIFQSISAKSDGEPCCEWVGPAGAGHYVKMVHNGIEYGDMQLICEAYDIMKRLGGFTDKEISEVFTTWNKGVLDSFLIEITRDILKFDDVDGKPLVEKIMDTAGQKGTGKWTAINALDLGMPVTLIGEAVFARCLSALKNERVRASKVLPGPQVPKDAVKDRKQFVDDLEQALYASKIISYAQGFMLIREAAATYGWKLNNPAIALMWRGGCIIRSVFLAEITKAYRQEPDLENLLFNKFFADAVTKAQSGWRKSIALATTYGIPTPAFSTALTFYDGYRSERLPANLLQAQRDYFGAHTFRVLPECASENLPEDKDIHINWTGHGGNVSSSTYQA

SEQ ID NO: 18815 - protein, 261 aa, Saccharomyces bayanus
MSKAVGDLGLVGLAVMGQNLILNAADHGFTVVAYNRTQSKVDRFLANEAKGKSIIGATSIEDLVAKLKRPRKIMLLIKAGAPVDILIKELVPHLDKGDIIIDGGNSHFPDSNRRYEELTKQGILFVGSGVSGGEEGARFGPSLMPGGSKEAWPHIKNIFQSIAAKSDGEPCCEWVGPAGSGHYVKMVHNGIEYGDMQLICEAYDIMKRLGGFTDKEISEVFTKWNTGVLDSFLIEITRDILKFDDVDGKPLVEKIMDTAGQ

SEQ ID NO: 18816 - protein, 1053 aa, Saccharomyces bayanus
  misc_feature (609)..(609): Xaa can be any naturally occurring amino acid
PTVFNAPYKLIKNATRIFQNSNEGSTFQILKPMEGCLNPGELLVVLGRPGSGCTTLLKSISSNTHGFDLGKDTEISYSGYSGDDIKKHYRGEVVYNAEADIHLPHLTVFQTLLTVARLKTPQNRIKGVDRESYANHLAEVAMATYGLSHTRNTKVGSDLVRGVSGGERKRVSIAEVSICGSKFQCWDNATRGLDSATALEFIRALKIQANISNTSATVAIYQCSQDAYDLFNKVCVLDDGYQIYYGPGDKAKKYFEDMGYVCPSRQTTADFLTSVTSVSERILNEDMLKKGISIPQTPKDMNDYWVKSQNYKELMEEIDQKINNNDEAAREAIKEAHIAKQSNRARPTSPYTVNYMMQVKYLLARNMWRIRNNIGFTLFMILGNSGMALILGSMFYKIMKNGDTSTFFFRGSAMFFAILFNAFSSLLEIFSLYEARSITEKHRTYSLYHPSADAFASVLSEVPTKLTIAVCFNIIFYFLVDFRRNGGVFFFYLLINIVAVFSMSHLFRCVGSLTKTLSEAMVPASMLLLSLSMYTGFAIPKKKILGWSKWIWYINPLAYLFESLLINEFHDRKFPCAQYIPRGTAYANSTGTETICSVVGAIPGQDYVXGDDFIKESYQYYHSHKWRGFGIGMAYVIFFFFVYLFLCEYNEGAKQKGEILVFPRSVVKKMKKQGALKEKNGNDPENVGERSDFSSDKKMLQESSEEESDTYGDVGLSKSEAIFHWRNLCYEVQIKTETRRILNNVDGWVKPGTLTALMGASGAGKTTLLDCLADRVTMGVITGDIFVNGIPRDESFPRSIGYCQQQDLHLKTATVRESLRFSAYLRQPAEVSIEEKNVYVEEVIKILEMEKYADAVVGIAGEGLNVEQRKRLTIGVELTAKPKLLVFLDEPTSGLDSQTAWSICQLMKKLANHGQAILCTIHQPSAILMQEFDRLLFMQRGGKTVYFGDLGDGCKTMIDYFENHSSHKCPPSANPAEWMLEVVGAAPGTHADQDYHEVWRNSDEYRAVQSELDWMEKELPKKGPITAEADQHEFAQSIVYQTKLVSIRLFQQY

SEQ ID NO: 18817 - protein, 459 aa, Saccharomyces bayanus
DTKDVEDRASRSSGQGSSSSSAAQSIAQHPYRGLDNEAAERVHELARTLTSQSMLHSTTSNNADQNSSSSTHNTQHNNADSRSIFSTDMMGVNPVFTNPDTPGYNPKLDPNSDEFSSTAWVQNMANISSSDPEFYKPYTLGCVWKNLSASGDSADVSYQSTFVNIVPKLLTKAFRILKPRKDEDTFQILKPMDGCLNPGELLVVLGRPGSGCTTLLKSISSNSHGFKVAKDSTVSYDGLSSSDIKKHYRGEVVYNAESDIHLPHLTVYQTLFTVARLKTPQNRIKGVDRESYANHVTEVAMATYGLSHTRDTKVGNDLVRGVSGGERKRVSIAEVAICGSRFQCWDNATRGLDSATALEFIRALKTQADIGKSAATVAIYQCSQDSYDLFDKVCVLDDGYQLYFGSSKKAKKYFQDMGYVCPPRQTTADFLTSITSPTERIINKEYIAKGIKVPQTARE

SEQ ID NO: 18818 - protein, 333 aa, Saccharomyces bayanus
HWRDLCYDVPVKGGERRILNNVDGWVKPGTLTALMGASGAGKTTLLDCLAERVTMGVITGNIFVDGRLRDESFPRSIGYCQQQDLHLKTATVRESLRFSAYLRQPSSVSLEEKDKYVEEVIKILEMEKYSDAVVGVAGEGLNVEQRKRLTIGVELAARPKLLVFLDEPTSGLDSQTAWDTCQLMRKLATHGQAILCTIHQPSAILMQQFDRLLFLQRGGQTVYFGDLGDGCKTMIDYFESHGAHKCPPEANPAECMLEIVGAAPGSHATQDYNEVWRNSDEYRAIQEELAWMEKKLPGKSKDPTADAHKPYAAPISYQFKMVTVRVCQQYWRS

SEQ ID NO: 18819 - protein, 376 aa, Saccharomyces bayanus
INSWNPTLLKEISSTKFESKLFDSNKVSEYSFKNLSMDDVRLIYKNIPKAGFIEVFTNLYNSFNVTAYRQKELEIQYCQNLTFIERKRLLHQLRINVAPKLSSPAKDPFIFSYEKAMWKELSESMNQTVLDQVTNMVHEEYVDKIIGLSEGLKFKNFTLFNITLDGTGAIANDNSDDFVPASDTNVNPVDFQSHLNFSGNPFLDLNSYGLDLFAPTLSDSNRKGILMFDKDPIIVYEDFAYAKVLERRKKKEKEDKKKKEEEDKKKKEEEEKKKKEEEAKKKKEEEEKKKKEEEDKKKKEEDEKKKKEEEDKKKKEEEGKNNEEEDKKKKEEDEKKKKEEEDKKKKEEEGKNNEEEDKKKKEEDEKKKKEEEDKKK

SEQ ID NO: 18820 - protein, 493 aa, Saccharomyces servazzii
MSQEAVADFGLIGLAVMGQNLILNVADHGFTVCAYNRTVSKVDDFLANEAKGKSIVGAKSIEEFIAKLKRPRKIMLLVKAGKPVDYIINDLLPHLEKGDIIIDGGNSHFPDTNRRYEELTKKGILFVGSGVSGGEDGARYGPSLMPGGAEEAWPHIKDIFQSISAKADGEPCCDWVGPAGAGHYVKMVHNGIEYGDMQLICEAYDIMKRIGGFSDKEISDVFATWNKGVLDSFLIEITRDILAFNDKDGKPLVEKILDSAGQKGTGKWTAINALDLGMPVTLIGEAVFARCLSALKSERILASKQLAGPTIPADAIKDKKQFVDELEQALYASKIMSYAQGFMLIREAAKTYGWKLNNPAIALMWRGGCIIRSVFLGEITKAYRENPDLENLLLNKFFSDAVTKAQTGWRKTIGLATTYGIPTPTFSTALAFYDGYRSERLPANLLQAQRDYFGAHTFRVLPEEACETLPEGKDIHINWTGHGGNVSSSTYDA

SEQ ID NO: 18821 - protein, 501 aa, Naumovia castellii
MESRLARLTTLQVTAGDNLRRTSIIGTIGPKTNNPEVLVALRKAGLNIVRMNFSHGSYEYHQSVIENARKSEELYPGRPLAIALDTKGPEIRTGTTTGEVDYPIPPNHEMIFSTDEKYAKACDDKVMFVDYANITKVISKGKIIYVDDGVLSFEVLEVVDGKTLKVKSLNAGKICSHKGVNLPGTDVDLPALSEKDKADLRFGVKNGVHMVFASFIRTAQDVLTIREVLGEDGKDIKIVVKIENQQGVNNFDEILKVTDAVMVARGDLGIEIPAPEVLAVQKKLIAKSNLAGKPVICATQMLESMTYNPRPTRAEVSDVGNAILDGADCVMLSGETAKGNYPINAVTTMADTALIAEQAIAYQPLYDDLRNLTPKPTSTTETVAASAVAAVYEQKAKAIIVLSTSGTTPRLVSKYRPDCPIILVTRNPRAARFSHLSRGVFPFVYEADSVADWTEDVELRLKFGIEKAIEMGVMKKGDTYVSIQGFKAGEGHSNTLQVSNA

SEQ ID NO: 18822 - protein, 476 aa, Naumovia castellii
  misc_feature (457)..(457): Xaa can be any naturally occurring amino acid
MLQSRLARLTHLRTEPSANDIRKTSIIGTIGPQSNNVPTIVALRKAGLNIIRMNFSHGSHEFHQSVIDNARESESQYHGRPLGIALDTKGPEIRTGSFVRDNGVPVKTGHEMIFSTDPQYKECGDDQIMYVDYANITKVMEVGKFIYVDDGAISFEVLQVKDAETLKVRALNDGTLNSHKGVNLPGTDVDLPALSEKDKQDLQFGVKNNIHMIFASFIRTPDDIRTIRQFLGEDGKQIKIIAKIENEQGVNNFDQILQLADGVMIARGDLGIEIPAPEVLAVQKKLIAKCNLAGKPVICATQMLESMTYNPRPTRAEVSDVGNAILDGADCVMLSGETAKGAYPIDAVNMMADTALIAEEATAYLPNYDDIRNCTPKPTPTTETVAASAVAAVFEQDAKAIIVLSTSGDTARLCSKYRPNCPIILITRNDNTARFSHLYRAVFPFVYNKPALDDWVXDVQNRIDFGIEMAKQMGIL

SEQ ID NO: 18823 - protein, 489 aa, Naumovia castellii
MSADFGLIGLAVMGQNLILNAADHGFTVCAYNRTVSKVEHFLANEAKGKSIVGATSIDDFLSKLKRPRKVMLLVKAGAPVDALINELVPRLEKGDIIIDGGNSHFPDTNRRYEELKQKGILFVGSGVSGGEDGARYGPSLMPGGAEEAWPHIKDIFQSISAKSDGEPCCDWVGPAGAGHYVKMVHNGIEYGDMQLICEAYDIMKRVGHFTDKEIGDVFETWNKGVLDSFLIEITRDILKFNDVDGKPLVEKIMDTAGQKGTGKWTAINALDLGIPVTLIGEAVFSRCLSALKSERIRASKTLLGPEVPKDLIKDKKQFVDDLEQALYASKIMSYAQGFMLIREAGKTYGWKLNNPAIALMWRGGCIIRSVFLGEITKAYREDPELENLLFNKFFSDAVTKAQTGWRKSIALATTYGIPTPAFSTALAFYDGYRSERLPANLLQAQRDYFGAHTFRVLPECASDNLPLDKDIHINWTGHGGNVSSSTYQA

SEQ ID NO: 18824 - protein, 397 aa, Naumovia castellii
MPNFRNLISSSSSSNKHDSEKHVTEIHTSTEDEQTSPDDHSIEIIKNEILEKDKKKIAHTNQFSSDIHSITDSLARSRLPHLGDDDDEEDAEEAQYHDTEVKRALKQRHIGMIALGGTIGTGLFVGISVPLTNSGPVGSLIAYLFMGSIIYSITQSLGEMATFIPVTSSITVFSKRFLSPAFGVANGYMYWFNWAITYAVEISVVGQVIEYWTKKVPLAAWIAIFWVFVTLMNFFPVKVYGEIEFWIAFMKVLAIAGYLLYALIIVCGGSSQGPIGFRYWRNPGPWGAGIISKDKNTSRFLGWVSSLINAAFTYQGTELVGITAGEAANPRKSVPRAINKVVFRIALFYIMSLFFIGLLVPYDDPRLSSDSAVVASSPFVISIQNAGTKILPDIFNA

SEQ ID NO: 18825 - protein, 1236 aa, Naumovia castellii
MSFSTDSTSTRDELPLVENNSLDHPYMGFDKTAQDQIRDLARTLTQLSVAHPSESAIDQGSDVQSIYSTGLPGINPVYTNPDTPGYDEKLDPASDNFSSTAWVKNMANIAKSDPDFYKPYSLGCVWKNLSASGDSADVSYQATILNMPWKIITYVYRKVTPTREIDTFQILKSMDGILNPGELLVVLGRPGSGCTTLLKSISSNTHGFDISKDSIISYNGLTPKDIRRHYRGEVVYNAESDIHLPHLTVYQTLLTVARLKTPSNRIKDVTREDYANHLTQVTMATYGLLHTRDTKVGDDLVKGVSGGERKRVSIAEVSICGSKVQCWDNATRGLDSATALEFIRALKTQATILNTTATVAIYQCSQDTYDLFDKVCVLDDGYQLYYGPSDRAKKYFQDMGYVCPPRQTTADFLTSVTSPTERILNQDMLKNGKKIPQTPREMGEYWLESPDYQQLMQQIDAELSSNQDEQRDVIREAHIAKQSKRARPSSPYVVSYMMQVKYLLIRNYWRIKQRASVTIFQVVGNSVIAFILGSMFYKVQKKADSSTFYFRGAAMFFAILFNAFSSLLEIFTLFEARPITEKHRTYSLYHPSADAFASVLSEVPAKLVTSVCFNIIYYFLVNFKRDAGIFFFYFLISIVSTFALSHLFRCNGSLSKTLPGAMVPASMLLLAISMYTGFAIPETKMLGWSKWIWYINPLAYLFESLMINEFHDRRFPCAQFIPAGPPYQNATGTERVCAAVGSVPGQDFVNGDIFLLESYGYQHKHKWRGFGVGMAFVVFFFFGYLILCEYNEGAKQRGEMLIFPQNIVRKMKKQGKLKGKHPNKDDIEAAASSMECNTTEKSILNSSSINYDDMESEVGLSKSEAIFHWRNLCYEIPIKKEIRHILNNIDGWVKPGTLTALMGASGAGKTTLLDCLAQRVTVGTITGDVFVNGCLRDESFPRSIGYCQQQDLHLKTSTVRESLRFSAYLRQPFDVPVEEKNKYVEEIIKTLEMETYADAVVGVPGEGLNVEQRKRLTIGVELAAKPKLLVFLDEPTSGLDSQTAWATCQLMKKLAQNGQAILCTIHQPSAILMQNFDRLLFLQKGGETVYFGDLGSGCQTMIDYFEKEGAEKCPPEANPAEWMLQIIGAAPGSHAIKDFHKAWRNSEEYKAVQKELDWMEQELPRRASETTPEEHKRFATSVWYQFKLVSVRLFQQYWRSPEYLWSKYLLTVFNETFIGFTFFKADRTMQGLQNQM

SEQ ID NO: 18826 - protein, 478 aa, Naumovia castellii
MSEKKTLDVSSINSIDPSNDNSANSTNSENLHEYHGFDQTAEEEIRELARTLTIQSVNNASVHESINELENQSIFTPEMEGINPVFTNPANPGYNPKLDPVSEDFSSKAWVQNMANISLADPDFYKPYSLGCVWKNLSASGESSDVAYQSTFLNMPYKILSTGYRKLKSSKTEDRFEILKPMDGCLNPGELLVVLGRPGSGCTTLLKSISSNTHGFKISDESTISYSGLTPKEVKRHYRGEVVYNAEADIHLPHLTVFQTLYTVARLKTPTNRIKGVDRDTFARHMTEVAMATYGLSHTRNTKVGNDLVRGVSGGERKRVSIAEVSICGSKFQCWDNATRGLDSATALEFIRALKTQATISNSAATVAIYQCSQDAYDLFDKVCVLDGGYQLYYGPGNKAKKYFQDMGYLCPERQTTADFLTSVTSPAERVINPEFIKKGIKVPQTPKDMGDYWLNSQNYKELITEIDRKLSENVEST

SEQ ID NO: 18827 - protein, 1035 aa, Naumovia castellii
VAKQSKRARPSSPYTVSYGLQVKYLLERNFWRIRNNASISLFMIFGNSSMAFILGSMFYKVMRKGDTSTFYFRGAAMFFAILFNAFSCLLEIFSLYEARPITEKHRTYSLYHPSADAFASIISEIPTKFCIAVCFNIIFYFLVNFRMNGGVFFFYLLMNVVGVFCMSHMFRCVGSLTKSLSEAMVPASMLLLALSMYTGFAIPKKKMLRWSRWIWYINPLSYLFESLMINEFHDVKYPCAQYIPFGPAYANISGTERVCSAVGAVPGQAYILGDDYIKESYGYKHSEKWRSLGIGLAYAIFFLGVYLFLCEYNEGAKQAGEILVFPRSVIKRLKKEGKLREKNTAEDIEMAADTSVTDKQLLSSDEMAEESGANIGLSKSEAIFHWRNLCYDVQIKDETRRILNNVDGWVKPGTLTALMGASGAGKTTLLDCLAERVTMGVITGDVLVNGRPRDQSFPRSIGYCQQQDLHLKTSTVRESLRFSAYLRQPADVSIEEKNQYVEDVIKILEMEAYADAVVGVAGEGLNVEQRKRLTIGVELTAKPKLLVFLDEPTSGLDSQTAWSICQLMKKLADHGQAILCTIHQPSAILMQEFDRLLFMQRGGRTVYFGDLGKGCQTMIDYFERNGSHPCPADANPAEWMLEVVGAAPGSHANQDYHEVWRNSAEYKAVQEELDWMAQELPKKQVEESAADQREFATSVPYQAKIVSIRLFEQYWRSPEYLWSKFILTIFNQLFIGFTFFKADTSLQGLQNQMLSIFMFVCIFNPILQQYLPSFVQQRDLYEARERPSRTFSWKAFIFSQIVVEVPWNLLAGTLAFFIYYYPIGFYANASAAGQLHERGALFWLFSCAFYVYVGSMGLAAISFNQLAENAANLASLLFTMSLSFCGVMTTPGAMPRFWIFMYRVSPLTYFIDATLAVGVANVDVHCSDYELLRFTPASRMTCGEYMTPYMEMMGTGYLKDSSATDQCEFCTVSHTNEYLSQVNSSYSRRWRNYGIFICYIAINYIFAVLFYYMARVQRIRVRVPVRAFYPSSRNN

SEQ ID NO: 18828 - protein, 501 aa, Saccharomyces kluyveri
MESRLGWLTELQTETGANLRRTSIIGTIGPKTNNPETLVALRKAGLNIVRMNFSHGSYEYHQSVIDNARKSEELYPGRPLAIALDTKGPEIRTGTTTNEVDYPIPPNHEMIFSIDDKYAKACDDKVMYIDYKNITKVIEKGKIIYVDDGVLSFEVLEVVDEQTLKVKSLNAGKICSHKGVNLPGTDVDLPALSEKDKSDLRFGVKNGVHMVFASFIRTAQDVLTIREVLGEDGKDVKIIVKIENQQGVNNFDEILKVTDGVMVARGDLGIEIPAPQVFAVQKKLIAKCNLAGKPVICATQMLESMTYNPRPTRAEVSDVGNAVLDGADCVMLSGETAKGNYPINAVTIMAETALIAEQAIPYVATYDDLRNFTPKPTSTTETIAAAAVSSVFEQKAKAIIVLSTTGDTPRLVSKYKPNVPIVMVTRNPRAARFSHLYRGVFPFVYESDTESEWTKDVESRLNFGIAKAKEFGMLKEGDTIVTIQGFAAGVGHSNTLRVLTV

SEQ ID NO: 18829 - protein, 363 aa, Saccharomyces kluyveri
MCGIFGYCNYLVEKSRGDIIDTLVEGLQRLEYRGYDSTGIAIDGDDLDETVIYKQIGKVSALKKEIEIQAPKRDVTYVSHCGIAHTRWATHGEPKQINCHPQRSDKHNEFVIVHNGIITNFRELKTLLSNKGYKFESDTDTECIAKLFLHLYNTNLKNGNELDFHELTKQVLLELEGSYGLLCRSVHYPNEVIATRKGSPLLVGVKSERKLKVDFVDVEFPDSEDAQPDVPLNNEKHNDPPKNLMPIATPESNLRRSQSRAFLSEDGAPNPIEFFVSSDVASVIKHTKKVLYLEDDDIAHIYDGELHIHRSRREIGASATRSIQTLEMELDQILKGPYKHFMKKGNLLNNQESTLHTNEKRKT

SEQ ID NO: 18830 - protein, 283 aa, Saccharomyces kluyveri
FLDRKTPVFRDDVCVFVSQSGETADTMLALKYCLERGALTVGIVNSVGSSISRATHCGVHINAGPEIGVASTKAYTSQYIALVMFALSLSDDRVSKVERRKEIIQGLKYIPQQIKQVLNLEKRIKQLCENELSGQKSLLLLGRGYQFASALEGALKIKEISYMHSEGVLAGELKHGVLALVDENLPIIAFGTRDSLFPKVVSSIEQVTARKGRPIIICNENDDVWAKKAKTINLVTLEVPQTVDCLQGLLNIIPLQLTSYWLAVNNGIDVDFPRNLAKSVTVE

SEQ ID NO: 18831 - protein, 285 aa, Saccharomyces kluyveri
MNLISSPDSSSSENTKPSVSKKLEDYVSSETLPIYSHSGDNAPCEKGEGDCRETEVKRALKPRHISMIALGGTIGTGLFVGIASPLSESGPVGALIAYIFIGSIVYFVTQSLGEMATFIPVTSSITVFSKRFLSPAFGVANGYMYWFNWAITYAVEIAVVGQVIQYWTDAVPLAAWIAIFWVLVTLANFFPVKFYGEVEFWVASVKVIAIVGYLIYALVIVCGGSHQGPIGFRYWRNPGPWGPGIISKDVNEGRFLGWVSSLINAAFTYQGTELVGITAGEAVNR

SEQ ID NO: 18832 - protein, 474 aa, Saccharomyces kluyveri
AGPVGALIAYMFIGTLAYMVSQSLGEMATFIPVTSSFMVFTQRFLSPALGAANGYMYFLSWSITFALELSVVGQVIQFWTDAVPLTAWIIILWVVLVSANLAPVKFYGEVEFWIACIKVLAIVGFIIYAFIMVCGAGKTGPVGFRYWRNPGPWGPGIISKDVNEGRFLGWVSSLISAAFTYQGTELVGITAGEAANPRKTVPRAINKVFFRILFFYILSLLFIGLLVPFNDPKLKSEDSYISSSPFVIAIENSGTKVLPHIFNAVILSTIISAGNSDVYISSRVLYSMGLNGLAPKYLTWTTKSGIPYAAVLTTSLVGFLAYLESSHGASVVFDWLLNITAVAGFFAWMLISVAHIRFMQALKHQGISRDDLPFKAKFMPWGAYYAAFFIGVIIIIQGFTAFAPKFNVSDFFTAYVSVILFFAVWIGFQIWFRGPLFKKTEDIDLDTDRREIDNDVWEEDEPKNLWEKFWSAVA

SEQ ID NO: 18833 - protein, 402 aa, Saccharomyces kluyveri
GQIIQFWTFAVPLGAWIAIFWVILTTSNLFPVKYYGEVEFWIACIKVLAIVGFIIYAFIMVCGAGKTGPVGFRYWRNPGPWGPGIISKDVNEGRFLGWVSSLINAAFTYQGTELVGITAGESKNPRRTVPRAINKVFFRILFFYILSLLFIGLLVPFNDPKLKSEDSYISSSPFVIAIENSGTKVLPHIFNAVILSTIISAGNSNIYVGSRVLYGLAKNKLAPKVFARATKDGVPYISVLGTAAFGFLAYLNLSNSAQKVFDWLLNITAIAGFFAWLFISLAHIRFMQVLKDRNMSRNDLPFKAKFMPWGAYYSAFFISLIIIIQGFTAFAPKFNVSNFFAAYISVFLFLAIWVVFQIRFRTRFILTKNDVDIDTDRRDIDCIVWEEETPKNAWDKFWAAMA

SEQ ID NO: 18834 - protein, 1023 aa, Saccharomyces kluyveri
  misc_feature (105)..(105): Xaa can be any naturally occurring amino acid
MSFEDNIGDDSITKEIPAIEGDVAPDHRPYFGLENDLKEQENIRRLARSLTRQSLHSVSNNSLADNENPNDTNSEFGLKRSLTSISHVPGQVPFSSKDIDPRLDXESDTFDPAFWAQNLRKLYLSDKDYYKPVELGVCLKNMRVSGVSVDSDYQSTVLNLPLKWGEKLYTNLFRSNDESRYFDILKPMDALFEPGRLCVVLGRPGAGCSTLLKTISARTYGFKIQPESVISYDGITQKEITKHYRGDVIYSAEMDYHFASLPVGYTLEFAARCRCPESRPEGITREQYYKHYAAVVMATNGLSHTYNTKVGNDFIRGVSGGERKRVSISEVTLAGAKVQCWDNSTRGLDSATALEFVRALKTNANVSRITPLIAIYQCSQDAYDLFDDVLLLYEGYEIYFGKAEDAKQYFLDMGWDCPPRQTTADFLTSVSSPAERRAKPEWENKVPRTAKEFYDIWLHSKEYAKLKVKIDKHLAKSEDGETKRQLAEHHRARQSKNLRPQSPFIISFGMQVKAVIHRNIQRIKGDPSVYLSAIISNSVMGLLVSSMFYNQKSNTGSFYYRTSALFTAILFNSFSSFLEILALFEARKIVEKHKTYAFYHPSADALASIITELPSKILVALGFNLSFYFMVNFRRTPGHFFFYFLVSVTSTFAMSHLFRTIGAASTSLQMAMTPASLLLLIISIYVGFVIPKGSLLGWSKWLYYLNPIARSMESMVANEFAHRTFECSHFIPSGPGYENVTLANKVCAVVGSVAGQSTVDGTSYMEKSFSYYDKHRWRNWGIVLCYAVFFLIVYMVLIEYNKGEMQKGEVILFTRSTLNKKRKKNEALKGDIESNDSITKDLTVSEESYSNEKENSLQKIGSEDIFHWRDVCYDVKIKSETRRILSNVDGWVKPGTLTALMGSSGAGKTTLLDVLANRVSTGVITGNMFVNGHLRDESFQRSTGYCQQQDLHGRTQTVREALRFSAHLRQPQDVSKAEKDEYVEEIIKLLEMEAYSDALVGVTGEGLNVEQRKRLPIGVELVA

SEQ ID NO: 18835 - protein, 304 aa, Saccharomyces kluyveri
MAEKKQSNFAIDFLMGGVSAAVSKTAAAPIERVKLLIQNQDEMIKQGSLDRRYNGIVDCFKRTSEAEGVVSFWRGNTANVIRYFPTQALNFAFKDKIKAMFGFKKEEGYAKWFAGNLASGGLAGGLSLMFVYSLDYARTRLAADSKSAKKGGERQFNGLVDVYKKTLASDGVAGLYRGFLPSVVGIVVYRGLYFGLYDSLKPLLLTGTLEGSFFASFLLGWAVTTGASTASYPLDTVRRRMMMTSGQAVKYDGAFDAFRKIVAAEGIKSLFKGCGANILRGVAGAGVISMYDQLQMILFGKKFK

SEQ ID NO: 18836 - protein, 488 aa, Saccharomyces kluyveri
MSKRGSQHVVGIHYAVGPKIGEGSFGVIFEGENILNSNNNNSSNNSSSASTGTANPVDPVAIKFEPRRSDAPQLRDEFRAYRILNGITGIPHAYYFGQEGMHNVLIIDLLGPSLEDLFEWCGHRFSVKTTCMVAKQMIDRVRSIHQRDLIYRDIKPDNFLISEYQRELPTGQILRSCSSSSNGDPNLIYVVDFGMAKQYRDPKTKQHIPYRERKSLSGTARYMSINTHFGREQSRRDDLESLGHVFFYFLRGSLPWQGLKAPNNKLKYEKIGTTKQRLSPEKLLSDGIPEQFATYLKYCRNLKFDEDPDYDYLISLMDEALNTSGSVEDGHYDWMDLNQGQGWNIRVNRRANLHGYGNPTPRDQKAKNLQQQQQPQSQSQQKQPQQQQQQQQQQQQQQQQPNTTSGSLPTTPHRNSYSKHTFQRFRNNDGVLSVNPSVKQMHGPSTMAIRSPGYDSMGKRMQTSLQGNNNDNDSIEQAGFFRKLCCWC

SEQ ID NO: 18837 - protein, 465 aa, Tropheryma whipplei TW08/27
MSVKKNHKIVVIGGGPGGYSAALSGALLGADVVLIENQAVGGSATLTDVVPSKTLIASAERAVFVAQGADFGIRFQNCVSADIGHINRRIMDLTRAQSADMFSTLTGAGVRVVYGHAALDGPNRVLVSVSGQEKYEFFANTVVVATGSSPRVLPNAIPDGKRILTWKQLYTLEQVPEHIIVVGSGVTGAEFASAFRNLGSEVTLVSSRDRVLPGGDEDAADLIQEVFINSGMKLLNRARAQAAAACNGGVVVTLTDGTEVRGTHCLMAVGSVPNTSGIGLETANIALNPAGRITVNRVACSSVPGVYAAGDCSDFLPLASVAEMQGQVAVYHAMGENANPIELKNLASTVFTTPEIATVGRSEKAIDKARATALKVDLATNSRAKILGIKTGFVKMIVSRETGTVLGGVVVAPNASDLIFPISVAVQNRLSADQLSQSFAVYPSLTISLWHAARASHVRTDSASP

SEQ ID NO: 18838 - protein, 491 aa, Tropheryma whipplei TW08/27
MHPHKLSGVGLTYDDVMLVPGRSDVLPSQVNFGSFLTRRIRLSAPLVSAAMDTVTESGMAVAMARLGGVGVIHRNMSIADQAEHVTRVKLSESGMITRPVSVSPDLTLEEVEQRCSRYKISGFPVVDEDNTLLGIVTSRDMWPYRHEHRASVRVSEVMTRSPLITASPNISSEEARDLLYKHRLEKLPLVDEHGRLFGLITVKDFVNRQRYPFATKDKNGCLIVGAAIGFFGDAYDRALALAAAGVDFIVVDTANGYSDGALKMINRLKNDSTFADIDIIGGNVATGDGAKALIDSGADAVKVGIGPGSICTTRVIAGVGVPQITAIYECAQTSSVPIIADGGLHYSGDIAKALVAGAKSVMLGGLLAGCDESPGELISRGGKQYKIYRGMGSAGAMQARASYSRDRYFQHDLDSHPIAEGVEGQVPHTGSVSTVFYQLLGGLRQSMFYVGCRDINELQDKGRFVRITSAGLKESHPHDIEMIVETPNYRT

SEQ ID NO: 18839 - protein, 167 aa, Tropheryma whipplei TW08/27
MKPLLSEAVIHRRLAQLALQIDEDYRGTSIVLLGVLKGSIMLMADLSRLLSSDLRIEWVTLSSYGNDTVSSGSIRIVHDLDADIRDRHVLIIEDIVDSGLTLGWLLAKMRERRPASIEACVLLRKPHARGTDVRYLGFDIPDEFVIGYGMDYAEKYRNLKSVYVLEQ

SEQ ID NO: 18840 - protein, 450 aa, Tropheryma whipplei TW08/27
MDYDLIVLGAGSAGYATAIRATQLGMKVALAEGDKVGGTCLHRGCIPTKSLVQCAKAAHIAKNASKFGVINSFSGVDINAVNVFKNGIVESKYRGLQSLLRSYGIHVYPNFATLSSQNSVRIGTEDITGKNIVIATGSRPKGIPGLSGGCIFDSDSILEIDHLPSSLAIIGGGVIGVEFASIFNYLGVDVSILEAQETLIPSEERGVSKQLERVFRRRGIKLYLGHKIMDVSQTDGVVVSLDSNEKVNADLLLVAIGRAPATDAIGKVGIEIDGGAISVDEKLRTTVPNVFAAGDVVGGLQLAHRGYQQGIYLAEQIAGLDPSAVADINIPRVIYTSPEVASVGYTEAGAAEIYGVNEIVTYEYNLAGNAKSSIMGAAGSIKVVQHKNKDVLGVHMVGDGVSELVSEAQLIVNWEANPSDVASLIHPHPTQAEAIGEAMLALAGKPLHGI

SEQ ID NO: 18841 - protein, 219 aa, Tropheryma whipplei TW08/27
MKIRISPSILSADFCNLERDLQLISSADMVHVDVMDGHFVPNITFGLPVVKRICEVSPVPLDVHLMVENPDYWALQYADLGVYSVTFHFEAAKDPIATARNIRSNKSKVGLAVSPDTDIGECVHVLPEVDMLQVMTVYPGFGGQKLIRRVLDKFSRITRSEFENLSFSVDGGVTLGNISEIASVGVDTFVAGSSVFLSQLPADSVESLRKLAKVAYKRS

SEQ ID NO: 18842 - protein, 293 aa, Tropheryma whipplei TW08/27
MLPKRAYPVQDSNVHSQEKKIIAGNWKMNINHSQAVSYLQELNWRLIDNGHDFDACEIAVFPPFTDLRSVQTLVASDDIQISYGAQDVSAFSDGAHTGQISAQFLKDLDCKYVLIGHSEQRCLPCYPGNNSAINELNNKHDGLIANKLLRSFAAGICPILCIGDISPGDHFDATLSRFRSVLSHLKAISDKKHSIGYALGSKTHFLDSDQLHMLVAYEPSSAINSGNCANSGDIVRMAAAIKDIVNVRVLYGGGVNLFNASAVFNEDLLDGILVGRASLNASDFASLIKTCCL

SEQ ID NO: 18843 - protein, 395 aa, Tropheryma whipplei TW08/27
MRTLGGFTFPCDAPVFVRVDFNVPMDEVGTITDDLRIRASLPTIESLLGRGAPLILISHLGRPVKNEQQGFSLKPCAERLSEYIGVNVPLVDFLDLDTKLYGELTRHLDKSGIVLFENIRFFAEETSKAQADRRILAEQLAPFAGAYVNDAFGASHRRHASVYELAQAFSNKAAGFLIESEMQAFSHLASEAKRPYTVILGGAKLSDKLRLIENILPTVDRLLLCGGMAFTFLAAQGCETGKSLLEESFISEANKIIDFAKQNNVELILPVDVIEARSLTSPLGVVSKAESISYMGLDIGPETQSIFRNVIQDSKTVFWNGPAGLFENPSFSNGTRALLDALSSSSAFTFIGGGDTAAAVSLLGFDYGDFSHVSTGGGACLELLEGKILPALEVL

SEQ ID NO: 18844 - protein, 471 aa, Tropheryma whipplei TW08/27
MRRAKIVVTLGPAVSDLDSVRDLISAGADVFRMNLSHGSLDFHREVFLNVRTAAAELDRHIAIFADLQGPKIRLGRFASGPYTLQEGDIFTITTEQVLGTKELSSTTLPTLPDNVSEGDLLLIDDGKVALRAIGNDGVRITTRVEVPGKVSNNKGINLPGVGVKVPALSEKDIDSLRWALSLPVDMIALSFVRCASDVDAVHKVMDEEGIRLPVIAKIEKPQAVSAIEEIALRFDAIMVARGDLGVELPLEDVPVAQKEIVKVARRFARPVIIATQMLESMISSSRPTRAEASDVANAVLDGADALMLSGETSVGEWPVEAVRVMSRVIEKTEEKAISQIVGFGTTPKTQGGALAWAAAKVAEFIDARYLCVFSESGDSIRRVSRLRHDIPIIGFSPVESVVRQVSLSWGVRCFLIERLHQTDQMMRKAEHVLLTNNLAEIGEKIVIISGSPVGVPGSTNHMRIHELGSTS

SEQ ID NO: 18845 - protein, 474 aa, Tropheryma whipplei TW08/27
MFENAKEAAEYIKSNQIEVLDVRFCDFLGAQHHFAVPAHAVDDEFFQSPQVFDASSLRGYADINHSDMLLVADPSTSYIDPFRHHKTLAMIFDVHDPRTGDVYERDSRNVAKKAEKYLAGCRFADTAYFAAEAEFFIFDDVRFKISNHSSSYSVDSEEGIWNSSRRKGGGNLGNQLKHKGGYAPLPPADQHADLRDDIMNALTKVGLRVEKGHHEAGSAGQGEINYRFNTLVNAADDLLKFKYVVKNTAHEWGKSATFMPKPIAGDNGSGMHTHQSLWKNGKPLFYSETGYANLSDIALWYIGGLLKHGPALAAFTNPSTNSYKRLVAGFEAPTSLVYSAGNRSAAIRIPPTIGAEGSKRIEYRVPDSSSNPYLAFSALLMAGIDGIKNKIHPGSPVEQNMYELTKEQSRDLRYLPSSLSDALRALEQDCDFLLEGNVFTREFISAWIDYKRKNELNRIAQYPHPLEFGMYYGV

SEQ ID NO: 18846 - protein, 442 aa, Tropheryma whipplei TW08/27
MGGAGLLTDQYELSMVNAARISGIAAKECVFEVYSRALPPGRPFGVFAGLERLLEKIENFSFADDEITWLREKNIVDNETLDWLRGYSFSGSISGHKEGEIFFPNTPVLTVRAPFAEAVVLETLILSCINFDSAIASTAAQLVYRAKNKPVYEMGSRRTNEQAAVAAARAAYIAGFAATSNLAAGKIWDIPTVGTMGHAFILAHKTESEAFYAQVKQGGGNNITLLIDTYDIQEAIDSAVTVAGKNLAAVRIDSGNLPEVVHDVRRKLDLAGATETKIILTGDLDEASIRLVSTAPVDALGVGTSLVTAGGFPSAGFVYKPVACREKNRWRMLSKKSKNKVSTGGQKNVQRVLDKNKKIIKEQVLVFDPDNPPVTTYDTNVLQITSEHIRYGKRVAINSTNEIRAYHKSVINQIPEEVFNLEGKINTERISWHSVQGHRLEA

SEQ ID NO: 18847 - protein, 432 aa, Tropheryma whipplei TW08/27
MSKIKLVTAIPGPESERLHRIRQATVARGVSSTFPIYIKESHGSILIDEDGNHLIDMGCGIGVTTLGHSHPAVVDAARAQINSVWHTLFSITPYESYVEVCKLLAKNTPGDFPKKSLLLNSGAEAVENAVKISRAYTGRPTVAVLDRSFHGRTNLTSSMTYRGSLYSSDFGPTASNIVSAPNSYPLHDRLSGKEAAARTISYLETRVAARNIACLFYEPIQGEGGVIVPADGFLPALQDWCRENDIVFVADEIQSGFGRTGCFFASETDGLEPDIVCSAKGIANGLPLSAVTGRSDIVDAARPGTLGGTFTGNHVSCAAALEVFEQYKDNAPLDSASRLGDILKELLLNLQSKHPQIAEVRGRGAMFGAEFSGNHAGEMVSRVITRAAELGVIFLSSGVEGNVVRFLPNVFMDKETIEEAIGVLDSAISSVV

SEQ ID NO: 18848 - protein, 287 aa, Tropheryma whipplei TW08/27
MVSQDWLEKDFYAVLDVDSGVSGSQISKAYRKLARRYHPDSNPGSKEAEARFKEISEAYTVLSDPVQREEYDQLRNQKGAFTTGDFGDIFSNLFTGHRSHFAPSGGDIAASVKVSLESIVLGDYVNMQLSSGETLRVKIPSGIGNGERFRVRGKGAPSPYGGPSGDLIVTVNIRPHPVFELDGKDLRMNLPITFVEAFSGAVIEVPTMQKQTVKIKIQPGTLSGMTLRIKGRGVQSAQQPGDLLAVVQIVPPKNTDDVRKIIEQLAAKTAGDNPRRDVLECVRDSDP

SEQ ID NO: 18849 - protein, 428 aa, Tropheryma whipplei TW08/27
MCLIDSVHARQILDSRGTPTVEVEVTLEDGSMGRSAVPSGASTGAFEAHELRDQDNNEYLGKGVTRAVRSVNSEIAPVLIGFDAFDQVGLDHRMIELDGTNNKSRLGANAILGVSLASASAAARAADLSLFRYLGGPSSRILPVPMMNIINGGAHADTGVDIQEFMILPVGARSFSESLRWGCEVYHSLKVQLRESGLSSGLGDEGGFAPALRSNRTALDLILSAIEKAGFSPGIDIVLALDIAASEFCKAPGHYRFEGKDITSDELISYYEGLLSSYPLVSIEDPLDQDDWEGYRTLTTHIGDRVQIVGDDLFVTNTSRLSRGIQSGVANSILVKVNQIGTLTETFDAVDMAAKGGYTAVLSHRSGETEDTTIADMAVATNCGQIKTGAPARGERIAKYNQLLRIEEKLGRSARYAGWLSYPRWQGK

SEQ ID NO: 18850 - protein, 465 aa, Medicago truncatula
MTSEKVETVVAGNYLEMEREEEGSKSTTGKLSKFFWHGGSVYDAWFSCASNQVAQVLLTLPYSFSQLGMLSGILFQIFYGLMGSWTAYIISVLYVEYRTRKEREKVDFRNHVIQWFEVLDGLLGKHWRNLGLFFNCTFLLFGSVIQLIACASNIYYINDHLDKRTWTYIFGACCATTVFIPSFHNYRIWSFLGLVMTTYTAWYMTIASILHGQAEDVKHSGPTKLVLYFTGATNILYTFGGHAVTVEIMHAMWKPQKFKMIYLIATLYVMTLTLPSAAAVYWAFGDNLLTHSNALSLLPRTGFRDTAVILMLIHQFITFGFACTPLYFVWEKFLGVHETKSLLKRALVRLPVVIPIWFLAIIFPFFGPINSTVGSLLVSFTVYIIPALAHMVTFASAPARENAVERPPSFLGGWVGLYSVNVFVAVWVLVVGFGLGGWASMLNFVHQIKTFGLFAKCFQCPPHKA

SEQ ID NO: 18851 - protein, 213 aa, Phaseolus vulgaris
EASRSRTLQDIIREEKPNGDAKDRNSWKAFKEKLRLKRAVGLAWSSATSHSNNNDNDDGNLPQTRLHSDGAATQQNDVVVEDANDSDPIERFGSPAENTAAGGDSSEGENNQEAAVGVSLMDLLEEAEQELDLYRVSDDDAVADFEKREEDEEEKEGLVEYNCNCCVCMVRHKGAAFIPCGHTFCRMCSREIWASRRNCPLCNNLILEILDIF

SEQ ID NO: 18852 - protein, 348 aa, Malus x domestica
MGSESESVCVTGASGFIGSWLVMRLLEHGYTVRATVRDPTNQKKVKHLLDLPKAETHLTLWKADLADEGSFDEAIQGCSGVFHVATPMDFESKDPENEVIKPTINGLLDILKACQKAKTVRKLVFTSSAGTVNVEEHQKPVYDESNWSDVEFCRSVKMTGWMYFVSKTLAEQAAWKYAKENNIDFITIIPTLVIGPFLMPSMPPSLITGLSPILRNESHYGIIKQGQYVHLDDLCLSHIYLYEHPKAEGRYICSSHDATIHELVKMLREKYPEYNIPTKFKGIDDNLEPVHFSSKKLREIGFEFKYSLEDMFVGAVDACRAKGLIPIPIPAEKTEAAEESNLVDVKAG

SEQ ID NO: 18853 - protein, 348 aa, Malus x domestica
MGSESESVCVTGASGFIGSWLVMRLLEHGYTVRATVRDPTNQKKVKHLLDLPKAETHLTLWKADLADEGSFDEAIQGCSGVFHVATPMDFESKDPENEVIKPTINGLLDILKACQKAKTVRKLVFTSSAGTVNVEEHQKPVYDESNWSDVEFCRSVKMTGWMYFVSKTLAEQAAWKYAKENNIDFITIIPTLVIGPFLMPSMPPSLITGLSPILRNESHYGIIKQGQYVHLDDLCLSHIYLYEHPKAEGRYICSSHDATIHELVKMLREKYPEYNIPTKFKGIDDNLEPVHFSSKKLREIGFEFKYSLEDMFVGAVDACRAKGLIPIPIPAEKTEAAEESNLVDVKVG

SEQ ID NO: 18854 - protein, 347 aa, Pyrus communis
MGSESESVCVTGASGFIGSWLVMRLLEHGYTVRATVRDPTNQKKVKHLLDLPKAETHLTLWKADLADEGSFDEAIQGCSGVFHVATPMDFESKDPENEVIKPTINGLLDILKACQKAKTVRKLVFTSSAGTVNVEEHQKPVYDESNWSDVEFCRSVKMTGWMYFVSKTLAEQAAWKYAKENNIDFITIIPTLVIGPFLMPSMPPSLITGLSPILRNESHYGIIKQGQYVHLDDLCLSHIYLYKHPKAEGRYICSSHDATIHELVKMLREKYPEYNIPTKFKGIDDNLEPVHFSSKKLREIGFEFKYSLEDMFVGAVDACRAKGLIPIPAEKTEAAEESNLVDVKVGG

SEQ ID NO: 18855 - protein, 347 aa, Pyrus communis
MGSESESVCVTGASGFIGSWLVMRLLEHGYTVRATVRDPTNQKKVKHLLDLPKAETHLTLWKADLADEGSFDEAIQGCSGVFHVATPMDFESRDPENEVIKPTINGLLDILKACQKAKTVRKLVFTSSAGTVNVEEHQKPVYDESNWSDVEFCRSVKMTGWMYFVSKTLAEQAAWKYAKENNIDFITIIPTLVIGPFLMPSMPPSLITGLSPILRNESHYGIIKQGQYVHLDDLCLSHIYLYKHPKAEGRYICSSHDATIHELVKMLREKYPEYNIPTKFKGIDDNLEPVHFSSKKLREIGFEFKYSLEDMFVGAVDACRAKGLIPIPAEKTEAAEESNLVDVKVGS

SEQ ID NO: 18856 - protein, 504 aa, Schizosaccharomyces pombe
MSILAGFKNLLKHSKSSKGRSNASKSVDVSVNRDVAAYTELAAKNVNAGGDEEIRVANYPGLEKYQLIENLGDGAFSQVYKAYSIDRKEHVAVKVIRKYEMNKKQRQGVFKEVNIMRRVKHKNVVNLFDFVETEDFYHLVMELAEGGELFHQIVNFTYFSENLARHIIIQVAEAVKHLHDVCGIVHRDIKPENLLFQPIEYLPSQNYTPPSLEPNKLDEGMFLEGIGAGGIGRILIADFGFSKVVWNSKTATPCGTVGYAAPEIVNDELYSKNVDMWAMGCVLHTMLCGFPPFFDENIKDLASKVVNGEFEFLSPWWDDISDSAKDLITHLLTVDPRERYDIHQFFQHPWIKGESKMPENFTYKPKLHGTPGGPKLSLPRSLVSKGEIDIPTTPIKSATHPLLSSYSEPKTPGVSSVHEAMGVAYDIRRLNHLGFSPEQLSKKSMNTGSIKELILDEETTTDDDDYIISSFPLNDTLGSEGKDPFSLNLKESSLYSRRSAKRVN

SEQ ID NO: 18857 - protein, 398 aa, Schizosaccharomyces pombe
MTHTPSFDLSDIKSTLSTNVLHADDAYALENDVAPPIHISTTYTYPGTPDTLQPFTKLAEEDFPYYARISGNNVDRAEASLSSVLGAPSVVYSSGLAAIYGLLSYLNPKHIAVHKPGFGGYSGTIQIIARINRLTGLETSFIDGKCDAIGEGDVIWLETPLNPLGIAFDIPFYKELAKKKGAILVVDSTFAPPPIQDALVLGADYVVHSATKYLAGHSDVLAGVTASKDRSKILDLKADRAYLGTILHPQQAFLLLRSLRTFPLRIAKHSENGFLVAQHLNKLATDEQFATSLGIDSSLILEVYHNSLQTKEFVAKNLTGGHASCFSVLLKSDTVAKHLCCELKYFHHATSLGSVESLIEWRRMTDSKIDPRLVRLSIGIEDAADLIADLNRVFASLS

SEQ ID NO: 18858 - protein, 413 aa, Schizosaccharomyces pombe
MFTYQKIIQLALLLSGVCGALASIDTDSHLSPKVLEKLRPTENLAYEDDSLDDDTWRSKRWEFDYQYSGISTFAHLPHVRCLVEQSEDFDIAIIGVPFDTAVSHRPGARFGPKGIRSASSRQMAIRGFNPSLNVNPYESWAKILDCGDIPVSSYDNQLAVRQMTEGYIDLLSRKATASPASNNLKTAGLAKDGIFHPRLITLGGDHSIGLASLRALGHFYGNVSVIHFDSHLDTWNPKRYYPSYWHSDRADFTHGTMFWMASKEGLINNGTSIHAGLRTRLSGTDYYDYEEDNRVGFTFIEAQEIDEIGVNGIVERIKQVVGDTLVYLSIDIDVVDPGLAPGTGTPETGGWTTREMKSILRKLDGHLNLVGAEVVEVSPPYDDRAESTSLAASDFIFEILSSMVKHPLYDVKK

SEQ ID NO: 18859 - protein, 497 aa, Arabidopsis thaliana
MEMILMVSLCLTTLITLFLLKQFLKRTANKVNLPPSPWRLPLIGNLHQLSLHPHRSLHSLSLRYGPLMLLHFGRVPILVVSSGEAAQEVLKTHDLKFANRPRSKAVHGLMNGGRDVVFGPYGEYWRQMKSVCILNLLTNKMVASFEKIREEELNEMIKKLEKASSSSSSENLSELFVTLPSDVTSRIALGRKHSEDETARDLKKRVRQIMELLGEFPIGDYVPALAWIDRINGFNARIKEVSQGFSDLMDKVVQEHLEAGNHKEDFVDILLSIESEKSIGFQAQRDDIKFMILDMFIGGTSTSSTLLEWIMTELIRNPNVMKKLQDEIRSTIRPHGSYIKEKDVENMKYLKAVIKEVFRVHPPLPLILPRLLSEDVKVKGYNIAAGTEVIINAWAIQRDPAIWGPDAEEFKPERHLDSTLDYHGKDLNFIPFGSGRRICPGINLALGLVEVTVANLVGRFDWRAEAGPNGDQPDLTEAFGLDVCRKFPLIAFPSSVI

SEQ ID NO: 18860 - protein, 497 aa, Arabidopsis thaliana
MEMILSISLCLTTLITLLLLRRFLKRTATKVNLPPSPWRLPVIGNLHQLSLHPHRSLRSLSLRYGPLMLLHFGRVPILVVSSGEAAQEVLKTHDHKFANRPRSKAVHGLMNGGRDVVFAPYGEYWRQMKSVCILNLLTNKMVESFEKVREDEVNAMIEKLEKASSSSSSENLSELFITLPSDVTSRVALGRKHSEDETARDLKKRVRQIMELLGEFPIGEYVPILAWIDGIRGFNNKIKEVSRGFSDLMDKVVQEHLEASNDKADFVDILLSIEKDKNSGFQVQRNDIKFMILDMFIGGTSTTSTLLEWTMTELIRSPKSMKKLQDEIRSTIRPHGSYIKEKEVENMKYLKAVIKEVLRLHPSLPMILPRLLSEDVKVKGYNIAAGTEVIINAWAIQRDTAIWGPDAEEFKPERHLDSGLDYHGKNLNYIPFGSGRRICPGINLALGLAEVTVANLVGRFDWRVEAGPNGDQPDLTEAIGIDVCRKFPLIAFPSSVV

SEQ ID NO: 18861 - protein, 241 aa, Raphanus sativus
SWIIKLLLERGYTVKGTVRNPDDPKNTHLRELEGAKERLILCKADLQDYDALKEAIDGCDGVFHTASPVTDDPEEMVEPAVNGAKFVINAAAETKVKRVVITSSIGAVYMDPNRDPEAVVDESCWSDLEFCKNTKNWYCYGKMVAEQAAWETAEEKGVDLVVLNPVLVLGPPLQPTINASLFHVLKYLTGSAKTYANLTQAYVDVRDVALAHVLVYEAPSASGRYLLAESALHRGEVVEIL

SEQ ID NO: 18862 - protein, 439 aa, Aster tripolium
MKILLGVGINGGLFGSCVSSRSKVDSSTSGISSHFEIKSTNNVSKDQPTTSNSEHNLPTLTPEDELKVASRLRKFGFNDLKMATRNFRPESLLGEGGFGCVFKGWIEENGTAPVKPGTGLTVAVKTLNHDGLQGHKEWLAEVNFLGDLGNPNLVKLIGYCIEDDQRLLVYEFLPRGSLENHLFRRSLPLPWSIRMKIALGAAKGLAFLHEEAKRPVIYRDFKTSNILLDAEYNAKLSDFGLAKDGPEGDKTHISTRVMGTYGYAAPEYVMTGHLSSKSDVYSFGVVLLEMLTGRRSMDKKRPNGEHNLVEWARPHLGERRRFYRLIDPRLEGHFSIKGAQKAAQLASRCLSRDPKARPLMSEVVDCLKPLPALKDMAGPSYYLQTVQPERAGSSPDPNRTRVGSFSRNGSQHPRTLSIPNASPRHNQFLQDSPNPNGKQ

SEQ ID NO: 18863 - protein, 297 aa, Aster tripolium
MLPYSSLQEAEAAMGRSLTFAETLWFNYSANKSDYVLYCHNIPLIFFLTTFLPIVYVVIEFLFPDYAASYKIQPKIKVSLYENFKVYLGVMRTFFLLVAPILLASHPSVQMIGIRTSLPLPSLLEIASQLLVYFLIEDYTNYWIHRFFHCKWMYNNIHVVHHEYTAPTGFATQHAHWFRYWCLGIPSFLGPSIAPGHMVTFLLWLALRQFEAIENHSGYDFPWTYKKFIPFSAGAEYHDYHHYVGEKSQSNFWHPIFTYCDYLYGTDKGYRNRKKLLAQQERWSKSEGKRAKGEHMR

SEQ ID NO: 18864 - protein, 155 aa, Aster tripolium
MGSGGGYEKGKHGGIQNPLRSTDHEMGNKGTNIHSTTGGHGIGSTGTTMGSGGGQGYEEGKHGATGGILHRSGSGSSSSSEDDGEGGRRKKKGVIGKIKEKLPGGQQGSDEQSRLQAPATHVGAGGGGHGYQGEEVPEMMGLMNKIKDKLPGGNH

SEQ ID NO: 18865 - protein, 299 aa, Chlamydomonas reinhardtii
EEVAIKLESVKTRHAQLLYESKLYKILQGGVGIPNVRWYGVEGDYNVMVIDLLGPSLEDLFNFCNRKFSLKTVLMLADQLLSRVEFVHSRSFIHRDIKPDNFLMGLGKKANQVHIIDFGLAKKYRDPKTHIHIPYRENKNLTGTARYASINTHLGIEQSRRDDMESLGYVMMYFLRGSLPWQGLKATTKRQKYEKISEKKMSTPIEVLCKGYPMEFVTYFQYCRSLRFDDKPDYSYLRKMFRDLFAREGYQWDYVFDWTILKHQQSGTVPRPAVPRVPEPAAGEGEEAADPAYGGRFDF

SEQ ID NO: 18866 - protein, 196 aa, Burkholderia multivorans
IHFDVMDNHYVPNLTIGPLVCEAIRPHVQVPIDVHLMVRPVDRIVPDFAKAGANLISFHPEGSDHIDRTLTLIRDHGCKAGLVFNPATPLNYLDHVMDRLDYVLLMSVNPGFGGQSFIPETLNKLREARARIDAYTERTGREILLEVDGGVKADNIAEIAAAGADTFVAGSAIFGKPDYRKVIDEMRAALAAVERS

SEQ ID NO: 18867 - protein, 120 aa, Neurospora crassa
MTIPQLDGLQIEVQQEGQGTRETRRGDNVDVHYKGVLTSGKKFDASYDRGEPLNFTVGQGQVIKGWDEGLLGMKIGEKRKLTIAPHLAYGNRAVGGIIPANSTLIFETELVGIKGVQKGE

SEQ ID NO: 18868 - protein, 415 aa, Arabidopsis thaliana
MNSLILGAARRFVGLHLRVSVNLLQNESFSSYSFSSASAADVSPKGETFKSSSFLDSLRLATKLTDKGNSDSVLDLLRSYGFTDSQISSIIRSDSRVLIDNDATSLGSKLQFLQSRGASSSELTEVVSTVPKILGKREGKSLSRYYDFIKVIIEADKSSKYEKISHSLAQGNKIRNILVLRELGVPQKRLLLLLISKSQPVCGKEKFDASLKKVVEMGFDPTTSTFVHALHMLYQMSDKTIEEKIRVYRSVGFSVDDVWAMFKKWPRSLTHSEKKVANSIETFLGLGFSRDVFMMMFKRFPPCIGYSTEAVKKKTEFLVKEMNWPVKAVASIPQVLGYSLEKRTVPRCNVIKVLMSKGLLESELPPMSSVLTSTSESFLNLYVSKHDDKQLVAELMAIFTGNRVSLTDQKARLEQ

SEQ ID NO: 18869 - protein, 410 aa, Zea mays
MACTDNAMRALFLLVLFCIVHGEKEESKGIDAKASGPGGSFDITKLGASGNGKTDSTKAVQEAWASACGGTGKQTILIPKGDFLVGQLNFTGPCKGDVTIQVDGNLLATTDLSQYKEHGNWIEILRVDNLVITGKGNLDGQGPAVWSKNSCTKKYDCKILPNSLVMDFVNNGEVSGVTLLNSKFFHMNMYQCKNMLIKDVTVTAPGDSPNTDGIHMGDSSGITITNTVIGVGDDCISIGPGTSKVNITGVTCGPGHGISIGSLGRYKDEKDVTDINVKDCTLKKTMFGVRIKAYEDAASVLTVSKIHYENIKMEDSANPIFIDMKYCPNKLCTANGASKVTVKDVTFKNITGTSSTPEAISLLCTAKVPCTGATMDDVNVEYSGTNNKTMAICTNAKGSTKGCLKELACF

SEQ ID NO: 18870 - protein, 410 aa, Zea mays
MACIDNAMRALFLLALFCVVHGEKAKSKDNDAKASGPGGSFDITKLGASGNGKTDSTKAVQEAWASACGGTGKQTILIPKGDFLVGPLNFTGPCKGDVTIQVNGNLLATTDLSQYKDHGNWIEILRVDNLVITGKGKLDGQGPAVWSKNSCVKKYDCKILPNSLVMDFVNNGEVSGITLLNSKFFHMNMYKCKDMLIKDVNVTAPGDSPNTDGIHMGDSSGVTITNTVIGVGDDCISIGPGTSKVNITGVTCGPGHGISIGSLGRYKDEKDVTDINVKDCTLKKTANGVRIKAYEDAASVLTASKIHYENIKMEDSGYPIIIDMKYCPNKLCTANGASKVTVKDVTFKNITGTSSTPEAVNLLCTAKIPCTGVTMDDVNIKYSGTNNKTMAVCKNAKGSAKGCLKELACF

SEQ ID NO: 18871 - protein, 111 aa, Clavispora lusitaniae
EDTWHYWFHRGLHHGVFYKYIHKQHHRYAAPFGLTAEYAHPVEVALLGMGTVGIPLVWCYFTRDLHLFTISLWICLRLFQAVDAHSGYEFPWSLHHFLPFWAGADHHHEDH

SEQ ID NO: 18872 - protein, 454 aa, Musa acuminata
MTAGLRWIPPLLLLLMGFLLVLNGGRGWIGSERSSGSRNGGASRRSLREASANATSADASLEDRAVTRAAEAAVDDPEEVASTVLTTIINSTARRSLGYLSCGSGNPIDDCWRCDPDWHVNRKKLADCGIGFGRNAIGGRDGELYVVTDSGDDDPVNPRPGTLRYAVIQDVPLWITFKHDMEITLKEELIMNSFKTIDGRGVNVHIANGACITIQYITNVIIHGLHIHDCKPTGNAMVRSSPSHYGWRTMADGDAVSIFGSSHIWVDHCSLSNCADGLVDAVMGSTAITVSNNYFTHHNEVMLLGHTDSYARDSIMQVTIAFNHFGEGLIQRMPRCRHGYFHVVNNDYTHWEMYAIGGSANPTINSQGNPIPCADQSICKGGNKKGGHRSNTWKNWNWRSEGDLLLNGAFFTPSGAGASASYARASSFGAKPSSLVDTLTSDAGVLSCQVGTRC

SEQ ID NO: 18873 - protein, 290 aa, Nicotiana tabacum
ELFDRIIAKGHYTERAAASMCRAIVNVVHVCHFMGVIHRDLKPENFLLTDKSENAALKATDFGLSMFIQEGKVYKDIVGSAYYVAPEVLRKSYGKEIDVWSAGVMLYILLSGVPPFWAETERGIFDAILKEDIDFESQPWPSITSSAKDLVRKMLTKDPKKRISAAQVLEHPWLKVGGVASDKPLDNAVLSRMKQFRAMNKLKKLALKVIAENMSAEEIQGLKSMFHNIDTDNSGTITYEELKSGLARLGSKLTEAEVKQLMEAADVDGNGSIDYIEFITATMHKHTEFL

SEQ ID NO: 18874 - protein, 200 aa, Simmondsia chinensis
MATIGHNNLNAKLVLLGDMGAGKSSLLLLFVKGHFLEFQESTIGAAFFSHTLAVNDATVKFEIWDTAGQERYHILAPMYYRGAAAAIIVYDITSADSFALAKKWVQELQKQGNPNMVMALAGNKADLEDRRSVPAEEARIYAEDNGLFFMETSAKTALNVNEIFYEIAKRLPRAQPPQNPAGMVLVDRPPEGSRASTCCS

SEQ ID NO: 18875 - protein, 433 aa, Streptococcus sobrinus
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAAARAAADYLEIPLYSYLGGFNTKVLPTPMMNIVNGGSHSDAPIAFQEFMIMPVGAPTFKEGLRWGAEVFHALKKILKERGLETAVGDEGGFAPRFDGIEDGVETILKAIETAGYEAGEKGIMLGFDCASSEFYEDGVYDYTKFEGEKGAKRSAAEQIDYIEGLVNKYPIITIEDAMDENDWEGWKALTERLGNRVQLVGDDFFVTNTDYLARGIKEGAANSILIKVNQIGTLTETFEAIEMAKEAGYTAVVSHRSGETEDSTIADIAVATNAGQIKTGSLSRTDRMAKYNQLLRIEDQLGEVAQYKGINSFYNLKK

SEQ ID NO: 18876 - protein, 182 aa, Spirodela punctata
MGNCFSQSTQTRGSKRNQKPDPLDEPSTRQAQNGGSANAPPQKPPGAVTGVLRQPPAKGSAAVGPVLGRRMEDVRQTYAIGKELGRGQFGVTHLCTDRVTGKQFACKTIAKRKLVNKEDIEDVRREVQIMHHLTGQQNIVELVGAYEDKQSVHLVMELCAGGELFDRIIAKGHYTERAAASL

SEQ ID NO: 18877 - protein, 497 aa, Pseudomonas syringae pv. tomato str. DC3000
MTTLTRADWEQRAQNLKIEGRAFIQGEYTAAASGETFDCISPVDGRLLAKVASCDAADAQRAVESARSAFDSGAWSRLAPAKRKATMIRFAGLLEQNAEELALLETLDMGKPISDSLGVDIPGGARALSWSGEAIDKLYDEVAATPHDQLGLVTREPVGVVAAIVPWNFPLMMACWKLGPALSTGNSVVLKPSEKSPLTAIRIAQLAIEAGIPAGVLNVLPGYGHTVGKALALHMDVDTVVFTGSTKIAKQLMIYAGESNMKRVWLEAGGKSPNIVFADAPDLQAAADSAASAIAFNQGEVCTAGSRLLVERSIKDRFLPMVIEALGTWKPGNPLDPATNVGALVDTQQMNTVLSYIAAGHTDGARLVAGGKQILQETGGTYVEPTIFDGVNNAMRIAQEEIFGPVLSVLTFDTAEEAIQIANDTPYGLAAAVWTANLSKAHLTARALRAGSVWVNQYDGGDMTAPFGGFKQSGNGRDKSLHAFDKYTELKSTWIKL

SEQ ID NO: 18878 - protein, 460 aa, Pseudomonas syringae pv. tomato str. DC3000
MQPPAFKELWIILRLAGPLIASQMAHMLMVFTDTVMMGKIGPEALAGGGLGAATYSFISFFCVGVMAAVGTLVSIRHGAGDSEGVTRLTQAGLWLAWGMALIAALLLWNLEPILLQLGQAEANVHMAAQFLITLPFALPGLLSFMALRGFTSALGRAGPVMTISVAGAVANFVLNYAMINQWLGLPNLGLMGIGLVTAMVTNCMALALAWHIKRHPAYAAYPISKGLSKLSRSHLKELWRLGLPIGGTYAVEVGLFTFAAFCMGAMGSTQMAAHQIALQTVSMAFMIPVGISYAVTMRIGQHYGAGNILMARTAGRLGIGFGGSVMLLFGIFFWLAPHWVIGLFLDLDDPAFAEIVVLAAKLLAIAAWFEFFDGTQTIAMGAIRGLKDARTTFLIGLGCYWLIAAPAAWLLGFYADGGASGVWWGLALGLFCSAVALTYAFEWKTARLLRKEAVGAAVPG

SEQ ID NO: 18879 - protein, 270 aa, Pseudomonas syringae pv. tomato str. DC3000
MSRLEQRFAQLKTEGRAVLVTFITAGDPGYDTSLKVLKGLPAAGADVIELGMPFTDPMADGVAIQLATLRALDAGQTLLKTLQMVSEFRVDDQTTPIVLMGYYNPIHRFGVEAFVAQAKEAGVDGLIIVDLPPEHDAELATPAQASGIDFIRLTTPTTDDARLPRVLERSSGFVYYVSVAGVTGAGSATTEHVTEAIARLRRHTSLPISVGFGIRTPEQAAAIARLADGVVVGSAFVDKIATAESPEQAIDGVLTLCAALAEGVRNARVS

SEQ ID NO: 18880 - protein, 372 aa, Pseudomonas syringae pv. tomato str. DC3000
MSFAKKNVIDGISKTPLIDLARINKEISTNVIVKLEKYNPGGSIKDRAAAYIIREAEKKGQLKPGGTIIESSSGNFAISLAMIGAVSGYKVIALVDPKATETNKALMKAYGAEVITVTEKDDTGSYHKTRIKLANDLAKKIPGSYRPDQCFNVLSSLAHYNSTAKEIHEQTSGNIAGVVCAVSTGGQIGGVSEYFKDHLPDVKVTCVDAYGSAVFGGPSHAYKIPGVGLGWTPRNINDTTKIDYFYRAKDESAYIAARLLCRHEGILVGVSSGAVLLAALNLSLHLGNQKPIVAILGDSGERYLDTLYNDDWLNEHGVDTGLELNKLQLLIDNMATPIESPHIKSNYRDDLIGILEVPETTITHFNMLEGRN

SEQ ID NO: 18881 - protein, 485 aa, Pseudomonas syringae pv. tomato str. DC3000
MLKNQLKDPSLLVDRAYVDGQWISADDGATLAISDPATGEVIAQVPALQGAETRRAIEAADRAWPAWRARPAAERAALLERWHQAMLDNVEDLALIMTLEQGKPLNESRGEIRYGASFVKWFAEEARRSYGETIPTPSADRRLMTLKQPVGVCAAITPWNFPNAMITRKCAPALAAGCTIIVKPSDLTPLSALALAVLAERAGIPVGVFSVVTGMPTAIGEELTGNPVVRKISFTGSTPIGRLLMRQSAEHIKRLSLELGGNAPFIVFDDADLEQAVAGIMLSKFRNAGQTCVCANRILVQSGIYDRFAARLVEEVAKLKVGNGLEEGVTIGPLINPAAVSKIARHIDDALSQGAKLLYGGLPNGDGQFVQPTVLGDTHAGMLLANEETFGPVAPLMRFTDEAEALALANATPYGLAAYYFTQDLRRSWRFGEALEFGMVGLNTGIISMEIAPFGGIKQSGLGREGSSYGLDEYLEVKAFHVGGL

SEQ ID NO: 18882 - protein, 434 aa, Pseudomonas syringae pv. tomato str. DC3000
MNSKVDETPHLLRQRDQFVPRGIVTAHPLVIDRAQGSELWDVDGKRYLDFVGGIGVLNIGHNHPNVVKAIQAQLSKVTHACFQVASYQPYLDLAKRLSLMIAGQSGIDHKAVFFTSGAEAVENAVKIARARTNRPAIISFRGGFHGRTLLGTTLTGMSQPYKQNFGPMAPEVFHTPYPNEYRGVTTEVALAALHELLATQVAPDRVAAILIEPIQGDGGFLTAPVEFLKALRALTEQHGIVLILDEIQTGFGRTGKWFGFEHAGIQPDLVTVAKSLAGGMPLSGVVGRAEIMDAPLPGGLGGTYGGNALSCAAALAVIDTYEQDNLLARGEQLGEHLRAGLLRLKDRYACIGDVRGTGFMLAMELTKNDAARSPDADLNQKVIDQARIGGLLVIKCGVYRNVLRFLAPLVTTEQQIDEALSILDAALARVLKSS

SEQ ID NO: 18883 - protein, 480 aa, Pseudomonas syringae pv. tomato str. DC3000
MQLKDSTLFRQQAYINGQWLDADGGQSIKVNNPATNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGSELTGNPIVRKLSFTGSTEIGRQLMAECAKDIKKVSLELGGNAPFIVFDDADLDKAVEGAMISKYRNNGQTCVCANRIYVQDGVYDAFAEKLKVAVGKLKIGNGLEDGITTGPLIDEKAVAKVKEHIADAVSKGATVLTGGNSLEGSFFEPTILVNVSKDAAVAREETFGPLAPLFRFKDEAEAIALANDTEFGLASYFYAQNMSRVFRVAEALEYGMVGINTGLISNELAPFGGIKSSGLGREGSKYGIEDYLEIKYLCLSV

SEQ ID NO: 18884 - protein, 426 aa, Pseudomonas syringae pv. tomato str. DC3000
MSQTNESLMQRRHAAVPRGVGQIHPIFAASAKNATVTDVEGREFIDFAGGIAVLNTGHLHPKIVAAVQEQLTKLTHTCFQVLAYEPYVELCEKINAKVPGDFDKKTLLVTTGSEAVENAVKIARAATGRAGVIAFTGAYHGRTMMTLGLTGKVVPYSAGMGLMPGGIFRALYPCELHGVSVDDSIASIERIFKNDAEPRDIAAIIIEPVQGEGGFYVAPKAFMLRLRELCDKHGILLIADEVQTGAGRTGTFFAMEQMGVAADLTTFAKSIAGGFPLAGVCGKAEYMDAIAPGGLGGTYAGSPVACAAALAVLDIFEEEHLLERCKTVGERLVTALKGMQAKYPVIGEVRALGAMIAVELFEDGDSHKPNAAAVAQVVAKARDKGLILLSCGTYGNVLRVLVPLTAEEELLTRGLAILDECFAEIA

SEQ ID NO: 18885 - protein, 326 aa, Pseudomonas syringae pv. tomato str. DC3000
MSIEVRNVSKNFNAFKALNNISLDIQSGELVALLGPSGCGKTTLLRIIAGLETPDDGSIVFHGEDVSGHDVRDRNVGFVFQHYALFRHMTVFDNVAFGLRMKPKSERPNETRIAEKVHELLNMVQLDWLADRYPEQLSGGQRQRIALARALAVEPKVLLLDEPFGALDAKVRKELRRWLARLHEDINLTSVFVTHDQEEAMEVADRIVVMNKGVIEQIGSPGEVYENPSNDFVYHFLGDSNRLSLGDEGHVLFRPHEVSLSRQEIEDHHAAEVRDIRPLGATTRVTLKVEGQNELIEAEVVKDHDSLVGLAKGETLFFKPKVWQKL

SEQ ID NO: 18886 - protein, 387 aa, Pseudomonas syringae pv. tomato str. DC3000
MTVLKMTDLDLQGKRVLIREDLNVPIKDGVVSSDARILASLPTIRLALEKGAAVMVCSHLGRPTEGEFSAENSLKPVAEYLSKALGRDVPLVADYLDGVDVKAGDIVLFENVRFNKGEKKNADELAQKYAALCDVFVMDAFGTAHRAEGSTHGVAKYAKVAAAGPLLAAELEALGKALGAPAQPMAAIVAGSKVSTKLDVLNSLSAICDQLIVGGGIANTFLAAAGHKVGKSLYEPDLLDTARAIAAKVSVPLPTDVVVAKEFAESATATVKLIADVADDDMILDIGPQTAAHFAELLKSSGTILWNGPVGVFEFDQFGEGTKTLAKAIAESKAFSIAGGGDTLAAIDKYGVADQISYISTGGGAFLEFVEGKVLPAVEMLEQRARA

SEQ ID NO: 18887 - protein, 475 aa, Pseudomonas syringae pv. tomato str. DC3000
MLAETMPQHTDPSIEAMHRAFALQRAAFRANPMPSAAQRLQWLKSLGEVLSLHRQDLIDAIGADFGQRSADETLLAELLPSLLGIADARKHVKRWMKPSRRRVGLMFQPASAKVVYQPLGVIGVIVPWNYPLFLAIGPLIGALAAGNRVMLKLSESTPATGALLKRLLANVFPEDLVAVVLGEAETGMAFSRLPFDHLLFTGASSIGKHVMRAAAENLTPVTLELGGKSPAIVSQDVPLQDAAERIAFGKTLNAGQTCIAPDYVLVPKDRLTGFVDAYTAAVKRFYPTLIDNPDYTAIINQRQLLRLNHCLEDAENKGATIITLYEQGQDRRMPFSVLLDVSDDMLVMQDEIFGPLLPVVPYHRIEDAYAYINQRPRPLALYYFGYDKAEQRQVLERTHSGGVSINDTLMHAAQDDLPFGGVGPSGMGNYHGREGFLTFSQAKAVFTKQRLNTARLIYPPYGKAIQRLVYKLFMR

SEQ ID NO: 18888 - protein, 490 aa, Pseudomonas syringae pv. tomato str. DC3000
MARFELQKLYIDGGYVDASNTETFDSINPANGEVLAKIQRASKEDVERAVVAAEKGQKIWAAMTAVERSRILRRAVDILRERNDELAALETLDTGKAISETRYVDIVTGADVLEYYAGLVPAIEGEQIPLRDSSFVYTRREPLGVVAGIGAWNYPIQIALWKSAPALAAGNAMIFKPSEVTSLTTLKLAEIYTEAGVPNGVFNVLTGSGREVGTWITEHPRIEKVSFTGGTDTGKKVMASASSSSLKEVTMELGGKSPLIVFDDADLDRAADIAMMANFYSSGQVCTNGTRVFVPNALKGEFEAKILERVKRIRPGNPEDENINFGPLVSFEHMESVLGYIAKGKEQGARLLCGGDRLTGGVFDKGAFVAATVFTDCTDEMTIVREEIFGPVMSILGYDTEDEVVRRANDTDFGLAAGIVTRDLNRAHRVIHLLEAGICWINAWGESAAQMPVGGYKQSGVGRENGISSLAQYTRIKSVQIELGDYASVF

SEQ ID NO: 18889 - protein, 374 aa, Pseudomonas syringae pv. tomato str. DC3000
MSDVDTSAGASDVLVSFRGVQKSYDGEALIVKDLNLDIRKGEFLTLLGPSGSGKTTSLMMLAGFETPTAGEILLGGRAINNVPPHKRDIGMVFQNYALFPHMTVAENLAFPLSVRGMSKTDVGEKVKKALGMVQLDTFAHRYPAQLSGGQQQRVALARALVFEPQLVLMDEPLGALDKQLREHMQMEIKHLHQRLGVTVVYVTHDQGEALTMSDRVAVFHQGEIQQIAPPRSLYEEPKNTFVANFIGENNRLNGRLVSQDGDRCVVELERGEKVHALAINVGRPGGPVTLSIRPERINLNGRSESCVNRFSGRVAEFIYLGDHVRVRLEVAGKTDFFVKQPIAELDPTLSVGDVVPIGWQVEHVRALDPLQQEH

SEQ ID NO: 18890 - protein, 224 aa, Pseudomonas syringae pv. tomato str. DC3000
MQPFVIAPSILSADFARLGEEVDNVLSSGADFVHFDVMDNHYVPNLTIGPMVCSALRKYGVTAPIDVHLMVSPVDRIIGDFIEAGATYITFHPEATQHIDRSLQLIREGGCKAGLVFNPATPLNLLEYVMDKVDMILLMSVNPGFGGQKFIPGTLNKLREARALIDASGRDIRLEIDGGVNVNNIREIAAAGADTFVAGSAIFNAPDYREVIEKMRAELALSRA

SEQ ID NO: 18891 - protein, 368 aa, Pseudomonas syringae pv. tomato str. DC3000
MNALAPITCAPQIVTKGLHKTYGTGHILHGLDLTFKAGERNVILGPSGCGKSTLLRMVAGLEDVSQGQILMGGRDVTRLPPKERGCAMVFQNYALYPHMSVADNIGYALKLAGVSRKQREQRVRECASSLGLEDLLQRKPGELSGGQRQRVAIGRALIRKPPVLLFDEPLCNLDSALRHEMRLLIRSLHQQTGATILYVTHDQTEAMTLAERVVILNQGRVEQIGTPADIYDQPASTFVARFIGTPPMNLLPVTCLEDNVLMLADGQRLPIKLGIGAIRTGKWLMGVRPETFTLDQNGVTAVVESSENLGSHSLLYCKLAGTRCVVSLADRHHLTPGTQVRLAINPTPLLFDMESGQRLLVSFSHTAK

SEQ ID NO: 18892 - protein, 388 aa, Pseudomonas syringae pv. tomato str. DC3000
MPHSKDPRAHTALSQRGRSASSGPGLAVNPPVVRLSTVVFDSLESLREAEVRTAGPERSLTYGANGNPTAFALQDLISELEGAHGTCLYPTGLAAVAQMFQSFLRPGDHVLLTESVYGPVRRLANTMLKAFDIQFDFYAADGSDVESMIKTNTRMIYAEVPGSLTFEMCDLPALAQLCKAKSMLLAVDNSWGSGVLYKPLELGADISLMALTKYMAGHSDVMMGSVSTTQTHWQTLKTMNTAVGNTVSPDDAYLVLRGARSLAARMAMHERHAMQVAQWLQDQPEVARVLYPALPSDPGHALWKRDFHGCNGLLSFEFKTADRQVLDRFTGALTLFGIGYSWGGFESLVTEIEQHGPDRGMGPMLRLQVGLESPDDLIADLQNGFAAG

SEQ ID NO: 18893 - protein, 506 aa, Pseudomonas syringae pv. tomato str. DC3000
MRYAHPGTEGAIVNFKERYGNYIGGEFVAPVKGQYFTNTSPVNGKPIAEFPRSTAEDIDKALDAAHAAAAAWGSTSVQARSLVLLKIADRIEANLEVLAITETWDNGKAIRETLNADIPLAADHFRYFAGVLRAQEGSAAEIDGNTVAYHIHEPLGVVGQIIPWNFPILMAAWKLAPALAAGNCIVLKPAEQTPLGISVLIELIGDLLPAGVLNIVQGYGREAGEALASSKRIAKIAFTGSTPVGSHIMKLAADNIIPSTVELGGKSPNIFFEDIMSAEPEFIDKAAEGLVLAFFNQGEVCTCPSRALVQESIYPQFMEAVLRKVEKIKRGDPLDTDTMVGAQASEQQFDKILSYLEIAKGEGAELLTGGKVEKLEGDLSTGYYIQPTLLKGNNKMRVFQEEIFGPVVSVTTFKDEAQAVAIANDTEFGLGAGLWTRDINRAYRVGRAIKAGRVWTNCYHLYPAHAAFGGYKKSGVGRETHKIALEHYQQTKNLLVSYDTNPLGFF

SEQ ID NO: 18894 - protein, 321 aa, Pseudomonas syringae pv. tomato str. DC3000
MDQLPIIDISPLYGTDTQAWQAVATQIDSACREWGFFYIKGHPITAERIEQVQSAAKDFFARDAAEKLRIDITQSTHHRGYGAIATEQLDPGLPSDLKETFDMGLHLDTNHPDVLAGKPLRGPNRHPAIPGWKDLMEQHYLDMQALAQTLLRAMTLALGIERDFFDQRFQDPVSVLRMIHYPPRHTATSSEQQGAGAHTDYGCITLLYQDTAGGLQVRDVRGEWIDAPPIDGTFVVNLGDMMARWSNDRYLSTPHRVVSPLGVDRYSMPFFAEPHPDTRIECLPGCQSETHPARYPVTTCAEFLLSRFADTYAYRREQEAS

SEQ ID NO: 18895 - protein, 296 aa, Pseudomonas syringae pv. tomato str. DC3000
MNIAFIGLGNMGAPMARNLINAGHSLHVFDLNKDVLSEFAGLGAKVSDSPRQAAEGSGLVITMLPAAAHVRSVYLNDDGVLKGIAPGVPAVDCSTIDPQTIRDIAAIAAQQGVVLGDAPVSGGTGGAQAGTLTFMVGGSAQHFAALKPVLEIMGRNIVHCGEVGTGQIAKICNNMLLAISMIGVSESMALGSALGIDTEVLASIINTSTGRCWSSEAYNPWPGIVETAPASRGYSGGFGAELMLKDLGLATEAARVAHQPVILGAIAQQLYQAMSLRGDGGKDFSAIIEGYRKKAL

SEQ ID NO: 18896 - protein, 162 aa, Pseudomonas syringae pv. tomato str. DC3000
MSAFHDIRLKALGGQELPLADFKNKVVLVVNVASKCGLTPQYAALENLYQQYRDKGLVILGLPCNQFAGQEPGTEQEIAEFCQLNYGVTFPLGEKLDVNGPNRHSLYRLLAGEGAEFPGDITWNFEKFLVGKNGGVSARFSPRTAPDDPAVIQAIEKALAHN

SEQ ID NO: 18897 - protein, 367 aa, Pseudomonas syringae pv. tomato str. DC3000
MSAAALFTPFRLGGLELSSRVVMAPMTRSFSPGHVPNSKVIEYYRRRAAAGVGLIITEGTTVNHPASNGYPNVPQFFGDAPLAGWKKVVDAVHAEGGKIAPQLWHVGAVRRLGTEPDGSIPAYGPMEKVKDGQVLVHGMSKQDIDEVVAAFAQAAADAKAIGMDGVEIHGAHGYLVDQFFWEGSNQRSDEYGGSLANRSRFAIELIKAVRAAVGPDYPIIFRFSQWKQQDYSARLVQTPEALGEFVQPLSDAGVDIFHCSTRRFWEPEFEGSELNLAGWTRKLTGKPTITVGSVGLDGEFLQFMVNTEKVAQPASLENLLERLGKDEFDLVAVGRALLVDPDWAVKVREGREQDILPFSREALTTLV

SEQ ID NO: 18898 - protein, 483 aa, Pseudomonas syringae pv. tomato str. DC3000
MIPVILSGGSGSRLWPLSRKQFPKQFLALTGEHTLFQQTLQRLVFEGMQEPIVVCNKDHRFIVNEQLAALNLETQAILMEPFGRNTAPAVALTAMKLVNEGNDGLMLVLPADHVIEDQKALQRALALATVTAERGEMVLFGVPANKPETGYGYIKSTADALLPEGVSRVSQFVEKPDEKRAKEFVEAGGYYWNSGMFLFRASRFLEELKKHDPDIYDTCLLTLERSVQDGDALEIDASTFACCPDNSIDYAVMEKTQRACVVPLSAGWSDVGCWSSLWEVNAKDAHGNVTKGDVVIQDSRNCMIHGNGKLVSVIGLDNIVVVETKDAMMIAHKDKVQGVKQMVATLNEQGRTETQNHLEVYRPWGSYDSVDMGGRFQVKRISVKPGACLSLQMHHHRAEHWIVVSGTAQVTCDENVFLLTENQSTYIPIASVHRLRNPGKIPLEIIEVQSGSYLGEDDIERFEDIYGRSNALEAGVKTQTIAR

SEQ ID NO: 18899 - protein, 254 aa, Pseudomonas syringae pv. tomato str. DC3000
MSEVINKPLGAEGMIRMEGVHKWYGQFHVLKDINLNVRQGERIVLCGPSGSGKSTTIRCLNRLEEHQQGRIIVDGTELTSDLKQIETIRREVGMVFQHFNLFPHLTILQNCTLAPMWVRKMPKKKAEEIAMHYIERVRIPEQAHKFPGQLSGGQQQRVAIARALCMKPKIMLFDEPTSALDPEMVKEVLDTMVGLAEEGMTMLCVTHEMGFARTVANRVIFMDKGEIVEQAAPNDFFDNPQSDRTKLFLSQIIH

SEQ ID NO: 18900 - protein, 473 aa, Pseudomonas syringae pv. tomato str. DC3000
MSSSSTTAAADTQGRQNASPNRLIFISVLVATMGALAFGYDTGIIAGALPFMTLPADQGGLGLNAYSEGMITASLIVGAAFGSLASGYISDRFGRRLTLRLLSVLFIAGALGTAIAPSIPFMVAARFLLGIAVGGGSATVPVFIAEIAGPSRRARLVSRNELMIVSGQLLAYVLSAVMAALLHTPGIWRYMLAIAMVPGVLLLIGTFFVPPSPRWLASKGRFDEAQDVLEQLRSNKDDAQREVDEMKAQDEQARNRPKAKELLRQRWVIKLLLIGIGLGFTAQLTGVNAFMYYTPIILKNTGMGTNAALTATIGNGVVSVIATLLGIWAIGRYGRRHLLMTGLVMVILMQAALGCVLQFMPQNLTQSYTALACILVFLLFMQMCISPVYWLLMSELFPMQVRGLLTGTAVSMQWLFNASVAFTFPIAVDTIGNPTFFIFAAINVGSLIFVFLCLPETKGKSLEQIEKHLKKEL

SEQ ID NO: 18901 - protein, 173 aa, Pseudomonas syringae pv. tomato str. DC3000
MGSPCHFALFELKPEFQLDLDQLATRYRELARNVHPDRFADAPEREQRLALERSASLNEAYQTLKSPPKRARYLLAMNGNEVPLEVTVHDPEFLLQQMQLREDLEDLQDEADLAGVATFKRQLKVAQDELNQSFAACWNDAAQREHAEKLMRRMQFLDKLSHEVRQLEERLDD

SEQ ID NO: 18902 - protein, 489 aa, Pseudomonas syringae pv. tomato str. DC3000
MLRIKQEALTFDDILLVPGYSEVLPNEVSLKTRLTRGIELNIPLVSAAMDTVTEARLAIAMAQEGGIGIIHKNMTIEQQAAEVRKVKKFEAGVVKDPITIEADATVRDLFELTRMHNISGVPVLHNGDLVGIVTSRDVRFENRLDVPVREVMTPKERLVTVREGADKNEVRELLHKHRLEKVLIVDANFALKGMMTVKDIEKAKAYPLASKDDQARLRVGAAVGTGKDTGERVTALVAAGVDVVVVDTAHGHSKGVIDRVRWVKDNFPQVQVIGGNIATGEAALALVAAGADAVKVGIGPGSICTTRIVAGVGVPQISAIANVAAALEGTGVPMIADGGIRFSGDLSKAIVAGASCVMMGSMFAGTEEAPGEIELFQGRSYKAYRGMGSLGAMSQAQGSSDRYFQDSSAGAEKLVPEGIEGRVAYKGPLSAIIHQLMGGLRSSMGYTGSADIEQMRTKPEFVRITGAGMAESHVHDVQITKEAPNYRVG

SEQ ID NO: 18903 - protein, 368 aa, Pseudomonas syringae pv. tomato str. DC3000
MSLLLEPYTLRQLTLRNRIAVSPMCQYSSVDGLANDWHLVHLGSRAVGGAGLVMSEAMAVTPDGRITPEDLGLWNDEQIEPLQRITRFINAQGAVAGIQLAHAGRKASTWRPWLGKHGSVPLNEGGWTPVGPSAIAFDPQHTAPVQLSETQIKELIEAFVESARRALTAGFKVVEIHAAHGYLLHQFLSPLSNQRTDQYGGSFENRIRLTLQVTEAVHAVWPEELPLFVRVSATDWVEDGWNADETVELARRLKALGTDLIDVSSGGTSANAEIPVGPGYQTRFAERVRKESDIATGTVGMITDPAQAEHILRTGQADIILLARELLRDPYWPLRADEDLGGRLATWPAQYQRATHRDQPIHESDLRD

SEQ ID NO: 18904 - protein, 215 aa, Pseudomonas syringae pv. tomato str. DC3000
MRVILLGAPGAGKGTQAKFITEKFGIPQISTGDMLRAAVKAGTELGLKAKSVMDAGNLVSDDLIIGLIKDRLAEPDCANGVLFDGFPRTIPQAEALLKAGLEIDHVLEIAVDDEEIVKRMSGRRVHEGSGRIYHTIFNPPKVEGVDDVTGESLVQRKDDVEETVRLRLKVYHDQTKPLVEFYSKLEAQNGKPKCSHIPGVGSVEEITAKVLVALS

SEQ ID NO: 18905 - protein, 428 aa, Pseudomonas syringae pv. tomato str. DC3000 [sequence omitted]

SEQ ID NO: 18906 - protein, 370 aa, Pseudomonas syringae pv. tomato str. DC3000
MIKSRAAVAFEAKKPLEIVEVDVAMPKAGEVLLKVVASGVCHTDAYTLSGADPEGIFPSILGHEGGAIVEAIGEGVTSVAVGDHVIPLYTPECRQCKFCRSGKTNLCQAIRSTQGKGLMPDGTTRFSYKGEPIFHYMGTSTFSEYTVLPEISVAKIDKKAPLEKVCLLGCGVTTGIGAVLNTAKVKPGDTVAVFGLGGIGLSAVIGAVKAKAARIIAIDINPAKFEIAKQLGATDCVNPKDFDRPIQEVIVDMTDGGVDFSFECIGNVQLMRSALESCHKGWGESVIIGVAGAGQEISTRPFQLVTGRVWRGSAFGGVRGRTELPSYVDMAQTGEIPLDTFITHTMGLEDINKAFDLMHEGKSIRTVIHF

SEQ ID NO: 18907 - protein, 300 aa, Pseudomonas syringae pv. tomato str. DC3000
MTLQYQTIADCVGNTPLVRLQRMMGTTSNTILLKLEGNNPAGSVKDRPALSMITRAELRGQIVPGDTLIEATSGNTGIALAMAAAIKGYRMILIMPDNSSAERKAAMTAYGAELILVSKDEGMEGARDLADRMQAEGRGKVLDQFANGDNPEAHYTSTGPEIWQQTAGTVTHFVSSMGTTGTIMGTSRYLKEQNPDVQIVGLQPMEGASIPGIRRWPYEYLPKIYQSDRVDRIIDMGQTEAEETMRRLAREEGIFCGVSSGGSVAGALRIAREVENATIVAIICDRGDRYLSTGIYDMPN

SEQ ID NO: 18908 - protein, 183 aa, Pseudomonas syringae pv. tomato str. DC3000
MKIRFVSIPLLLLSMSGAVMAADCPPLLQGELPKLRAKENIDLCKRFAGKPLVVVNTASFCGFAPQFKGLEELSQRYKGQGLEVLGLPSNDFKQEAKDGEETAKVCYVNYGVTFTMTEPQAVRGDDATHLFKVLAEQSSAPRWNFYKYVVDRQGKVVANFSSMTKPDDPELIAAIEKAIASKP

SEQ ID NO: 18909 - protein, 364 aa, Pseudomonas syringae pv. tomato str. DC3000
MSEQELKALRVRIDSLDEKVLELISERARCAQEVARVKMSSLAEGEVPVFYRPEREAAVLRRVMDRNRGPLSNEEMARLFREIMSSCLALEQPLKVAYLGPEGTFTQAAAMKHFGHAVISLPMAAIDEVFREVVAGAVNFGVVPVENSTEGAVNHTLDSFLEHDMVICGEVELRIHHHLLVGESTKTQSISRIYSHAQSLAQCRKWLDAHYPNVERVAVASNAEAAKRVKGEWNSAAIAGDMAAGLYGLTRLAEKIEDRPDNSTRFLIIGNQEVPPTGDDKTSIIVSMSNKPGALHELLVPFHENGLDLTRIETRPSRSGKWTYVFFIDFVGHHQDPLVKAVLEKISSEAVALKVLGSYPKAVL

SEQ ID NO: 18910 - protein, 161 aa, Pseudomonas syringae pv. tomato str. DC3000
MSENLLNIPVTTIKGEQKTLADFAGKAVLVVNTASKCGFTPQYKGLEKLWQDYKDQGLVVLGFPCNQFGKQEPGDEGAISGFCELNYGVSFPLFKKVDVNGDQAHPLFVQLKEQAPGLLGTERIKWNFTKFLIGQDGKLVKRFAPLTKPEELTDEIEALLR

SEQ ID NO: 18911 - protein, 469 aa, Pseudomonas syringae pv. tomato str. DC3000
MSETTAPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPHIPSWVSAAVFFVLINAINLTNVKVFGETEFWFAIIKVVAIIGMIALGSYMLVSGSGGPQASVSNLWEHGGFFPNGVSGLVMALAIIMFSFGGLEMLGFTAAEAEQPKTVIPKAINQVIYRILIFYIGALVVLLSLTPWDSLLASLNASGDSYSGSPFVQVFSMLGSDAAAHILNFVVLTAALSVYNSGTYCNSRMLVGMAEQGDAPKLLAQVDKRGVPVKAIFASAAVTLVAVLLNYFVPQQALELLMSLVVATLVINWAMISYSHLKFRQHMNRTGQVPLFKALWYPYGNYVCLAFVVFILGIMLMIPGIQISVYAIPVWLAVMWVCYRAKNRRSVVVNAETGK

SEQ ID NO: 18912 - protein, 405 aa, Pseudomonas syringae pv. tomato str. DC3000
MSVEHAAVQRADFDQVMVPNYAPAGFIPVRGAGSRVWDQAGRELVDFSGGIAVNVLGHCHPALVGALTEQANNLWHVSNVFTNEPTLRLAKKLVDSTFAERVFFCNSGAEANEAAFKLARRVAHDLYGPEKYEIIAAVNSFHGRTLFTVSVGGQPKYSDGFGPKITGISHVPYNDLEALKAAVTDKTCAVVLEPIQGEGGVLPGELDYLQGARKLCDEHNALLVFDEVQSGMGRSGHLFAYMHYGVTPDILSSAKSIGGGFPLAAMLTTEKLAKHFAVGVHGTTYGGNPLACAVGEAVIDVINTPEVLAGVQRKHQQFKTRLESIGQQYGVFTEVRGLGLLIGCVLSDAWKGKAKDIFNAAEAQDLMILQAGPDVIRFAPSLVIEDADIEEGLNRFERAIAKLTS

SEQ ID NO: 18913 - protein, 360 aa, Pseudomonas syringae pv. tomato str. DC3000
MSEKTLFQPYALGNLTLTSRIVMAPLTRNRAGAGLAPTDLAATYYAQRASAGLIITEATQISPQAQGYQDTPGLYTPEQIAAWRVVTDAVHAEGGRIFVQLWHVGRVSHVDLQPGGAAPVAPSAIRAQTKTFVNNAFTDVSEPRALELSELPGIVNDFRQAAANAIEAGFDGVEIHGANGYLLDQFIKDSANVRTDAYGGSVENRARLLLEVVTAVVKEIGAHRTGVRISPVSPANGVASSDPQPQYEYIAEQLSEQGIAFLHVVEGATGGPRDVAPFDYDALRQRFKHTYLANNGYDLDLATARVNANKADLVAFGRPFISNPDLIERLKTGAPLAELNPATLYGGGAEGYTDYPTIAG

SEQ ID NO: 18914 - protein, 505 aa, Pseudomonas syringae pv. tomato str. DC3000
MSTATILELMRPYWGDRSVIASYVGGAFIEGHGAPVEVRNAHNDSLLLSFPDADESLVEVADKAAKAAQQQWWAMTAQARGRAMYQVGNLIREEQENLAQIESLTANKPIRDARVEVLKVAEMFEYYAGWADKLHGEVIPVPTTHLNYVTYEPLGTVLQITPWNAPIFTCGWQIAPAIAAGNAVILKPSELTPLSSLVVGVLIERAGVPKGLVNVIAGFGHSIGQAFIAKADIRKVVFVGSPATGRHIAVAAAQRCIPAVLELGGKSANIVFDDADLEVALRGAQAAIFSGAGQSCVSGSRLLVQQSIFEKFTNALAVAATQFKVGDPGDPETQIGPINNAKQYNHVKSMVERALKDGAKLVGEQADPIPDRPGYYINPTVLAGTNELHCAQEEIFGPVVVAIAFKDEEDAIRIANDSRFGLAGGVWTRDVGRAHRVAKQVRAGTFWVNGYKTIHVSSPFGGYGESGYGRSSGLDALREYSEVKSVWVETAAKPAASFGYGASLE

SEQ ID NO: 18915 - protein, 415 aa, Pseudomonas syringae pv. tomato str. DC3000
MSEHISESISFVHSMTLSHGRNAEVWDTTGKRYIDFVGGIGVLNLGHCNPQVVKAIQDQAARLTHYCFNATPHDPYIQFMRQLTQFVPVSYPLSGMLTNSGAEAAENALKIVRGATGRSAVIAFDGGFHGRTLATLNLNGKVSPYKQKVGVLPGPVFHIPFPSKDNGVSTEQALKALERLFSVEIDVNDVACIIFEPVQGEGGFLAMQADFAQALRAFCDEHGIVLIADEIQSGFGRTGQRFAFTRLGIEPDLILLGKSIAGGIPLGAVVGRKALIDSLPKGGLGGTYSGNPIGCAAGLASLAQMTDENLSTWGEQQESAIVSRYNAWQASNLSPYLGRLTGVGCMRGIELITPDGNPGTRQLAELLGAARDAGLLLMPSGKSRHIIRLLIPLTIEPDVLHEGLDIFERCLAALA

SEQ ID NO: 18916 - protein, 286 aa, Pseudomonas syringae pv. tomato str. DC3000
MSDYQETLYEGYGQRFRMEKMLHEVRTEHQHLVIFQNPRMGRVMALDGVIQTTEADEFIYHEMLTHVPILAHGAAKRVLIIGGGDGGMLREVAKHLTVEHITMVEIDATVVEMCKEFLPNHSSGAFDDSRLNLVIDDGMRFVATTEEKFDVIISDSTDPIGPGEVLFSENFYQACHRCLNEGGILVTQNGTPFMQLSGVQTTAGRMNGLFADWHFYQAAIPTYIGGAMTFAWGATDKSYRKLPLETLRQRFSGSGIVTRYYNPEVHIGAFALPQYVLHAVNKASND

SEQ ID NO: 18917 - protein, 464 aa, Pseudomonas syringae pv. tomato str. DC3000
MAVYNYDVVVLGSGPAGEGAAMNAAKAGRKVAMVDSRREVGGNCTHLGTIPSKALRHSVKQIIQFNTNPMFRAIGEPRWFSFPDVLKNAEMVISKQVASRTSYYARNRVDVFFGTGSFADETSVNVVCANGVVEKLVANQIIIATGSRPYRPADIDFSHKRIYDSDTILSLGHTPRKLIIYGAGVIGCEYASIFSGLGVLVELVDNRDQLLSFLDSEISQALSYHFSNNNVMVRHNEEYERVEGLDNGVVLHLKSGKKIKADALLWCNGRTGNTDKLGLENIGLKANGRGQIEVDEAYRTSVSNVYGAGDVIGWPSLASAAYDQGRSAAGSMVDNGSWRYVNDVPTGIYTIPEISSIGKNEHELTQAKVPYEVGKAFFKGMARAQISGERVGMLKILFHRETLEVLGVHCFGDQASEIVHIGQAIMSQPGEANTIKYFVNTTFNYPTMAEAYRVAAYDGLNRLF

SEQ ID NO: 18918 - protein, 394 aa, Pseudomonas syringae pv. tomato str. DC3000
MPKTSAKLLIIDDDDVVRASLAAYLEDSGFSVLQASNGLQGIQIFEQENPDLVVCDLRMPQMGGLELIRQVTAIAPQTPVIVVSGAGVMSDAVEALRLGAADYLIKPLEDLAVLEHSVRRALDRSRLLNENQVYREQLEKANRELEASLHLLQEDQDAGRQVQINMLPITPWSIAEFKFAHQIIPSLYLSGDFVDYFRVDERRVAFYLADVSGHGASSAFITVLLKFMTTRLLFESKRGGTLPEFKPSDVLGHINRGLISCKLGKHVTMVGGVIDEESGKLTYAVGGHLPLPVLYSEGQARYLDGRGLPVGLFNEATYQDHEIDLPASFSLTMLSDGILDLLPGDTLKEKEAILPELVKKAGGRLDGLQRVFELATLGEMPDDIALLVLSRNLE

SEQ ID NO: 18919 - protein, 488 aa, Pseudomonas syringae pv. tomato str. DC3000
MAHRHASGHSTSVLRVAQMSVATRFIDDQLTRITPAAAETLYQFDESPLLARQSRQESNARSYPRRIPLALKRAKGIHVEDVEGRRFIDCLAGAGTLALGHNHPVIIDAIQQVISDELPLHTLDLTTPVKDQFVQDLFGLLPPALANEAKIQFCGPTGTDAVEAALKLVRTATGRSTVLSFQGGYHGMSQGALSLMGSLGPKKPLGALLSSGVQFLPYPYDYRCPFGLGGEQGVRANLHYLENLLNDPEAGVQLPAAVILEVVQGEGGVIPADLDWLRGVRRITEKAGVALIVDEIQSGFARTGKMFAFEHAGIIPDVVVLSKAIGGSLPLAVVVYRSWLDTWLPGAHAGTFRGNQMAMATGSAVMRYLQEHNVCEHATAMGARLVGHLQALQRDFPQLGDIRGRGLMLGVELVDPAGARDAQGHPPVFARLAPLIQRECLKRGLILELGGRHGSVVRFLPPLVITAEQIDEVAEIFGRALNAAVAQL

SEQ ID NO: 18920 - protein, 350 aa, Pseudomonas syringae pv. tomato str. DC3000
MYTAIGYAAQSATAPLAPMTFERRAPRADDVAIEILFCGVCHSDIHQARNEWGIAVYPLMPGHEIVGRVTATGANATKYKVGDLVGVGCMVDSCRECSACKSDLEQYCLEGPTMTYATPDRVDGSNTMGGYSNSIVVAEHFVVRVPEKLDPAAAAPILCAGITTYSPLKHYGVKAGDKVGILGMGGLGHMGIKFAKAMGAEVTLFTRSAAKAQEARRQGADHVIVSTDAEQMKAAAGHFDFLLDTIPVQHDLNPYLETLRFDGVHILVGLIEPIEPPVHAAHLVMSRRVLAGSLIGGIAETQEVLDFCAENGITCDIEMLDIRNINEAYERMLAGDVKYRFVIDMATLQA

SEQ ID NO: 18921 - protein, 478 aa, Pseudomonas syringae pv. tomato str. DC3000
MSQKFDVVVIGAGPGGYVAAIKAAQLGLKTACIEKYQDKEGKLALGGTCLNVGCIPSKALLDSSWKFYEAKNGFAVHGISTSEVAIDVPAMIGRKSTIVKGLTGGVASLFKANGVTTLQGHGKLLAGKKVELTAADGTVEIIEADHVILASGSRPIDIPPAPVDQKVIVDSTGALEFQQVPQRLGVIGAGVIGLELGSVWARLGAQVTVLEALDKFIPAADEAVSKEALKTFTKQGLDIKLGARVTGSKVNGEEVVVSYTDAAGEQSITFDRLIVAVGRRPVTTDLLASDSGVDLDERGFIYVDDYCTTSVPGVYAIGDVVRGLMLAHKASEEGIMVVERIKGHKAQMNYNLIPSVIYTHPEIAWVGKTEQTLKAEGVEVNVGTFPFAASGRAMAANDTGGFVKIIADAKTDRVLGVHVIGPSAAELVQQGAIAMEFGSSAEDIGMMVFSHPTLSEALHEAALAVNGGAIHIQNRKKR

SEQ ID NO: 18922 - protein, 162 aa, Pseudomonas syringae pv. tomato str. DC3000
MHYITPDLCDAYPELVQVVEPMLSNFGGRDSFGGQIVTLKCFEDNSLVKEQVELDGKGKVLVVDGGGSLRCALLGDMLAEKAAKHGWEGLVIYGCVRDVDMLAQTDLGVQALASYPKRSEKRGVGQLDLPVTFGGVTFRPGEYLYADNNGVIISPSPLTMPE

SEQ ID NO: 18923 - protein, 409 aa, Pseudomonas syringae pv. tomato str. DC3000
MKKLKLVMIGNGMAGVRTLEELLKLSEDLYDITVFGAEPHPNYNRILLSPVLAGEQNFEDIVLNDLAWYQSNGIQLLLNRRVVKIDRIKRLVIADDGTQAHYDRLLIATGSRPFILPIPGNTLDGVIGYRDIGHTRQMIDTAVTHKHAVVIGGGLLGLEAANGLSLRGMQVTVIHNGQTLLERQLDKTSGLMLQAALELRGLSFRLNEQTQALLGDDQGRVRAVQLKNGDVIDADLVVMAAGIRPNTELAEQAGLPCNRGILVNDTLQTFDPRIYAIGECVSHRGIAYGLVAPLFEQARVCANHLAQLGSARYPGSVTSTKLKVTGIDLFSAGDFLGGEGTESITLSDPIGGVYKKLVIKNDILVGACLYGDTADGSWYLQQIRDGQGIDAIRNHLMFGKPAATPAACA

SEQ ID NO: 18924 - protein, 403 aa, Pseudomonas syringae pv. tomato str. DC3000
MDTSFWKAGHRPTLFAAFLYFDLSFMVWYLLGPMAVQIATDLHLTTQQRGLMVATPILAGAVLRLFMGLLADQLSPKTAGIIGQVIVIGALFTAWQLGIHSYEQVLLLGLFLGMAGASFAVALPLASQWYPPQHQGKAMGIAGAGNSGTVLAALIAPVLAASFGWGNVFGLALIPLVLTLIAFTLMARNAPERSKPKSMADYLKALGDRDSWWFMFFYSVTFGGFIGLASALPGYFNDQYGLSPITAGYYTAACVFGGSLMRPLGGALADRFGGIRTLTVMYTVAAVGIAAVGFNLPSSWAALALFVAAMLGLGAGNGAVFQLVPQRFRKEIGVMTGLIGMAGGIGGFLLAAGLGAIKQNTGDYQLGLWLFAGLAVLAWFGLLNVKRRWRTTWGSAAVTAARV

SEQ ID NO: 18925 - protein, 449 aa, Pseudomonas syringae pv. tomato str. DC3000
MTLTASGPATGTLDVQAFINAQPLSGYQWRIVALCFLIVFLDGLDTAAMGFIAPALSQDWGIDRASLGPVMSAALIGMVFGALGSGPLADRFGRKVVLVVAVFLFGIFSLASAYSSNIDQLLVLRLLTGLGLGAAMPNATTLLSEYTPERLKSLLVTSMFCGFNLGMACGGFVSAKLIPSMGWHSLLMLGGILPLVLAVVLMVWLPESARFLVVRNRGAEQIRKVLAPIAPKAVAGVTAFTVPEQKTVSSRNVLKVIFSGTYSAGTLLLWLTYFMGLVIVYLLTSWLPTLMRDSGASMEQSAFIGALFQFGGVLSAVGVGWAMDRYNPHKVIGFAYALAGVFAYLVGQSLGNVAVLATLVLLAGMCINGAQSAMPSLAARFYPTQGRATGVSWMLGIGRFGAILGAWAGATLLGLGWNFEQVLTALVIPAALAALAILIKGWVSHSDAT

SEQ ID NO: 18926 - protein, 363 aa, Pseudomonas syringae pv. tomato str. DC3000
MSALFEPFKLKDVTLRNRIAIPPMCQYSAIDGVVNDWHHVHLASMARGGAGLLVVEATAVAPEGRITPGCTGIWNDEQAQAFVPIVKAIKDAGCVPGIQIAHAGRKASANRPWEGDDHIVASDSRGWDTIAPSAIAFGANLPKVPRAMTLDDIARVRQNFVDAARRARDAGFEWIELHFAHGYLGQSFFSEHSNQRTDEYGGSFDNRSRFLLETLAAVREVWPENLPLTARFGVLEYDGRDEQTLTESIELARRFKAGGLDLLSVSVGFSTPDANIPWGPAFMGPIAERVRREAAIPVTSAWGFGEPKLAEEAVKSGQLDLVSIGRAHLADPHWAYFAAKELGVEKSAWTLPAPYAHWLERYR

SEQ ID NO: 18927 - protein, 446 aa, Pseudomonas syringae pv. tomato str. DC3000
MANVSMEAKGLLILGFPIAATMIAQTLMSLTDLMLVSRLGEKQVAGVSLGIAVYSFGMLFGLGVITAVTPMIAKAYGRKDFNAVSNYTRQGLWVAALVAMPGVIALILTRSILLFLNVEAETANIASDYCVGALMGLPAFLIYVNLRCFLSAIGRPKTTTWIMFLAVPVNYIIGHVLIFGVMDAEGLGITGAGLASSVTRLAILSTVIATLKYGADFKCFSLFENVMNVKPVVVKKIVLLGLPVGVRILLAEGMLPIIALLISTLGTIDLVAHMVAVRLSGVSAVIALGFSSAASTRVAWQVAANNQNGVRVTGYVASALAFGVSALLAMLLIFFPTELVMLLFDIDDAEVLALTSHLLKVVAAYQILNAIQTAVVGSLLGVSDTKIPTCLVLIGNWLVGLASAYGLVVLFEATVTAVWGGLVLGQVFVVVTCLCRFHMKTKALHE

SEQ ID NO: 18928 - protein, 327 aa, Pseudomonas syringae pv. tomato str. DC3000
MILFLNFRYENMNSIELAIGNTPMVELKSFDLPPGIRIFAKLEFLNPGGSIKDRVVNHIFNDAEARGLLCRGSTVIENTSGNTGAAIAMLAAARGYRVILTMPDKVSKEKQDTLRALGAEVIMCPTSAAPDSPEHYVQVAKSLHADTPNSFMLHQYDNPLNPEAHKLTTGPEIWRDLKGGISVFVAAGSTGGTISGISRYLKSQDKTIRSVLLDPKGSIYYKYFYEGVIDPLVIGPYQVEGVGEDHLAKCMDFEMIDDVIQFDDAAAFGTCRLLAQKEGLLCGGSSGANVWGCLQVAKRLSSPANIVTVLPDSGVKYLSKIYNSPFT

SEQ ID NO: 18929 - protein, 483 aa, Pseudomonas syringae pv. tomato str. DC3000
MPITPKNGTVFETDLPARLDRLPWGRFHTLLVIALGITWLLDGLEVTLAGSVAGALKASPALNLTNSDIGLAGAAYIAGAVLGALLFGWLADRLGRRKLFFITLLLYVGATAATAFSFSVWSFMLFRFLTGMGIGGEYTAINSTIQEFTPARYRGWVDLTINGTFWLGAALGAVGSIVLLDPLWVGAELGWRLCFGIGAVLGLLVLLMRLWLPESPRWLLIHGQSAQATKIVEQIEADLQRRGHVLPAVTSKPLRLHVRDHTPLGEVARTLLVTFRQRSLVGLTLLTAQAFFYNAIFFTYALVLTDFYDVPAERVGWYVLPLALGNFCGPLLLGRLFDVVGRRTMISLTYGLSGVLLAISGYLFQQGLLDVTQQAIAWMVIFFFASAAASSAYLTVAETFPLEIRALAIAVFYAFGTGLGGMIGPTLFGELIDTGERSNVFIGYLIGAGLMLLAALVQSIWGAAAERKSLEEVARPLSQAGDV

SEQ ID NO: 18930 - protein, 400 aa, Pseudomonas syringae pv. tomato str. DC3000
MTTACLMSTYQPLALSFTRGLGTRLWDQSGREYLDAVAGVAVTNVGHSHPMLVDAIRDQAGLLLHTSNLYSIDWQQRLAQKLTRLAGMDRVFFNNSGAEANETALKLARLHGWHKYIEQPLVVVMENAFHGRTLGTLAASDGPAVRLSYSDLPGDYIKVPFGDLLAFDKVCVTHGHRIAAVLVEPIQGEGGAQVAPAGYLKALRERCTRRDWLLMLDEIQTGMGRTGKWFAFQHEGIVPDVMTLAKGLGNGVPIGACLARGKAAELFTPGSHGSTFGGNPLACRVGCTVIDIIEQQALVENAGVRGQHLLGRLQEVLGGHPQVMQVRGRGLMIGIELREAIPELTRIAAEQHGLLINVTRGKVIRLLPPLVLEAAEVEQIVQGLAASLDSASYRALERSA

SEQ ID NO: 18931 - protein, 278 aa, Pseudomonas syringae pv. tomato str. DC3000
MPSIDSGAQSLVSLRDLHLSFGNNRVLKGIDLDVERGQAVSIIGPSGSGKSTILRCITGLLQTQRGSIRVGQTRVDELTREAERIELRKRVGFVFQQYNLFPHLSVLENLVIAPRKVLGIERGEAEKQARALLAKVRMEHKADAYPGQLSGGQQQRVAIARALTMRPELILFDEVTSALDPETVGEVLTVIRELTEEGMTCVLVTHEMRFAEEISDQVYFTENGLIVEHGSAEQIFQRPTSERTAAFLRHALGDAGRRNHTAGDPFLLSNISRYSLSV

SEQ ID NO: 18932 - protein, 493 aa, Pseudomonas syringae pv. tomato str. DC3000
MSLTRFQMCIDGQWVDALSGKTFDSLNPALAEPWAQLPDAGEADVERAVQAAQKAFESQEWRGLTATARGKLLRRLGDLIAENKEHLAQLESRDNGKLIRETRGQVSYLPEFFHYTAGLADKLEGGTLPLDKPDLFAYTVHEPMGVVAGIIPWNSPLYLTAIKLAPALAAGNTIVLKPSEHASATVLELARLALEAGIAPGVVNVITGYGPTTGAALTRHPLVRKIAFTGGAATARHVVRSSAENFAKLSLELGGKSPNIIFADADLDSAINGAVAGIYAASGQSCVSGSRLLVQDEIYDEFVERLAERASRIRIGNPLDESTEMGPMATAQQLAVVEGLVADALAEGARLRLGGKRPELDSKGWFYEPTLFECDHNSMKIMQEEVFGPVASVIRFKDEAEALAIANDSQFGLAAGIWTRDLGRAHRLARDIRSGIIWVNTYRAVSAMAPIGGFKNSGYGRESGIDSVLAYTELKTVWINLSQAPMPDPFVMR

SEQ ID NO: 18933 - protein, 476 aa, Pseudomonas syringae pv. tomato str. DC3000
MYPDVQLYIDGQWRASRDGRSIPVIDPATGQSLGSVAHAGIADLDEALSAAERGFATWRATSAYDRYKLMQKAADLVRERADSIARIMTQEQGKPLAEARMETLSAADVIDWLAEEGRRSYGRIVPSRGVSIEQKVIKEPVGPVAAFTPWNFPINQVVRKLSSALAAGCSIIVKAPEETPGSPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLQAFTEKFVGLTREIKVGNGLESGTTMGPVANDRRIPALVDLIEDAVSAGATVSAGGKAVEGQGYFFEPTVLSGLTPAMRIMNEEPFGPVALLVPFDTVEEAIVESNRVPFGLASYAFTTSMKTAQALSTYIEAGMLSINHQGIGLPEVPFGGIKDSGYGSEGGTEAIEAYLNTKLVTQYS

SEQ ID NO: 18934 - protein, 358 aa, Pseudomonas syringae pv. tomato str. DC3000
MVKAYSYAAQSAQDVLQPYQFERRTPGDDDVQIDILYCGVCHSDLHTARNEWHNTLYPSVPGHEIVGRVTAVGANVKQFKVGDLAGVGCMVDSCQQCASCTEGDEQYCESGFTGTYNGPVFGGENTLGGYSDKIVVKEKFVLRISHDDNLAAVAPLLCAGITTYSPLRHWKVGPGTKVGIVGLGGLGHMGVKIAHAMGAHVVLFTTSPDKREDGLRLGADEVIVSRDPAQMATQVNSLDFILNTVAAPHDLDAFLSLLKRDGTMTLVGAPAEPHPSPAVFNLIFKRRSLAGSLIGGIQETQEMLDFCAEHGIVSDIEVIDMQYINEAYERMLKGDVKYRFVIDMASLKQEVSADSNAA

SEQ ID NO: 18935 - protein, 312 aa, Pseudomonas syringae pv. tomato str. DC3000
MFLVCGEALFDIFTRADDGGSLNRLGFDAIAGGSPFNVAIGLRRLGVEAAFFAGLSTDYLGRRLRAVLEQETVNAEHLIEFDAPTTLAMVAVGSDGSPTYSFRGDGCADRQLRLEHLPELDERVRGIHVGSFSLVVQPIADTLLALVARESARRLISLDPNVRLNPAPDIQRWRTQIAAFAEHAHLIKVSDEDLHLLYPDSDPQQIAEGWLGKRTQLVIVTRGTQGASVFTRQHGTWSVPAKTVVTADTVGAGDTFQAALLTFLSERQLDTPQGLSTLSRETLDEMLNFAVGAAALTCTKVGPDLPYRHQLG

SEQ ID NO: 18936 - protein, 1108 aa, Pseudomonas syringae pv. tomato str. DC3000
MAKKPDAATFIKDPLWYKDAVIYQVHVKSFFDANNDGIGDFAGLIEKLDYIAALGVNTIWLLPFYPSPRRDDGYDISEYRDVHSDYGTMADAKRFIAQAHKRGLRVISELVINHTSDQHPWFQKARNAKPGSKARDFYVWSDTDQKYDGTRIIFLDTETSNWTWDPVAGQYFWHRFYSHQPDLNFDNPHVLDAVLEVMRFWLDLGIDGLRLDAIPYLIERDGTNNENLPETHQVLKRIRAEIDANYPDRMLLAEANQWPEDTQLYFGDSKGPDGDECHMAFHFPLMPRMYMALAQEDRFPITDILRQTPEIPENCQWAIFLRNHDELTLEMVTDRERDYLWNYYAADRRARINLGIRRRLAPLVERDRRRVELLNSMLLSMPGTPTLYYGDEIGMGDNIYLGDRDGVRTPMQWSIDRNGGFSRADPASLVLPPIMDPMYGFQSVNVESQERDPHSLLNWNRRMLAVRKQQKAFGRGTLKMLSPSNRRILAYTREYTAPDGHSEVVLCVANVSSAAQAAELDLSGYAGTVPVEMLGGSAFPPIGQLNYLLTLPPYGFYWFLLATENQMPSWHVEPAQSMPDFPTLVLKKRLEELLEEPLRSTMEDTSLTVYLPKRRWFAGKDKAIEKVNIAYAVRFGDEAHPVLLSEIEVTAGGQTDRYQLPFGLLGEDDISSALPQQLALARVRRSRDVGLITDAFTLETFIRAVIQGMQSDTVIPCADGQLRFEQSSQLAPLGLTHESEVRYLSAEQSNSSVVVGSSLVLKLIRKVSAGTHPELEMGAFLTHAGFKNISPLLGSLVRVGNDGQPNLLMIAQGYLSNQGDAWEWTQNNLERAVRDELAHGVSGQEQHYNALLELADFSRSLGQRLGEMHQILASPTDNADFAVEITSAQDSKASATSVNAQLERALQLLEQRKGDLDKDDQQLVSDLLAHRKQIRQRVEGLAKRSAGGLRIRVHGDLHLGQVLVVKGDAYLIDFEGEPARALEERRAKHSPFKDVSGVLRSFDYAAAMAVRSAQSVDTSPQAAAARKQVAETYLAQAREAFIEGYRLATSGIAHAWKDAKGEDSALELFTLEKAAYEVIYEAENRPAWLAVPLQGLRGLLQPSDGEPI

SEQ ID NO: 18937 - protein, 331 aa, Pseudomonas syringae pv. tomato str. DC3000
MITRQLGNHGPQVSAIGLGCMGMSDFYTTGIDEQESIATLHRALELGVTFFDTADMYGPHTNEALLGRALQGRREGIYLASKFGIVRGDDPHARGVNGSPEYIRQSIDGSLKRLSTDYLDLYYQHRVDPNVPIEDTIGAMAELVKAGKVRHIGICEASAATIERAHKVHPLAAVQSEYSLWSRDPEHDDVLATCRRLGIAFVAYSPLGRGFLTGALRTVDDFAEDDYRRFSPRFQGENFNRNLALVEKVKGLATAKGISASQLALAWVLAQGDDIIPIPGTKQRKYLESNVAAATLTLSHDELAQLDAIFPASGAVSGERYNAESMKSLNG

SEQ ID NO: 18938 - protein, 482 aa, Pseudomonas syringae pv. tomato str. DC3000
MLEVPLLIGGQSCPARDGRTFERCNPVTGEVVSRVAAATLEDADAAVAAAQAAFPGWAALAPGERRARLLKAAEQLQARSGEFIAAAGETGAMANWYGFNVQLAANMLREAASMTTQITGDVIPSNVPGSFAMALRQPCGVVLGIAPWNAPVILATRAIAMPLACGNTVVLKASELSPAVHRLIGQVLQDAGLGDGVVNVISNAPADAAAIVERLIANPAVRRVNFTGSTHVGRIVGELSARHLKPALLELGGKAPFLVLDDADLDAAVEAAAFGAYFNQGQICMSTERLIVDQKVADVFVAKLTAKIETLRAGHPDDSQSVLGSLVDVSAGSRIKALIDDAVNLGATLVIGGQLQGSILQPALLDGVTDRMRLYREESFGPVAVVIRGEGDEALLALANDSELGLSAAIFSRDTGRALALAQRVESGICHINGPTVHDEAQMPFGGVKSSGYGSFGGKASIEHFTQLRWVTLQNGPRHYPI

SEQ ID NO: 18939 - protein, 404 aa, Pseudomonas syringae pv. tomato str. DC3000
MTSPLRRSTLTIVLCFIVALIEGFDLQAAGTAAAGLRQTFALDPKMMGWVFSAGIIGLLPGAFFGGWIADRIGRKKILVAAVLLFGVFSLSTAYVQTFSGLLLVRFMTGLGLGAALPNLIALCAEAVSERHRGLAISVMYAGVPLGGALAAVVAMFTSEHWQTTFIIGGLVPLLVVPLMMLLLPESSAFSQQTSARSVRHSTATALFGEGRARTTLALWAGYFFTLTVMYMLLNWLPSLLIGQGFSKPQAGMVQMLFNIGGASGSLLGGLLLDRCNGIKVVMFVYAGLLLALTGVGFSVGIVPMAAAGFCAGVFVMAAQLVLYALAPPSYPTSVRATGVGAAVAIGRLGSVAGPLAAGQLLGAGAGTAGVLLATSPGLVIAALAAISVLSRSTATEKRQLKVAR

SEQ ID NO: 18940 - protein, 493 aa, Pseudomonas syringae pv. tomato str. DC3000
MSASDGTPFLQRAIDAECIFNGNWIPSSSALLPVIEPATSELLMNTAMAGAADIAIACREAALAQPAWAAMGPREKAEIFLMAADHAVCAFDELALYVARETGGSLHKGQHEVNETIVLLRQAAGMLSQAHGHGVILPSAAGRLSYARRVAHGVVGVISPFNFPLVLSLRSVAPALAAGNAVVLKPDPQTPISGGFLIARLFEEAGLPKGLLHVLPGAADAGEALCRDTNVQMITFTGSTGAGRKVAEAAGRNLKKVSLELGGKNPLVILEDADLDLAASNAAFGAWLHQGQICMATGLILVHESIVAAFTRKLADKARALTVGNAARGQAALGPLINQRQLQHVHQVVSDSLQAGAQLETGGEYEGLFYRPTVLSGVKPGMRAFEEEIFGPVAVVVSFSSDEQAIELANRSEYGLAAAVISPDVGRATALGDRLRCGMLHINDQTVADECINSFGGRGASGNGSSAGSPSDWDEYSQWQWVTVKNQAPVYPF

SEQ ID NO: 18941 - protein, 261 aa, Pseudomonas syringae pv. tomato str. DC3000
MSELAHPARAGRIQIQGVGKRFGSQQVLKDIDLTIEPGKVTVILGPSGSGKSTLLRTINHLEKIDSGYITIDGDYVGYRRKGDLLYELKEREILKRRIEVGFVFQNFNLFPHLTAWENIAEAPLAHKRWSKAQAQGKAGELLARVGLADKVDAYPRQLSGGQQQRVAIARALALDPKVLLFDEPTSALDPELVGEVLDVIKGLTQLGVTLVVVTHEIGFAREVADHVVFLCDGQLIEQGPPEQVFHQPRHPRTAAFLGKVL

SEQ ID NO: 18942 - protein, 505 aa, Pseudomonas syringae pv. tomato str. DC3000
MHDLLTADEYAAIAQSISFPSNAFINGAYKPAISGATFSTINPATGEFLSDLAACRAEDVDDAVSKAKKAFDDGRWRLLAPGERKSVLLKFARLLEDNRHELAVLESLDSGKPVRECQLVDVPDTIHTLRWHAELIDKLYDHTAPVGNDALTLVVREPIGVVGCVLPWNFPLLMLAWKIGPALAAGCSVIVKPAEQTSLTTLRVAELAFEAGVPAGVLNIITGTGKDVGEPIGLHKDIDMVSFTGSTVTGRRFLHYSADSNLKRVVLECGGKNPAVVMEDAEDLDLVAEQVVNGAFWNMGENCSATSRLLVHASVKDELLERMGAYIREWKMGDPLDPQTRVGALVSSDHFAKVKSYLDYANADKLDIVYGGDTQEGAFVQLTVVDGVERDSRLFQEEIFGPILSVTTFNSISEAIALANDTVYGLAASVYTGSLRKAIKLSREIRAGIVTVNCFGEGDASTPFGGFKESGFGGRDKSVFAHDQYTEIKTIWIDVSDRSVDETVK

SEQ ID NO: 18943 - protein, 367 aa, Pseudomonas syringae pv. tomato str. DC3000
MNDLSKATDLFSPVQMGSIDLANRIVMAPVTRSRYAEDGVPKDLHATYYAQRATAGMIVAEATNISAQGRGYAATPGIWNEKQVAGWRKVTDAVHAAGGKIVSQLWHVGRFSGVDLQPGGEAPVAPSALQAEGNTYTVDGFVPVSMPRALETDEISGIIAQYRHAAENAKRAGFDGVEVHSANSYLLDQFLRDSTNQRTDHYGGSIENRARLTLEVTQAIVDIWGNDRVGIRLSPVTPDAGNTAPDSNVMGLHGYLIQQLNTLNLAYLHFVEGATATSREVPEGVDMDALSAQFHGPFIGNNNYDLEMAVERRAQGKIDAVAFGRLFISNPDLVARLFHGAELTIAPRESYYGGGAKGYTDWPLGQY

SEQ ID NO: 18944 - protein, 365 aa, Pseudomonas syringae pv. tomato str. DC3000
MSEINKDVPALFNMGSLKLKNRFALAPMTRVSATEQGCATQAMARYYERFAKGGFGLIITEGNYTDRSFSQGYPFQPGLTDDEQALAWRATTDAVHRHGSAVIAQIMHAGALSQANRFVNEAAGPSAIRPKGEQMAFYYGEGRYRVPRAMSDKDIADTLDGFARATRRAVGAAGFDGVEIHGANGYLLDQFLTDYTNQRTDQWGGNVYQRLRLTLDVIAEVKKAAGQAPVGVRISQGKVNDFQHKWAGGERDAEVIFGALADAGVDYIHITEHQAWQPAFAQGEASLVRLARRYAPDVALIANGGLHDPEKAAQVFRDGADIIAVGKGALANPDLPRLLLEGGAIREFDPAILGPIANIKDSELG

SEQ ID NO: 18945 - protein, 452 aa, Pseudomonas syringae pv. tomato str. DC3000
MAFDFDLFVIGAGSGGVRAARFAAGFGARVAVAESRYLGGTCVNVGCVPKKLLVYGAHFSEDFDHAKGFGWSLGEASFDWSTLIANKDREINRLNDIYRKLLVDSGVTLLEGHAKIVGPQQVEINGQTHSAERILIATGGWPQVPDVPGREHAITSNEAFYLKALPKRVVVVGGGYIAVEFASIFNGLGADTTLVYRGELFLRGFDGSVRSHLHEELLKRHMTIRFNSDIERIDKQSDGSLLLSMKGGGTLETDCVFYATGRRPMLDNLGLDSVDVKLDEHGYIKVDEHYQTSEPSILALGDVIGGVQLTPVALAEGMAVARRLFKPEQYRPVDYNHIPTAVFSLPNIGTVGLTEEDAIKAGHDVQVFESRFRSMKLTLTDDQERTLMKLVVDAKTDRVLGCHMVGPDAGEIVQSLAIAIKAGATKQVFDDTIGVHPTAAEEFVTMRTPAKR

SEQ ID NO: 18946 - protein, 324 aa, Pseudomonas syringae pv. tomato str. DC3000
MQLGIIGLGRMGGNIARRLMLDGHTTVVYDRDEASRGALANEGSTAVADLAELVSALEKPRAVWVMLPAGAPTEDTIQTLSQLLEADDVIIDGGNTFYKDDIRRAQELSEKGLHYVDVGTSGGVWGLERGYCMMIGGDVAAVERLDPLFASLAPGLGSIERTRGRTSTDDRAERGYIHSGPAGSGHFVKMIHNGIEYGMMQAFAEGFDLLKQKNSEHLPAEQRFDLNTADIAEVWRRGSVVSSWLLDLTADALATDPQLDAFSGSVADSGEGRWTIEAAIEQAVPVPVLSSALFARFRSRQTSSYADKMLSAMRFGFGGHKEPK

SEQ ID NO: 18947 - protein, 233 aa, Pseudomonas syringae pv. tomato str. DC3000
MAGLDKRVATYEEALAGLTDNMTVLCGGFGLCGIPENLIAQIKRMGIKGLTVVSNNCGVDGFGLGILLEDRQIRKMISSYVGENALFEKQLLSGELQVELTPQGTLAEKLRAGGAGIPAFYTATGYGTPVAEGKETRQFNGRNVILEEAITGDFALIKGWKADHFGNVIYRHTAQNFNPVVATAGRITVVEVEEIVEPGVLLPTEIHTPGIYVDRVIQGTFEKRIEQRTVRKS

SEQ ID NO: 18948 - protein, 485 aa, Pseudomonas syringae pv. tomato str. DC3000
MSILIPCIIAGGSGTRLWPVSREAMPKPFMRLPDGESLLQKTFLRAAGLPGVDRLLTVTNREVYFRTVDDYRLLNKSHARLDFILEPFGRNTAAAIAAAALHVSTLYGDDAQLLVLPADHLITDVAAFSRAVAAAQTLAAEGWLVTFGIVPTAPETGFGYIEKGQALNAEACQVARFVEKPDAAVAQGYLQSGLHLWNAGMFCMRADAVLRELQTHAPDVLSVVSTCMAVSQRKEGGRELQIELDSESFALTPDISIDYALMERSDKVAVVPCQLGWSDIGSWQAVRELSPVDAQGNHCNGETVLHDVSNCYIDSPKRLVGAVGLDNLIIIDTPDALLIADGRRSQDVKIIAQELKRQGHDAYRLHRTVTRPWGTYTVLEEGKRFKIKRIVVRPQASLSLQMHHHRSEHWIVVSGMATVTNGEREFMLDTNESTFIKPGFTHRLVNPGVIDLVMIEVQSGEYLGEDDIVRFTDIYGRVPEKAVKS

SEQ ID NO: 18949 - protein, 491 aa, Pseudomonas syringae pv. tomato str. DC3000
MTTQPLNSHRVDPHTAQKFYIDGHWSAPLSPVSIAVVNPATEEVVAHVASGSAADVDRAVAAARAAFAGWSGTSPEVRAQVIGRIHELIIERKEELAQAISLEMGAAISSARAMQVPLAAEHVRVARDLLATYRFQTVEGGTAIEREPIGVCALITPWNWPLYQITAKVAPAIAAGCTVVLKPSELSPLSALLFAQLVHDAGLPPGVFNLVNGSGPEVGGAMAAHPDIDMISITGSNRAGALVAQAAAPTVKRVTQELGGKSPNILLPDADFANAVPPGVMAAFRNVGQSCSAPTRMIVPRNRLAEVEALAAQTAGTIVVGDPQLEHTVLGPIANEAQFHRVQAMINAGICEGAKLVCGGPGRVQGHEQGFYTRPTVFSEVDSSMRIAREEIFGPVLCLIAYDTIDEAVAIANDTVYGLGAHVQGQDLELARSVASRIRAGQVHLNYPSWNPMAPFGGYKRSGNGREYGVHGFEEYLETKAIVGFAPADLM

SEQ ID NO: 18950 - protein, 338 aa, Pseudomonas syringae pv. tomato str. DC3000
MNLSKFKRYPLTFGPSPITPLKRLSEHLGGKVDLYAKREDCNSGLAFGGNKTRKLEYLVPEAIEGGYDTLVSIGGIQSNQTRQVAAVAAHLGMKCVLVQENWVNYSDALYDRVGNIEMSRIMGADVRLDSAGFDIGIRPSWEKAMADVVESGGKPFPIPAGCSEHPYGGLGFVRFADEVRQQEEELGFKFDYIVVCSVTGSTHAGMLVGFAADGRAQRVIGIDASAKPDKTREQVLRIAQNTAKLVDLGREITAEDVVLDTRYAYPEYGLPNDGTLEAIRLCARLEGVLTDPVYEGKSMHGMIDMVRNGEFPEGSKVLYAHLGGVPALNAYSFLFKDG

SEQ ID NO: 18951 - protein, 435 aa, Pseudomonas syringae pv. tomato str. DC3000
MSQELRLIRRITFKLIPFLILLYLIAYVDRSAVGFAKLHMGADIGIGDAAYGLGAGLFFIGYFLFEIPSNLMLERFGARRWFARIMITWGAITIGMAFVQGPHSFYVMRFLLGAAEAGFFPGVLYYITQWFPVRHRGKILGLFILSQPIAMMITGPVSGGLLGMDGVLGLHGWQWLFIVIGTPAILLTWPVLRWLPDGPQQVKWMDQAEKDWLAGELKKDLEHYGQTRHGNPLHALKDKRVLLLALFYLPVTLSIYGLGLWLPTLIKQFGGSDLTTGFVSSVPYIFGIIGLLIVPRSSDRLNDRYGHLAVLYVLGAIGLFCSAWLTLPVAQLAALCVVAFALFSCTAVFWTLPGRFFAGASAAAGIALINSVGNLGGYIGPFVIGALKEMTGSLASGLYFLSGVMVFGLVLTGIVYHVLERKHVLPASDFAASAR

SEQ ID NO: 18952 - protein, 402 aa, Pseudomonas syringae pv. tomato str. DC3000
MATSAQPATATASTTPQTSPLVMRIIGAVALAHLINDLIQAILPSIYPMLKASYDLSFTQIGLITLTFQITASLLQPWVGYYTDRHPNPLVLPVGSICTLIGIVMMSVVGSFPLILLAAALIGIGSSTFHPEASRIARLASGGRFGLAQSTFQVGGNTGSAFGPLLAAAIIIPFGQGNVAWIGLFALFSLGLLYAISRWYRAHLNLFKLKAGQVATHGLSRKRVIASLAVLAFLVFSKFFYMTSLTSYFTFYLIEKFDLSVASSQLHLFLFLGAVAAGTFFGGPIGDRIGRKAVIWFSILGAAPFTLALPYADLFWTSVLSVIIGFVLASAFSAIVVYAQELVPGNVGMIAGIFFGLMFGFGGIGAALLGYLADSHGILFVYTLCSYLPLLGILAILLPRTK

SEQ ID NO: 18953 - protein, 314 aa, Pseudomonas syringae pv. tomato str. DC3000
MISDALGWQPTAALQRLSLPWLQHAGVEVAMLRLDRIDTLISGNKWFKLSDHLKQAVTVGAQGVISLGGAHSNHLHALAAAGKRFGFPTVGLLRGHAQQTPTVLDLQAFGMQLHWLGYTGYRARHAADFWQPWQARYPELYPIAEGGGRLAGALGCARLREMVDSQLGQMDWDDYHGWWLAAGTGTTVAGLLLAEAGAHPVYGAMAVPDDHGIAENIMAVLGEAAGSQEKAASELPAACVLLDASRGGFARTDPALLDFIASSEVQGGVFLEPLYTGKALLALHDEVLAGRFEPGTRLVFVHTGGLQGRRAMGL

SEQ ID NO: 18954 - protein, 403 aa, Pseudomonas syringae pv. tomato str. DC3000
MTQEWDAGRLDSDLEGVGFDTLAVRAGQHRTPEGEHGDPMFFTSSYVFRTAADAAARFAGEVPGNVYSRYTNPTVRSFEERIAALEGAEQAVATATGMAATLAVVMSLCSAGDHVLVSRSVFGSTISLFDKYFKRFGIEVDYVPLAELSGWNAAIKANTKMLFVESPSNPLAELVDIAALAEIAHAKGAMLIVDNCFCTPALQQPLLLGADIVVHSATKFIDGQGRCMGGVVAGRSEQMKEVVGFLRTAGPTLSPFNAWIFLKGLETLNLRMRAHCANAQALAEWLEQQDGIEKVHYAGLESHPQHELAKRQQKGFGAVVSFEVKGGKDGAWRFIDATRLISITANLGDTKTTITHPSTTSHGRLAPQEREAAGIRDSLIRVAVGLEDVADLQADLARGLAAL

SEQ ID NO: 18955 - protein, 320 aa, Pseudomonas syringae pv. tomato str. DC3000
MKALQGVEGHVEWVEEPSPALDVGQVRIKVAAAGLNRADLLQRAGMYPPPPGVTATLGLECSGVIAEVGPGTSWLVGDRVCALLAGGAMAEEVVVDGRHVLPVPEGLTLHEAAAIPEVYATAWLNLFQLAGLKPGEKVLLHAGASGVGSAGIQLCKAFGNPVWVSVGSTERLAYCVELGAQGGVVRSESLEGLNDFAPFNVILDPVGANYAELNVKLLALDGRWVLIGIMSGREAKVDLAHVLGKRIQLMGSTLRSRDETFKADLISDLGQHVWPLFTEGRLKPQLAKSFAIKDAEAAFEELATNKVSGKIVLVIDESLV

SEQ ID NO: 18956 - protein, 315 aa, Pseudomonas syringae pv. tomato str. DC3000
MRALAALSRFVGNTFAYWVLLFAILAFMFPQVFIGLKGWIVPLLGLVMFGMGLTLKLEDFSEVARNPWRVALGVVAHFVIMPGVAWLLCQVFQLPPEIAVGVILVGCCPSGTSSNVMAWLAKGDLALAVAIAAVTTLLAPLLTPTLIWLLASAWLPVSFLDMFWSILQLVMLPILLGVVAQRLLGARVRYAVDVLPLVSVVSIVMIVCAVVAASQAKIAESGLLIMAVVILHNTFGFLLGYFTGKVFKLPLAQRKSLALEVGMQNSGLGAALASAHFSPLAAVPSALFSVWHNISGALLSTYFRKMPEEENTSAR

SEQ ID NO: 18957 - protein, 324 aa, Pseudomonas syringae pv. tomato str. DC3000
MSRIYADNAHSIGNTPLVQINRIAPRGVTILAKIEGRNPGYSVKCRIGANMIWDAEASGRLKPGMTIVEPTSGNTGIGLAFVAAARGYKLMLTMPASMSIERRKVLKALGAELVLTEPAKGMKGAIAKAEELLAGDPETFFMPAQFDNPANPAIHEKTTGPEIWADTDGTIDVLVAGVGTGGTITGISRYIKHTAGKPILSVAVEPDSSPIITQAMAGEEITPAPHKIQGIGAGFIPKNLDLSIVDRVERVTDDESKAMARRLMQEEGILCGISCGAAMAAAVRLAEKPEMQGKTIVVILPDSGERYLSSMLFSDLFTDQELSQ

SEQ ID NO: 18958 - protein, 187 aa, Pseudomonas syringae pv. tomato str. DC3000
MLKKIALAACSVLFAANLMAAQDKATHVVLDTSFGQIEIELADTKAPVSTQNFLGYVDSGFYSNTIFHRVIPGFMVQGGGFTQQLVQKPTKDPIKNEAQNGLHNVRGTIAMARTSDVNSATSQFFINTNDNAMLDNGTRDFGYAVFGKVVKGMDVVDNIVNARTGNQKGMQNVPVDPILIKSAKRVN

SEQ ID NO: 18959 - protein, 285 aa, Pseudomonas syringae pv. tomato str. DC3000
MTIALKQPTLTGQCVAEFLGTALMIFFGTGCVAALKVAGATFGLWEICIIWGMAVSMGIYLSAGISGAHLNPAVSIALSLFAGFEKRKLPFYISAQIAGAFCGAGLVYLLYISLFFDFEHAHHIIRGSEQSLELASVFSTYPNPAISVGQAFLVEVVITTILMGVIMALGDDNNGLPRGALAPLLIGLLVAVIGSAMGPLTGFAMNPARDFGPKLMTFFAGWGEIAFTGGRDIPYFLVPIFAPILGACLGAAGYRALIARHLPSTVTVENEKEAPVVRGKVQASS

SEQ ID NO: 18960 - protein, 466 aa, Pseudomonas syringae pv. tomato str. DC3000
MLGYFAKSGNLFQSFPYDFDLYVIGAGSGGVRAARFSAGFGAKVAVAESRYLGGTCVNVGCVPKKLLVYGAHFADDFENSRGFGWTPGEAKFDWATLIVNKDSEINRLNDIYRNLLVNSGVTLHEGHAKIIDPHTVEVNGERHTAQNILIATGGWPQIPDIPGHEHAISSNQAFFLKELPKRVLVVGGGYIAVEFAGIFHGLGAKTTLLYRGDLFLRGFDGAVREHLQVELTRRGMDLQFNSDIERIDKQADGSLKATLKDGRQLEADCVFYATGRRPMLDNLGLENTGVKLNKKGFIEVDELYQTAEPSVLALGDVIGRVQLTPVALAEGMAIARRLFKPEQYRPVDYRMIPTAVFSQPNIGTVGMTEEDSREAGHEVVIFETRFRPMKLSLTECQERTLMKLVVDAKTDKVLGCHMVGPDAGEIVQGLAIALKSGATKRDFDETIAVHPTSAEEFVTMRTPVGS

SEQ ID NO: 18961 - protein, 368 aa, Pseudomonas syringae pv. tomato str. DC3000
MNKLFTPFDLAGTSLKNRVVMAPMTRTRTLNNIPNEANALYYAQRASAGLLITEGLPISDESRGYLYTPGIYEDVHLPGWRNVTDAVHAKGGKIFAQLWHVGRMSHISVHGIVPVSSGTVPAVDTTVYAWIEPGKAGPVQPSAPRALETEEVKRVIADFVKSARMAMDAGFDGIEIMAANGFLFDQFLSSSLNTRTDQYGGSIANRQRFLLETIDAIAAEIGGSKIGVRFSPFGRLYDFGVYEGEEETWMSMASALNERELAFVHLNYQPTILAAQTPPGFGAAFREAYKGTVMAAGGFTKEIAESELAKGELDLVAFGTAYIANPDLVERMQNNWPLAESDRATYYGVSGSIEKGYTDYPEYAAAEA

SEQ ID NO: 18962 - protein, 389 aa, Pseudomonas syringae pv. tomato str. DC3000
MKKYKSVQTLLAHASIEPEQHHGFVNTPVYRGSTVAFPTCESMREGRQKYAYGRWNNPSTEALTEALQHLEGSEGTVLCPSGLSACTTAILSVVGTGDHILIADNVYAPVRVFCEEVGKRLGIGVSFYDPTIGSGIVDFIRPNTKAIYLESPGSLTLEIQDIPAIANVAHDHDIMVIADNTWGTPLYCPTMELGVDLSIMAATKYIVGHSDAVLGTVSASKRAWESLKRYHFNMGLFASPDDVTLALRGMRTLDVRLERHYKNATIVAKWLEGREEVIAVHYPALESHPQHDLWKRDFKGASGLLSFTTKPSSQPAADALLDNLSLFAIGYSWGGFESLAMLANPKPVRSVTQWDIDGHLVRLHIGLEDPYDLIADLEVGFAHFNRLRR

SEQ ID NO: 18963 - protein, 483 aa, Pseudomonas syringae pv. tomato str. DC3000
MTVRRTKIVATLGPASNSPEVIEQLILSGLDVARLNFSHGTPDEHKARAKLIREIAARHGRFVALLGDLQGPKIRIAKFTDKRIELKVGDKFTFSTAHPLTSGNQQIVGIDYPDLVKDCGVGDELLLDDGRVVMRVDTQTAHELHCTVLIGGPLSDHKGINRRGGGLTAPALTEKDKQDIKLAAEMDLDYLAVSFPRDAADMEYARQLRDESGGTAWLVAKIERAEAVANDEVLDALIRASDAVMVARGDLGVEIGDAELVGVQKRIILHARRHNKAVIVATQMMESMISSPMPTRAEVSDVANAVLDYTDAVMLSAESAAGSYPVEAVQAMARICVGAEKHPTGKTSSHRIGHSFTRCDESIALAAMYTANHFPGVKAIIALTESGYTPLIMSRIRSSVPIYAFSPHRGTQARAAMFRGVYTVPFDPGALPPGQVSQAAVDELLKRGLVEQGDWVILTKGDSYHTIGGTNGMKILHVGDPLV

SEQ ID NO: 18964 - protein, 349 aa, Pseudomonas syringae pv. tomato str. DC3000
MTTIFDPITLGDLQLPNRIILAPLTRCRADEGRVPNALMSEYYVQRASAGLILTEATSVTPMGVGYPDTPGIWSNDQVRGWSNITQAVHNAGGRIVLQLWHVGRISHPSYLNGETPVAPSAIAAQGHVSLMRPITPLPTPRALELAEIGDIVEAYRVGAENAKAAGFDGVEVHGANGYLLEQFLLTGSNQRTDQYGGSLENRARLLLEVTDAVIDVWGAGRVGVHLSPRFDMHNMSDENRAETFSYVAKELGKRGIAFICARERDAEDSLGPQLKKDFGGVYIANEKFTKDSANAWLAEGKADAFAFGVPYIANPDLPERLASDAPLNEAHPETFYGKGPVGYIDYPRL

SEQ ID NO: 18965 - protein, 269 aa, Pseudomonas syringae pv. tomato str. DC3000
MSPDDAYAVELKGVSFKRGTRSIFNNVDIRIPRGKVTGIMGPSGCGKTTLLRLMGAQLRPSEGQVLVNGQNLPELSRSDLFDARKQMGVLFQSGALFTDLDVFENVAFPLRVHTELPEEMIRDIVLLKLQAVGLRGAVELMPDELSGGMKRRVALARAIALDPQILMYDEPFVGQDPIAMGVLVRLIRLLNDALGITSIVVSHDLSETASIADYLYVVGDGQVLGQGTPEELMSSDNPRIRQFMTGEPDGPVPFHYPAPDFREDLLGKR

SEQ ID NO: 18966 - protein, 251 aa, Pseudomonas syringae pv. tomato str. DC3000
MRRPMVAGNWKMHGTRASVAELIEGLVKQALPGSVDIAVMPASLFTSRVIEGLQGTSIIVGAQDAAIQAEQGALTGEIASSQLADAGCKLVLVGHSERRQLIGEQDEVLNKKFAAIQASGLTPVLCIGETLEERKAGQTLEVVGRQLDSVIAEFGIGALVNAVIAYEPVWAIGTGLTASPQEAQEVHAAIRAQLAKENAEVAQGVRLLYGGSVKAANAVELFSMPDIDGGLIGGASLNADEFGAICRAAGN

SEQ ID NO: 18967 - protein, 380 aa, Pseudomonas syringae pv. tomato str. DC3000
MAKRDYYEVLGVERGSSEADLKKAYRRLAMKHHPDRNPDDKASEEMFKEANEAYEVLSDASKRAAYDQYGHAGVDPSMGGGGGFGGGAGGANFSDIFGDVFSDFFGGGRGGGGGGRGGAQRGSDLRYTLELNLEEAVRGTTVNIRVPTLVNCKPCDGSGAKKGSSPVTCPTCGGIGQVRMQQGFFSVQQTCPRCHGHGKIISDPCDSCHGEGRVEESKTLSVKVPPGVDTGDRIRLSGEGEAGAQGGPTGDLYVVINVREHAIFQRDGKHLFCEVPISFTDAALGGELEVPTLDGRVKLKIPEGTQTGKQFRLRGKGVAPVRGGGAGDLMCRVAVETPVNLSKRQRELLEEFRTSLENDESHSPKASGWFEGVKRFFGDL

SEQ ID NO: 18968 - protein, 427 aa, Pseudomonas syringae pv. tomato str. DC3000 [sequence omitted]

SEQ ID NO: 18969 - protein, 455 aa, Pseudomonas syringae pv. tomato str. DC3000
MAKAKRLYGCTECGATFPKWAGQCADCGAWNTLVETMIESGAAAPPSGRTGWTGSQAQIRTLAQVSVEEIPRFSTNSAELDRVLGGGLVDGSVVLIGGDPGIGKSTILLQTLCNIAQRMPALYVTGEESQQQVAMRARRLGLPQDKLRVMTETCIETIIATAKVEKPKVMVIDSIQTIFTEQLQSAPGGVSQVRESAALLVRYAKQSGTAIFLVGHVTKEGALAGPRVLEHMVDTVLYFEGESDGRLRLLRAVKNRFGAVNELGVFGMTDKGLKEVSNPSAIFLTRAQEEVPGSVVMATWEGTRPMLVEVQALVDDSHMSNPRRVTLGLDQNRLAMLLAVLHRHGGIPTHDQDVFLNVVGGVKVLETASDLALMAAVMSSLRNRPLPHDLLVFGEVGLSGEVRPVPSGQERLKEAAKHGFKRAIVPKGNAPKEAPPGLQIIAVTRLEQALDALFE

SEQ ID NO: 18970 - protein, 431 aa, Pseudomonas syringae pv. tomato str. DC3000
MLERLFQLKAHNTNVRTEILAGVTTFLAMAYILFVNPSILGETGMDKGAVFVATCLAAAIGSTVMGLIANYPIALAPGMGLNAFFTYTVVLHMGHSWQVALGAVFISAVMFFILSIFRIREWIINSIPLPLRSAIAAGIGLFLALIALHNAGIVVSNPATIIGMGDLKQPAPVLATLGFFLIVALDHLKVRGAVLIGILAVTLVSIGLGFTPFGGVVSMPPSLAPTFMQLDIMGALDVGLVSIIFAFLFVDIFDNSGTLIGVAKRAGLMGKDGHMPKMGRALIADSTAAMAGSLLGTSTTTSYIESAAGVSAGGRTGLTAVVVAVLFLLALFFAPLAGSVPAFATAPALLFVAVLMASGLAEIDWDDITVAAPVVITALAMPFTYSIANGIAFGFISWTAIKVLSGRWRELNSALVILSILFVIKLGWFNA

SEQ ID NO: 18971 - protein, 509 aa, Pseudomonas syringae pv. tomato str. DC3000
MSLISEFRSVVAQQPDTTAVVEDQRAVSFTELAQLADKVSAGLLQAGLQPGDRVAIHLGNRLELVALYYACLEIGAVTVPINRRLVTGEIEHLLHHSGARYYIGDQETYSRYAAVIAGSATVERAWIVAGEEALKEEQYLPWSDLLVSSPSKRPPSHADSLAAIFYTSGTTGLTKGIVHSQATLAQAVDLMKAMMPPRTAQGALDTGAVHSMMDAIVPWSILMILAAHRLGRAVVLLPVLTAETTLALLQRLPLSFLKGAPSHFNNLLAAGEASAATPLPSLTSTYSVSGGDPCPPKLGRRWHNLWGGTLRGSYGTTESGPIFCQPDVAATEQSSIGWPLPGVALQQTENGELLIRSPANTPGLWNGQDADRLPAARWIATGDLVQRQDDGGYLIIGREKDMLKCDAYSISPVEVEQELLKLPDIAEAVVFGVPDATIGERPVALLRTTSGRELPTQQLKQHLKALIAEYKHPRQYLFVERIPLSSAGKVSRKQLASDYREILGAAPST

SEQ ID NO: 18972 - protein, 427 aa, Pseudomonas syringae pv. tomato str. DC3000
MSRSETLFANAQKHIPGGVNSPVRAFKSVGGTPLFFKHAAGAYVTDEDDKRYVDYVGSWGPMILGHSHPDVLDAVRNQLEHGLSYGAPTAMETEMADLVCELVPSMEMVRMVSSGTEATMSAIRLARGFTGRDSIIKFEGCYHGHSDSLLVKAGSGALTLGVPSSPGVPAAFAKHTLTVPFNDLNAVRDLLAEVGQEVACIIVEPVAGNMNCVPPAPGYLQGLRALCDEHGVVLIFDEVMTGFRVALGGAQAYYDVKPDLSTFGKIIGGGMPVGCFGGKREIMSHIAPLGPVYQAGTLSGNPLAMAAGLTTLRLISRPGFHDELSDYTRRLLEGLQQRADAAGIAFVTTQAGGMFGLYFSDASEIVTFEDVMTSDAERFKRFFHLMLEGGVYLAPSAFEAGFTSIAHGDAELKLTLDAAEKAFAALK

SEQ ID NO: 18973 - protein, 314 aa, Pseudomonas syringae pv. tomato str. DC3000
MDFKDYYKILDVEPAADDKAIKTAYRKLARKYHPDVSKEAGAEDKFKEASEAYEVLSSPEKRAEYDELRKYGRQGRPFQTPPGWQSRAGAGAGGFEETADFSEFFSSIFGGRPQQGGRTRNPGRKGQDVEMELAVFLEETLSGESKQVSFKVPQHSPNGQRMGDITKTLNVKIPAGVVDGERIRLKGQGAPGIGGGANGDLYLIIRLAPHPMFEVEGHDLVITVPLAPWEAALGTKVAVPTLTSRLNLTIRPDSQNGQRLRIKGNGLMNKSGERGDLYAQLKIVMPKQTDEAARALWQKLADSAAFDPRAQWKG

SEQ ID NO: 18974 - protein, 496 aa, Pseudomonas syringae pv. tomato str. DC3000
MFDTKPHLPDALYSAAQVRDLDARLIAAGTPGLELMQRAAHATWRAIRRRWPEANQLTVLAGRGNNAGDGYLVAALAHKAGWQVNVLAVSDPAGLTGDAASAHAAASGIDTQAWGGQPLAGVVLDALLGTGLNGEVREPFLSAINAINASGLPVAAVDIPSGLSADTGHKSGATVRADLTVTFIGLKLGLLTGDAADLVGELVFDDLQADPALVAQTPASAKRLDAHNLPYLAPRPRTAHKGLFGRVLVIGGDHGFGGAALLCAESALRSGAGMLTLATRAEHVPAALTRMPEIMSAAIRSANQLMALIEPASVLVVGPGMGQGSWGRSLLSAAANADRPQVWDADALNMLAAGQVSLPKNSVITPHPGEAARLLGVGIKDIQADRPAAVRALARKFNTVCVLKGSGSLIADADGRLALCNHGHPAMATAGLGDVLAGLIGALMAQHLTPFDAACLAVWLHASAGQKVGESGRGLAASDIIPAIRQLLEELQPCLI

SEQ ID NO: 18975 - protein, 1317 aa, Pseudomonas syringae pv. tomato str. DC3000
MATTTLGVKLDDPTRERLKAAAHSIDRTPHWLIKQAIFNYLEKLESGATLLELNGATGKDSEDRGELAEDAGLQCFLDFAESIQPQSVLRAAITSAYRRPEQEVVPMLLEQARLTAPVAEATNKLAASIAEKLRNQKSAGGRAGIVQGLLQEFSLSSQEGVALMCLAEALLRIPDKGTRDALIRDKISNGNWQPHLGNSPSLFVNAATWGLLLTGKLVATHNEAGLTSSLSRIIGKRGEPMIRKGVDMAMRLMGEQFVTGETIGEALANASRFEAKGFRYSYDMLGEAALTEHDAQKYLASYEQAIHSIGKASHGRGIYEGPGISIKLSALHPRYSRAQYERVMDELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLAAPEVIYPQFATHNAHTLAAIYQIAGQNYYPGQYEFQCLHGMGEPLYEQVVGKVADGKLNRPCRVYAPVGTHETLLAYLVRRLLENGANTSFVNRIADHSISIQELVADPVNQIERMATQEGGFGLPHPRIPLPRDLYGTERANSSGIDMANEHRLASLSSALLSTAHNDWKAAPMLGCPASEGTLAAALNPSDLRDVVGHVQEASLQDVDNAIQCALSAGPIWQATPPAERAAILERAADLMEGEIQPLMGLLVREAGKTFANAIAEVREAVDFLRYYAVQARNDFTNDAHRPLGPVVCISPWNFPLAIFSGQVAAALAAGNPVLAKPAEQTPLIAAQAVRLLLEAGIPEGVVQLLPGRGETVGAGLVGDERVKGVMFTGSTEVARLLQRNVADRLDSQGRPIPLIAETGGQNAMIVDSSALTEQVVIDVVSSAFDSAGQRCSALRVLCLQEDSADRVIEMLKGAMAESRLGNPERLSVDIGPVIDAEAKAGIEKHIQAMRDKGRTVYQVAIAESAELKRGTYVMPTLIELESFDELQREIFGPVLHVVRYKRKELGLLIDQINASGYGLTLGVHTRIDETIAKVIDNVNAGNVYVNRNIVGAVVGVQPFGGEGLSGTGPKAGGPLYLYRLLSTRPLDAIEKSFVRGDALVAPDTRLREVMSKPLQALKAWAASSQHAELDVLCGQYAEQSQSGITRQLAGPTGERNSYAILPREHVLCLADDENDLLTQLAAVLAVGSSAVWPETDISKPLFARLPKEVQARIKLVPDWAKDEVAIDAVLHHGDSDQLRAICQQIAQRSGAIVGVNGLSHGETNVPLERLVIERALSVNTAAAGGNASLMTIG

SEQ ID NO: 18976 - protein, 402 aa, Pseudomonas syringae pv. tomato str. DC3000
MADQGSPRRFARIDRLPPYVFNITAELKMAARRRGEDIIDLSMGNPDGATPPHIVEKLVTVAQREDTHGYSTSRGIPRLRRAISNWYKKRYEVDIDPESEAIVTIGSKEGLAHLMLATLDQGDTVLVPNPSYPIHIYGAVIAGAQVRSVPLVPGVDFFAELEKAIRGSIPKPKMMILGFPSNPTAQCVELDFFERVVALAKQYDVLVIHDLAYADIVYDGWKAPSIMQVPGAKDIAVEFFTLSKSYNMAGWRIGFMVGNPELVNALARIKSYHDYGTFTPLQVAAIAALEGDQQCVLDIAEQYRQRRNVLVKGLHELGWMVENPKASMYVWAKIPEAYAHLGSLEFAKKLLAEAKVCVSPGIGFGEYGDDHVRFALIENQDRIRQAVRGIRSMFRADDKLKS

SEQ ID NO: 18977 - protein, 301 aa, Pseudomonas syringae pv. tomato str. DC3000
MNSKNVGVIGLGAMGLGIARSLLRSGFTVHACDVRTSVTEAFAQEGGVACQSPASMAAACDVIITVVVNAEQTETVLFGENGAIAALRPGSLVIGCATVAPTFAVELGERLTAQNLLYLDAPISGGAAKAASGQMTMMTSGPNESYAKAEAILTGMAGKVYRLGDVHGLGSKVKIINQLLAGVHIAASAEAMALGLREGVDADALYEVITNSAGNSWMFENRVPHILNADYTPLSAVDIFVKDLGLVLDTARSSKFPLPLSATAHQMFMQASSAGFGREDDSAVIKIFPGIELPKAKPEKA

SEQ ID NO: 18978 - protein, 283 aa, Pseudomonas syringae pv. tomato str. DC3000
MTDNARLLSQHSFIELGARQRARALLDAGSFRELLGPFDRVMSPWLAMQGVVPQADDGVVVAKGTVDGLPVVIAAIEGSFQGGSMGEVGGAKMAGALELAAEDNRNGIPTAAIVLLETGGVRLQEANLGLAAIAEIHAAMVDLRQYQPVIGVVAGSVGCFGGMSIAAGLCSYLLVTQEARLGLNGPQVIEQEAGIEEYDSRDRPFIWSLTGGEQRFASDLVDGFAADDVADIRQQVSGWLKQGVPATHRSGQYALFLQRLASLDTEPQIDPQSVRTLYQGARP

SEQ ID NO: 18979 - protein, 248 aa, Corynebacterium glutamicum
MGIKVGVLGAKGRVGQTIVAAVNESDDLELVAEIGVDDDLSLLVDNGAEVVVDFTTPNAVMGNLEFCINNGISAVVGTTGFDDARLEQVRDWLEGKDNVGVLIAPNFAISAVLTMVFSKQAARFFESAEVIELHHPNKLDAPSGTAIHTAQGIAAARKEAGMDAQPDATEQALEGSRGASVDGIPVHAVRMSGMVAHEQVIFGTQGQTLTIKQDSYDRNSFAPGVLVGVRNIAQHPGLVVGLEHYLGL

SEQ ID NO: 18980 - protein, 472 aa, Pseudomonas syringae pv. tomato str. DC3000
MAERLSNDFQFIDVGRKDPKKKLLRQRKKEFVEIYEPFKPQQSADQAHRCLGCGNPYCEWKCPVHNFIPNWLKLVAEGNILAAAELSHQTNTLPEVCGRVCPQDRLCEGACTLNDGFGAVTIGSVEKYITDTAFAMGWRPDMSRVIPTGKRVAIIGAGPAGLGCADVLVRGGVTPVVFDKNPEIGGLLTFGIPEFKLEKSVLSHRREVFTGMGIEFRLNTEVGKDVTIDQLLEEYDAVFMGMGTYTYMKGGFAGEDLPGVHDALDFLIANVNRNLGFEKAPEDFVDMKGKRVVVLGGGDTAMDCNRTSIRQGAKSVTCAYRRDEENMPGSRKEVKNAKEEGVRFLYNRQPIAIVGEGKVEGVKVVETRLGEPDARGRRSPEPIPGSEEIIPADAVVIAFGFRPSPAPWFEQFTISTDSQGRVVAPEQAQYKHQTSNPKIFAGGDMVRGSDLVVTAIFEGRNAAEGIMDYLGV

SEQ ID NO: 18981 - protein, 130 aa, Pseudomonas syringae pv. tomato str. DC3000
MKDWLDEIHWNSDGLVPAIAQDRKTGRVLMMAWMNREALSLTASENRAIYWSRSRGKLWRKGEESGHVQKLHELRLDCDADVIILMVEQIGGIACHTGRESCFYRVYEQSGWKTVDPVLKDPDAIYPAGH

SEQ ID NO: 18982 - protein, 332 aa, Pseudomonas syringae pv. tomato str. DC3000
MIKNQLARFNRLDLISAPTALEKLERLSLWADRDIYIKRDDTTTLALGGNKVRKLEYLAADALAQGADTLITAGAIQSNHVRQTAALAARLGLGCVALLENPIGTEDPSYLKNGNRLLLELFDAKVELVENLDNADDQLHALAARLRSSGKKPYLVPIGGSSPVGALGYVRAGLELAEQIKQTGIDFAAVVLASGSAGTHSGLALALAHELPQLPVVGVTVSRSEEAQLPKVQGLAERTAQLLDIALPEHFKVELWDEYFAPRYGEPNAGTLAAIKLVASQEGLLLDPVYTGKAMSGLLDGIGRQRFNDGPLIFLHTGGAPALFAYPDAFDQ

SEQ ID NO: 18983 - protein, 247 aa, Pseudomonas syringae pv. tomato str. DC3000
MIVVEKLTKEFKGNQVLKGIDLRIEAGEVVAIIGPSGSGKTTLLRCLNLLETPTSGRIKVGDIEIDGTRSIGQQQGLIRQLRQQVGFVFQNFNLFPHRTALENVIEGPVVVKKIAREAAEALGRQLLAKVGLTGKEDAYPRRLSGGQQQRVAIARALAMEPQVILFDEPTSALDPELVGEVLTTIRALAEENRTMVIVTHEMSFAREVANRVIFIDKGVIVEQGEAKALFANPQEERTRQFLERTRS

SEQ ID NO: 18984 - protein, 449 aa, Pseudomonas syringae pv. tomato str. DC3000
MFGFFRPARHQAPLPEEKVDSTYRRLRWQIFAGIFIGYAGYYLLRKNFSLAMPYLIDEGYTRGQLGVAMSAIAIAYGLSKFLMGIISDRSNPRYFLPFGLLVSAGIMFIFGFAPWATSSVTIMFVLLFINGWAQGMGWPPSGRTMVHWWSQKERGGVVSVWNVAHNVGGGLIGPLFLLGMGWTNDWHAAFYVPAAVALLVAVFAFATMRDTPQSVGLPPIEHYKNDYPEGYDESHEEEFSAREIFVKYVLRNKFLWYIAMANVFVYLLRYGVLDWAPTYLKEAKHFTVDKTSWAYFLYEWAGIPGTLLCGWMSDKIFKGNRGLTGMVFMFLVTIATLVYWLNPEGNPTVDMIALVSIGFLIYGPVMLIGLQALELAPKKAAGTAAGFTGLFGYLGGSVAASAAMGYTVDHFGWDGGFVLLIGACILAMVFLAPTLRHKQVASTSRDIKR

SEQ ID NO: 18985 - protein, 244 aa, Pseudomonas syringae pv. tomato str. DC3000
MPLLRISALHKYYGDHHVLKGIDLSVEEGQVVAIIGRSGSGKSTLLRTLNGLESINDGVIEVDGEYLDAARADLRTLRQKVGMVFQQFNLFPHLSVGENVMLAPQVVQKVPKAEAAKLARTMLERVGLGEKFDAYPDRLSGGQQQRVAIARALAMSPKVLLCDEITSALDPELVNEVLSVVRQLAADGMTLIMVTHEMRFAREVGDKLVFMHQGKVHEVGDPKVLFANPKTPELANFIGTTEQA

SEQ ID NO: 18986 - protein, 458 aa, Pseudomonas syringae pv. tomato str. DC3000
MTSQDGLKRGLSARHIRFMALGSAIGTGLFYGSASAIQQAGPAVLLAYLIGGAAVYMVMRALGEMAVHDPVSGSFSHYATRYMGPLAGFVLGWTYAFEMIIVCLADVTAFGIYMGFWFPEVPRWIWVLGIVFLIGALNLCNVKVFGETEFWLSILKVSAIVAMIVAGFGIMIFGIGSSTSGTEIGISNLWAHGGFMPNGVTGLIASFAVVMFAFGGIEIIGITAGEAKDPQRSLPQAINAVPLRILLFYVLTLFVLMCIYPWPQIGTQGSPFVQIFDNLGIASAATILNIVVISAAVSAINSDIFGAGRMMYGLARDGQAPASFARLSRQGVPWMTVLVMGVTLLGGVLLNYLIPKDVFLLIASLATFATVWVWLMILLTQVAMRRSMSREEVTQLKFAVPFWPYGPAAAIAFMLFIFGVLGYFPDNRAALIVGAIWIALLLIAYGLWVKPKALNKTH

SEQ ID NO: 18987 - protein, 458 aa, Pseudomonas syringae pv. tomato str. DC3000
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHEIEGDPFFADPREVLRQVVAKFDEMGLTICAAFELEFYLIDQENVNGRPQPPRSPISGKRPHSTQVYLIDDLDEYVDCLQDILEGAKEQGIPADAIVKESAPAQFEVNLHHVADAIKACDYAVLLKRLIKNIAYDHEMDTTFMAKPYPGQAGNGLHVHISILDRDGKNIFTSEDPEQNAALRHAIGGVLETLPAQMAFLCPNVNSYRRFGAQFYVPNSPTWGLDNRTVAVRVPTGSADAVRIEHRVAGADANPYLVMASVLAGVHHGLVNKIEPGAPVEGNSYEQHEQSLPNNLRDALRELDDNPVMAKYIDPKYIDIFVACKESELEEFEHSISDLEYNWYLHTV

SEQ ID NO: 18988 - protein, 463 aa, Pseudomonas syringae pv. tomato str. DC3000
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPDIAIWMFTLVITLLLTATNLFSVKNYGEFEFWFALIKVVAIIAFVVLGVAAIFGLLPTSSVSGVSHLFDTGGFLPNGMGAVLAAMLTTMFSFMGTEIVTIAAAESRNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPALSKRTSKGGTPYWAVIMSTAAAFLTVFANYVAPAAVFDFLLASSGAIALLVYLVIAVSQLRMRQKRIAAGETIDFKMWLFPWLTWAAIAFIVAVLTIMLIQQEHRVEIIATGVLSLLVIGAGLIVSRRRKAGPVGAAALG

SEQ ID NO: 18989 - protein, 257 aa, Pseudomonas syringae pv. tomato str. DC3000
MAEATPALEIRNLHKRYDQLEVLKGISLTARDGDVISILGSSGSGKSTLLRCINLLENPHQGQILVAGEELKLKAARNGDLIAADNRQINRLRSQIGFVFQNFNLWPHMSVLDNIIEAPRRVLGQSKAQAIEVAEALLAKVGIADKRHAYPAQLSGGQQQRAAIARTLAMQPKVILFDEPTSALDPEMVQEVLGVIRALAEEGRTMLLVTHEMNFARQVSSEVVFLHQGMVEEQGTPQQVFENPLSARCKQFMSSHR

SEQ ID NO: 18990 - protein, 393 aa, Pseudomonas syringae pv. tomato str. DC3000
MSGEASFNWIDPLLLDQQLSEEERMVRDTAEQFAQGKLAPRVLEAFRHEKTDPDIFREMGEVGLLGATIPEEFGGSGLNYVCYGLIAREVERVDSGYRSMMSVQSSLVMVPINEFGTQAQKEKYLPKLASGEWIGCFGLTEPNHGSDPGAMITRARSVEGGYRLSGSKMWITNSPIADVFVVWAKDDAGDIRGFVLEKGWAGLSAPVIHGKVGLRASITGEIVMDNVFVPEENIFPDVRGLKGPFTCLNSARYGISWGALGAAEFCWHTARQYTLDRQQFGRPLAANQLIQKKLADMQTEITLALQGCLRLGRMKDEGIAAVEITSIMKRNSCGKSLDIARMARDMLGGNGISDEFGIARHLVNLEVVNTYEGTHDVHALILGRAQTGIQAFY

SEQ ID NO: 18991 - protein, 382 aa, Pseudomonas syringae pv. tomato str. DC3000
MSAPVVIVGTGLAGYNLAREFRKLDADTPLLLITADDGRSYSKPMLSTGFGKNKEADGLSMAEPGAMADQLKAEIRTHTRISGVDPGHKRLWIGEEAVYYRDLVLAWGAETIRVPVEGDASDAVFPINDLQDYARFRAAAAGKRRVLILGAGLIGCEFANDLMLGGYEVDLVAPCEQVMPTLLPPAAAAAVKAGLESLGARFHLGPLLTRLQRADEALQAHLSDGQVIDCDVVVSAIGLRPRIDLAAAAGLQTGRGILADRQLQTSHANIYALGDCAEVDGLNLLYVMPLMSCARALAQTLAGTPTAVKYGPMPITVKTPACPLVVSPPPRGTDGQWSIEGQGADIKALCHDTGGNLMGYALTGTAVMEKLALNKVLPALLA

SEQ ID NO: 18992 - protein, 357 aa, Populus deltoides
MGSLETERKIVGWAATDSTGHLAPYTYSLRDTGPEDVFIKVISCGVCHTDIHQIKNDLGMSHYPMVPGHEVVGEVVEVGSDVTRFKVGDVVGVGVIVGSCKNCHPCKSEIEQYCNKKIWSYNDVYTDGKPTQGGFAESMVVHQKFVVRIPDGMSPEQAAPLLCAGLTVYSPLKHFGLKQSGLRGGILGLGGVGHMGVKIAKAMGHHVTVISSSDKKREEAMEHLGADEYLVSSDVESMQKAADQLDYIIDTVPVVHPLEPYLSLLKLDGKLILMGVINAPLQFVTPMVMLGRKSITGSFIGSMKETEEMLEFCKEKGVASMIEVIKMDYINTAFERLEKNDVRYRFVVDVAGSKLIH

SEQ ID NO: 18993 - protein, 281 aa, uncultured bacterium
MSQTSTLKGQCIAEFLGTGLLIFFGVGCVAALKVAGATFGQWEISIIWGLGVAMAIYLTAGVSGAHLNPAVTIALWLFACFDKRKVVPFIISQIAGAFCAAALVYGLYYNLFIDFEQTNHIVRGSTESLGLAGTFSTYPNPHINFVQAFAVEMVITAILMGLILALTDDGNGVPRGPLAPLLIGLLIAVIGASMGPLTGFAMNPARDFGPKLFAWMAGWGEIAFTGGRDIPYFLVPVFGPITGAILGAWAYRKLIGRHLPCDVCAIEEKDAAANTQQKASL

SEQ ID NO: 18994 - protein, 108 aa, uncultured bacterium
MKLNRPERIDGRVPVLSAADAIYYIPDEATLCVLGAGGGILEATTLISALADKYKNNQSPRNLSLISPTGLGDRADRGISPLAQEGLVKWALCGHWGQSPRITRCVCR

SEQ ID NO: 18995 - protein, 468 aa, Neurospora crassa
MAPISRETDFLVIGGGSGGIATARAAAGKYGIKSMVVEGKRLGGTCVNVGCVPKKVTFYAALVAETIHQAKDYGFSVEQTAPFDWPTFKQKRDAYVARLNGIYERNLANDKVEYVHGWAKLLSPNSVEVTLDDGTKSVVNAKKILIAVGGNPTIPPHIPGSEYGTNSDGFFDIDTLPKKVALVGAGYIAVEFAGMLNALGVETHLFIRHDTFLRSFDPMIQQVSVKEYERIGVKVHKKSQLTSVQKDAAGKLAINFKEGEGEQSISDVDHLIWAVGRTPAVEGLGLDKAGVKTNEKGYIEVDEYQNTSTENIYAVGDVCGQVELTPVAIAAGRKLAARLFGPEEFRTLKLNYDNVPSVVFAHPEIGSIGLTEPEAVAKYGAENLKIYKSSFTAMYYAMMKPEDKAPTAYKLICAGPEEKVVGLHIIGLGSGEILQGFGVAVNMGATKADFDNCVAIHPTSAEELVTLK

SEQ ID NO: 18996 - protein, 297 aa, Streptomyces lividans
MDLTGRRAVVTGGASGLGAETVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFDFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDVQPGGVAAHALDPEAADRLWEYGADTLSAG

SEQ ID NO: 18997 - protein, 398 aa, Citrobacter freundii
MSDCRTYGFNTQIVHAGQQPDPSTGALSTPIFQTSTFVFDSAEQGAARFALEESGYIYTRLGNPTTDALEKKLAVLERGEAGLATASGISAITTTLLTLCQQGDHIVSASAIYGCTHAFLSHSMPKFGINVRLVDAGKPEEIRAAMRPETKVVYIETPANPTLSLVDIETVAGIAHQQGALLVVDNTFMSPYCQQPLQLGADIVVHSVTKYINGHGDVIGGIIVGKQEFIDQARFVGLKDITGGCMSPFNAWLTLRGVKTLGIRMERHCENALKIARFLEGHPSITRVYYPGLSSHPQYELGQRQMSLPGGIISFEIAGGLEAGRRMINSVELCLLAVSLGDTETLIQHPASMTHSPVAPEERLKAGITDGLIRLSVGLEDPEDIINDLEHAIRKATF

SEQ ID NO: 18998 - protein, 354 aa, Thinopyrum ponticum x Triticum aestivum
MDGNKGPVVVTGASGFVGSWLVMKLLQAGYTVRATVRDPANVEKNKPLLELPGAKERLSIWKADLSDEGSFDDAIAGCTGVFHVATPMDFDSKDPENEVIKPTVEGMLSIMRACKEAGTVKRIVFTSSAGSVNIEERQRPAYDQDNWSDIDFCRRVKMTGWMYFVSKSLAEKAAMEYASENGLDFISIIPTLVVGPFLSAGMPPSLVTALALITGNEAHYSILKQVQLVHLDDLCDAMTFLFEHPEANGCYICSSHDATIHGLARMLRDRFPEHSIPHKFAGVDDDLQPIHFSSKKLLDHGFSFRYTAEDMFDAAIRTCREKGLIPLGDAPAPAAAGKLGALAAGKGQAIGAET

SEQ ID NO: 18999 - protein, 180 aa, Streptococcus pyogenes SSI-1
MLEQDIQKILYSENDIIRKTKKLGEQLTKDYQEKNPLMIGVLKGSVPFMAELMKHIDTHVEIDFMVVSSYHGGTSSSGEVKILKDVDTNIEGRDIIIVEDIIDTGRTLKYLRDMFKYRKANTIKIATLFDKPEGRVVKIEADYVCYNIPNEFIVGFGLDYAENYRNLPYVGVLKEEVYSK

SEQ ID NO: 19000 - protein, 282 aa, Streptococcus pyogenes SSI-1
MGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADIVVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVVPVVEKVPVDTAPEVFDEMERGLIQGRKVLDFIS

SEQ ID NO: 19001 - protein, 212 aa, Streptococcus pyogenes SSI-1
MNLLIMGLPGAGKGTQAAKIVEEFGVAHISTGDMFRAAMANQTEMGRLAKSYIDKGELVPDEVTNGIVKERLAEDDIAEKGFLLDGYPRTIEQAHALDATLEELGLRLDGVINIKVDPSCLVERLSGRIINRKTGETFHKVFNPPVDYKEEDYYQREDDKPETVKRRLDVNMAQGEPILEHYRKLGLVTDIEGNQEITDVFADVEKALLELK

SEQ ID NO: 19002 - protein, 219 aa, Streptococcus pyogenes SSI-1
MKENKRIAIAEAISHIKDGDTIMVGGFMANGTPEALIDALVDKGTKDLTLICNDAGFVDRGVGKMVANHQFKTIYATHIGLNKEAGRQMTAGETTIELIPQGTFAEKIRIGAYGIGGFYTPTGVGTLVAEGKETKTIKGKTYLLEYPFEADVALIFANKADEMGNLQYSGSENNFNQLMAACAKTTIVQAREIVPVGTIQPECVHTPHIFVDYIVKEGV

SEQ ID NO: 19003 - protein, 449 aa, Streptococcus pyogenes SSI-1
MSHITFDYSKVLESFAGQHEIDFLQGQVTEADKLLREGTGPGSDFLGWLDLPENYDEEEFARILTAAEKIKSDSEVLVVIGIGGSYLGAKAAIDFLNHHFANLQTAKERKAPQILYAGNSISSTYLADLVEYVQDKEFSVNVISKSGTTTEPAIAFRVFKELLVKKYGQEEASKRIYATTDKVKGAVKVEADANNWETFVVPDNVGGRFSVLTAVGLLPIAASGADITALMEGANAARKDLSSDKISENIAYQYAAVRNLLYRKGYITEILANYEPSLQYFGEWWKQLAGESEGKDQKGIYPTSANFSTDLHSLGQFIQEGYRNLFETVIRVDNPRKNVIIPELAEDLDGLGYLQGKDVDFVNKKATDGVLLAHTDGGVPNMFVTLPAQDEFTLGYTIYFFELAIAVSGYMNAVNPFDQPGVEAYKRNMFALLGKPGFEALSAELNARL

SEQ ID NO: 19004 - protein, 453 aa, Streptococcus pyogenes SSI-1
MAKKKATFICQECGYQSPKYLGRCPNCSAWSSFVEEVEVKEVKNARVSLAGEKSRPVKLKDVDNISYHRTQTDMSEFNRVLGGGVVPGSLILIGGDPGIGKSTLLLQVSTQLANKGTVLYASGEESAEQIKLRSERLGDIDNEFYLYAETNMQAIRTEIENIKPDFLIIDSIQTIMSPDITGVQGSVSQVREVTAELMQLAKTNNIATFIVGHVTKEGTLAGPRMLEHMVDTVLYFEGERHHTFRILRAVKNRFGSTNEIGIFEMQSGGLVEVLNPSQVFLEERLDGATGSAVVVTMEGSRPILAEVQSLVTPTVFGNARRTTTGLDFNRVSLIMAVLEKRCGLLLQNQDAYLKSAGGVKLDEPAIDLAVAVAIASSYKEKPTSPQEAFLGEIGLTGEIRRVTRIEQRINEAAKLGFTKVYAPKNALQGIDISQGIEVVGVTTVGQVLKAVFS

SEQ ID NO: 19005 - protein, 220 aa, Streptococcus pyogenes SSI-1
MSTLKIAPSILAADYANFASELARIEETDAEYVHIDIMDGQFVPNISFGADVVASMRKHSKLVFDCHLMVVDPERYVEAFAQAGADIMTIHTESTRHIHGALQKIKAAGMKAGVVINPGTPATALEPLLDLVDQVLIMTVNPGFGGQAFIPECLEKVATVAKWRDEKGLSFDIEVDGGVDNKTIRACYEAGANVFVAGSYLFKASDLVSQVQTLRTALHD

SEQ ID NO: 19006 - protein, 246 aa, Streptococcus pyogenes SSI-1
MSNSIIEIKNLKKSYGSNEVLKDISLSVNKGEVISIIGSSGSGKSTLLRSINLLEEPSAGQILFHGEDVLAEHYNLTHYREKLGMVFQSFNLFENLNVLENAIVAQTTVLKRDRAQAEQIAKENLNAVGMTEQYWQAKPKQLSGGQKQRVAIARALSVNPEAMLFDEPTSALDPEMVGEVLKTMQDLAKSGLTMIIVTHEMEFARDVSDRIIFMDKGLIAEEGSSQQIFENPTQDRTKEFLQRFLK

SEQ ID NO: 19007 - protein, 398 aa, Streptococcus pyogenes SSI-1
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGSKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 19008 - protein, 448 aa, Streptococcus pyogenes SSI-1
MAITVADIRREVKEKNVTFLRLMFTDIMGVMKNVEIPATKEQLDKVLSNKVMFDGSSIEGFVRINESDMYLYPDLDTWIVFPWGDENGAVAGLICDIYTAEGKPFAGDPRGNLKRALKHMNEIGYKSFNLGPEPEFFLFKMDDKGNPTLEVNDNGGYFDLAPIDLADNTRREIVNILTKMGFEVEASHHEVAVGQHEIDFKYADVLKACDNIQIFKLVVKTIAREHGLYATFMAKPKFGIAGSGMHCNMSLFDNQGNNAFYDETDKRGMQLSEDAYYFLGGLMKHAYNYTAITNPTVNSYKRLVPGYEAPVYVAWAGSNRSPLIRVPASRGMGTRLELRSVDPTANPYLALAVLLEAGLDGIINKIEAPEPIEANIYTMTMEERNEAGIIDLPSTLHNALKALQKDDVVQKALGYHIYTNFLEAKRIEWSSYATFISQWEIDHYIHNY

SEQ ID NO: 19009 - protein, 378 aa, Streptococcus pyogenes SSI-1
MNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYNLDISFTQAALGDTVEIPTVHGDVEMAIPAGTQTGKTFRLKGKGAPKLRGGGQGDQHVTVNIVTPTKLNDAQREALQAFAEASGEKMLHPKKKGFFDKVKDALEDI

SEQ ID NO: 19010 - protein, 288 aa, Streptococcus pyogenes SSI-1
MALFRKKDKYIRITPNNSLKGSVSHNVPEVPDELFAKCPACKHMIYKKDLGLAKICPTCSYNFRISAQERLTLTVDEGSFQELFISIETKDPLRFPGYQEKLQKAKETTGLHEAVLTGKAMVKGQQIALAIMDSHFIMASMGTVVGEKITRLFELAIEENLPVVIFTASGGARMQEGIMSLMQMAKVSAAVKRHSNAGLFYLTILTDPTTGGVTASFAMEGDIILAEPQSLVGFAGRRVIETTVRENLPDDFQKAEFLQDHGFVDAIVKRTELRDKIAHLVAFHGGGQ

SEQ ID NO: 19011 - protein, 486 aa, Streptococcus pyogenes SSI-1
MEKFFKLSENGATVSTEIMAGLTTFFAMSYILFVNPSILGAAGMPSNAVFLATIIAAAISTLIMGLFANVPYALAPGMGLNAFFTYTVVFALGFSWQEALAMVFICGLFNIFITVTKFRKSIIKAIPVSLQHAIGGGIGVFVAYLGFKNANIITFSISAENIVMVNGVEPAKASAKTFADGLLFVDANGGVVPTISSFTDSSVLLAIFGLLLTTALVIRNFRGAILIGIVATTLVGIPLGIVDVSNLNFGIGHIGEAWTELGTTFLAAFDGLSSLFSDSSRLPLVFMTIFAFSLSDTFDTIGTFIGTGRRTGIFSQDDENALENSIGFSSKMDRALFADAIGTSIGALVGTSNTTTYVESAAGIAEGGRTGLTAVSTAVCFLLSILLLPLVGIVPAAATAPALIVVGVMMVSSFLDVNWSKFADALPAFFAAFFMALCYSISYGIAAAFIFYCLVKVVEGKTKDIHPIIWGATFLFIVNFIILTIL

SEQ ID NO: 19012 - protein, 233 aa, Streptococcus pyogenes SSI-1
MDIFGEFLGTVLLVLLGNGVVAGVVLPKTKTHASGWIVIASGWGIAVAVAVFISGKVAPAHLNPAVSLAFAMSGTIAWSTAIAYSLAQLLGAMLGSTLVFLQFRPHYLAAESQADILGTFATDPAIRDTSSNLLSEIFGTFVLMLGILAFGLYDMPAGLGTLCVGTLVIGIGLSLGGTTGYAINPARDLGPRLVHAILPLNNKGDSDWSYAWIPVVGPIIGAALAVLLFQVMS

SEQ ID NO: 19013 - protein, 248 aa, Streptococcus pyogenes SSI-1
MMITIRNLSKTFSGQKVLDSLALDIEKGQVIALVGASGAGKSTFLRSLNYLEKPDSGSISIGDFTVDFETITTEQVLILRRKLAMVFQQFNLFERRTALENIKEGLKVVKKLSDQEATKLAQAELTKVGLADRKHHYPRHLSGGQKQRVALARALAMKPDVLLLDEPTSALDPELVGEVEKSITDAAKSGQTMVLVSHDMNFVYQVADRVLFLDQGKILEQGTPEEVFRHPQKERTKEFFASYSKTYI

SEQ ID NO: 19014 - protein, 463 aa, Streptococcus pyogenes SSI-1
MEFRMSIKEQTDNNELENGMVRGLENRHVQLIAIAGTIGTGLFLGAGRSIALTGPSIIFVYMITGAFMFMMMRAIGEMLYYDPDQHTFINFISKYIGPGWGYFSGLSYWISLIFIGMAEITAVGAYVQFWFPSWPAWLIQLVFLVLLSSINLIAVRVFGETEFWFAMIKILAILALIATAIFMVLTGFETHTGHASLSNIFDHFSMFPNGKLKFFMAFQMVFFAYQAIEFVGITTSETANPRKVLPKAIQEIPTRIVIFYVGALVSIMAIVPWHQLPVDESPFVMVFKLIGIKWAAALINFVVLTSAASALNSTLYSTGRHLYQIANETPNALTNRLKINTLSRQGVPSRAIIASAVVVGISALINILPGVADAFSLITASSSGVYIAIYALTMIAHWKYRQSKDFMADGYLMPKYKVTTPLTLAFFAFVFISLFLQESTYIGAIGATIWIIVFGIYSNVKFK

SEQ ID NO: 19015 - protein, 486 aa, Streptococcus pyogenes SSI-1
MYKDDSLTLHTDLYQINMMQVYFEQGIHNRHAVFEVYFRKEPFNNGYAVFAGLQRMVEYLEQFQFSETDLAYLEELGYPENFLTYLKELRLELTIRSAKEGDLVFANEPIVQVEGPLGQCQLVETALLNIVNFQTLIATKAARIRSVIEDEPLLEFGTRRAQELDAAIWGTRAAIIGGADATSNVRAGKRFGIPVSGTHAHALVQAYGNDYDAFMAYAKTHKDCVFLVDTYDTLKVGVPTAIRVAKEMGDKINFLGVRLDSGDLAYLSKTVRQQLDDAGFTEAKIYASNDLDENTILNLKMQKAKIDVWGVGTKLITAYDQPALGAVYKIVSIEQEDGSMRDTIKLSNNAEKVSTPGKKQVWRITSREKGKSEGDYITFTDINVNELTEIEMFHPTYTYIKKTVRNFDAIPLLVDIFVKGELVYQLPTLSEIKTYAKKEFDKLWDEYKRVLNPQDYPVDLARDVWQNKMALIDNICKDTHGKSDLK

SEQ ID NO: 19016 - protein, 196 aa, Streptococcus pyogenes SSI-1
MVGGFMTNGTPEKLIDALVEKGVKGLTLICNDAGFPDKGVGKMVANKQFSTIIASHIGLNREAGRQMTEGETVIDLVPQGTLAERIRSGGFGLGGFLTPTGIGTEVAKGKEVITIDGKEYLLETPLKADVALIFANKADKNGNLQYAGSENNFNHVMAANAKTTIVEAREIVDVGQMDPNFVHTPGIFVNYLVKGA

SEQ ID NO: 19017 - protein, 313 aa, Streptococcus pyogenes SSI-1
MTKIYKTITELVGQTPIIKLNRLIPNEAADVYVKLEAFNPGSSVKDRIALSMIEAAEAEGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKANPETVIYAVEAEESAVLSGQEPGPHKIQGISAGFIPNTLDTKAYDQIIRVKSKDALETARLTGAKEGFLAGISSGAALYAAIEVAKQLGKGKHVLTILPDNGERYLSTELYDVPVIKTK

SEQ ID NO: 19018 - protein, 480 aa, Streptococcus pyogenes SSI-1
MLAFPKEFWWGGATSGPQSEGRFAKQHRNLFDYWYEEEPDLFYDYVGPDTASDAYHQIESDLALLASLGHNSYRTSIQWTRLIDDFEQATINPDGLAYYNRVINACLANGIRPVINLHHFDLPIALYQAYGGWESKHVVDIFVAFSKVCFEQFGDRVKDWFVHNEPMVVVEGSYLMQFHYPAIVDGKKAVQVAYNLALATAKVIQAYRRGPAELSNGRIGTILNLTPAYPASQSEADMAAAHFTELWNNDLFMEAAVHGKFPEELVAVLKKDGVLWQSTPEELALIAENRVDYLGLNFYHPKRVKAPDVIPVISPSWSPEWYYDPYLMPGRRMNVDKGWEIYPEAVYDIAIKMRDHYDNIPWFLSENGVGISGEERYRDETGQIQDDYRIQFLKEHLTYLHKGIEAGSNCFGYHVWTPIDGWSWLNAYKNRYGLVENNIHTQVRRPKASAYWFKKVATHNRLISLEVMEEFGGSASHLSD

SEQ ID NO: 19019 - protein, 245 aa, Streptococcus pyogenes SSI-1
MMTEAIISIKDLHKYYGHNEVLKGIDLDIMPGEVVVIIGPSGSGKSTLLRTMNLLEVPTKGQIRFEGIDITDKKNDIFSMREKMGMVFQQFNLFPNMTVLENITLSPIKTKGMAKAEADKTALSLLDKVGLSEKAKAYPASLSGGQQQRIAIARGLAMDPDVLLFDEPTSALDPEMVGEVLAVMQDLAKSGMTMVIVTHEMGFAKEVADRVIFMDGGVIVEEGSPNQLFDLTKEERTKDFLSRVL

SEQ ID NO: 19020 - protein, 231 aa, Streptococcus pyogenes SSI-1
MVKLVFARHGESEWNKANLFTGWADVDLSEKGTQQAIDAGKLIKEAGIEFDLAFTSVLTRAIKTTNLALENAGQLWVPTEKSWRLNERHYGALTGKNKAEAAEQFGDEQVHIWRRSYDVLPPAMAKDDEYSAHKDRRYADLDPALIPDAENLKVTLERAMPYWEEKIAPALLDGKNVFVGAHGNSIRALVKHIKGLSDDEIMDVEIPNFPPLVFELDEKLNIVKEYYLGGE

SEQ ID NO: 19021 - protein, 406 aa, Streptococcus pyogenes SSI-1
MSTLSLDTTNKRALVAAIAASGTDDLNVMFLAFSMSSIMTDLGLSGTQGGWIATITNLGMLVGGLLFGLLADRHHKFKVFKWTILLFSVATGLIYFTQSLPYLYLMRFIAGIGVGGEYGVAIAIMAGIVPPEKMGRMSSLNGIAGQLGSISSALLAGWLAPSLGWRGLFLFGLLPILLVIWMTLAIDDQKIWDHYGQEEEECSQPIKINELFKTKSLTAQTLALMVMTTVQIAGYFGMMNWLPTIIQTSLNLSVKSSSLWMVATIVGMCLGMLCFGQLLDCFGPRLIYSLFLLASSICVYLFQFANSMASMVIGGAIVGFFVNGMFAGYGAMITRLYPHHIRSTANNVILNVGRALGGFSSVAIGSILDASGISMVMIFLASLYVISFGAMWTIGQLKAERYQQLR

SEQ ID NO: 19022 - protein, 466 aa, Streptococcus pyogenes SSI-1
MKQRKHRYQFPDGFLWGSSTSGPQSEGTVPGDGKGPSNWDYWFSIESAKFHHQIGPEKTSTFYENYKGDIALLKETGHTIFRTSIQWSRLIPEGVGEVNPKAVTFYREVFQDIIAQGIKLIVNLYHFDLPYALQEKGGWENKATVWAYETYAKTCFELFGDLVNTWITFNEPIVPVECGYLGYYHYPCKVDAKAAVQVAYNTQLASSLAVKACHKLHPDHKISIVLNMTPAYPRSDAPEDVKAARIAELFQTKSFLDPSVLGVYPAELVSILEEADLLPQYSADELEIIKNNTVDFLGVNYYQPLRVQAPSKSQQEGDPLILDIYFEPYDMPGKKVNPHRGWEIYEPGLYDIALNLKEHYGNIEWLVTENGMGVEGEEAFLADGQIQDDYRITFIEDHLIQLHKALGEGANCKGYLLWTFIDCWSWLNAYKNRYGLVALDLESQKRTIKKSGYWFKALSESNGFDK

SEQ ID NO: 19023 - protein, 246 aa, Streptococcus pyogenes SSI-1
MTELKIDVQDLHKSYGQNEVLKGIDAKFYEGDVVCIIGPSGSGKSTFLRTLNLLETITSGKVMVDGFELSDPKTNIDKARENIGMVFQHFNLFPHMTVLENIIFAPVELGKESKEVAKKHGMALLEKVGLSDKADAFPGSLSGGQKQRVAIARSLAMNPDIMLFDEPTSALDPEMVGDVLNVMKDLAEQGMTMLIVTHEMGFARQVANRVIFTDGGQFLEDGTPEEIFDHPKHPRLIEFLDKVLNV

SEQ ID NO: 19024 - protein, 384 aa, Streptococcus pyogenes SSI-1
MTKPIITFNNVSKTFEDSGTQVLKNINFDLEEGKFYTLLGASGSGKSTILNIMAGLLDASSGDIYLDGERINDLPINKRDIHTVFQNYALFPHMTVFENVAFALKLKKVDKKEIAKRVKETLKMVQLEGYENRSIQKLSGGQRQRVAIARAIINQPRVVLLDEPLSALDLKLRTEMQYELRELQQRLGITFVFVTHDQEEALAMSDWVFVMNEGEIVQSGTPVDIYDEPINHFVANFIGESNIINGTMIEDYLVSFNGKEFESVDGGMRPNEPVEVVIRPEDLQITLPEEGKLQVKVDTQLFRGVHYEIIAYDELGNEWMIHSTRKAIEGEVIGLDFTPEDLHIMRLNETEEEFDARIEEYVEMDEPEDGLINAIEEERNEENL

SEQ ID NO: 19025 - protein, 242 aa, Streptococcus pyogenes SSI-1
MIRFNNVSKTFGQTKVLQEQTFQINDREFFVLVGPSGSGKTTLLKMINCLIEPSSGDILLNNVPQKELDLREMRLSIGYVLQQIALFPNLTVAENIAIIPEMKQWSAEEIRQKTEELLDKVGLPAKDYLDRYPSDLSGGEQQRIGIVRAIISHPKILLMDEPFSALDPISRKQLQELMLSLHKEFDMTIVFVTHDIDEAIKLGDRVAILNEGEIVQLDRPEMIKTHPANAFVANLFGGDEHA

SEQ ID NO: 19026 - protein, 327 aa, Streptococcus pyogenes SSI-1
MFNDIPVFDYEDIQLIPNKCIITSRSQADTSVTLGKYQFKLPVIPANMQTIIDETIAEQLAKEGYFYIMHRFDEDSRKPFIKRMHEQGLIASISVGVKACEYEFVTSLKEDAPEFITIDIAHGHANSVIDMIKHIKTELPETFVIAGNVGTPEAVRELENAGADATKVGIGPGKVCITKVKTGFGTGGWQLAALRWCAKAARKPIIADGGIRTHGDIAKSIRFGASMVMIGSLFAGHIESPGKTVEVDGETFKEYYGSASEYQKGEHKNVEGKKILLPTKGHLSDTLTEMQQDLQSSISYAGGKDLDSLRHVDYVIVKNSIWNGDSI

SEQ ID NO: 19027 - protein, 456 aa, Streptococcus pyogenes SSI-1
MSKIVVVGANHAGTACIKTMLTNYGDANEIVVFDQNSNISFLGCGMALWIGEQIAGPEGLFYSDKEELESLGAKVYMESPVQSIDYDAKTVTALVDGKNHVETYDKLIFATGSQPILPPIKGAEIKEGSLEFEATLENLQFVKLYQNSADVIAKLENKDIKRVAVVGAGYIGVELAEAFQRKGKEVVLIDVVDTCLAGYYDRDLTDLMAKNMEEHGIQLAFGETVKEVAGNGKVEKIITDKNEYDVDMVILAVGFRPNTTLGNGKIDLFRNGAFLVNKRQETSIPGVYAIGDCATIYDNATRDTNYIALASNAVRTGIVAAHNACGTDLEGIGVQGSNGISIYGLHMVSTGLTLEKAKRLGFDAAVTEYTDNQKPEFIEHGNSPVTIKIVYDKDSRRILGAQMAAREDMSMGIHMFSLAIQEGVTIEKLALTDIFFLPHFNKPYNYITMAALGAKD

SEQ ID NO: 19028 - protein, 399 aa, Streptococcus pyogenes SSI-1
MKERFSPLFEPLTLPNGSQLDNRFVLSPMVTNSSTKDGYVTQDDVSYALRRAASAPLQITGAAYVDPYGQLFEYGFSVTKDADISGLKELAQAMKAKGAKAVLQLTHAGRFASHALTKYGFVYGPSYMQLRSPQPHEVKPLTGQQIEELIAAYAQATRRAIQAGFDGVEVSSAQRLLIQTFFSTFSNKRTDSYGCQTLFNRSKLTLAVLQAVQQVIKQEAPDGFIFGFRATPEETRGNDIGYSIDEFLQLMDWVLNVAKLDYLAIASWGRHVFRNTVRSPGPYYGRRVNQVVRDYLRNKLPVMATGGMNTPDKAIEALAHADFIGVSTPFVVDPEFAHKIKEGCEESIHLRIRPADLKSLAIPQASFKDIVPLMDYGESLPKESRTLFRSLTHNYKEIK

SEQ ID NO: 19029 - protein, 500 aa, Streptococcus pyogenes SSI-1
MNKRVKIVATLGPAVEIRGGKKYGEDGYWAGQLDVEESAKKIAELIEAGANVFRFNFSHGDHKEQGDRMATVRLAEEIARQKVGFLLDTKGPEMRTELFADDAKEFSYVTGEKIRVATTQGIQSTRDVIALNVAGSLDIYDEVEVGHTILIDDGKLGLKVIDKDIATRQFIVEVENDGIIAKQKGVNIPNTKIPFPALAERDNADIRFGLEQGLNFIAISFVRTAKDVEEVREICRETGNDHVQLFAKIENQQGIDNLDEIIEAADGIMIARGDMGIEVPFEMVPVFQKMIITKVNAAGKAVITATNMLETMTEKPRATRSEVSDVFNAVIDGTDATMLSGESANGKYPVESVRTMATIDRNAQTLLNEYGRLDSSAFPRTNKTDVIASAVKDATHSMDIKLVVTITETGNTARAISKFRPDADILAVTFDEKVQRALMINWAVIPVLAEKPASTDDMFEVAERVAVEAGLVQSGDNIVIVAGVPVGTGGTNTMRVRTVK

SEQ ID NO: 19030 - protein, 450 aa, Streptococcus pyogenes SSI-1
MVIPYDYIVIGGGSAGIASANRAAMHGAKVLLAEGKEIGGTCVNLGCVPKKVMWYGAQVADILGTYAKDYGFDFKEKAFDFKQLKANRQAYIDRIHVSYERGFEQNGVNRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKAIVDVLVEEMAVGGPCLHPHSEVAKVVKNTDESLTLYLKDGQEVEVDQLIWAIGRKPNLEGFGLDKTGVTLNDKGYIETDAYENTSVKGIYAVGDVNGKLALTPVAVAAGRRLSERLFNGKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGATKADFDNTVAIHPTGSEEFVTMR

SEQ ID NO: 19031 - protein, 435 aa, Streptococcus pyogenes SSI-1
MSIITDVYAREVLDSRGNPTLEVEVYTESGAFGRGMVPSGASTGEHEAVELRDGDKSRYLGLGTQKAVDNVNNIIAEAIIGYDVRDQQAIDRAMIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 19032 - protein, 252 aa, Streptococcus pyogenes SSI-1
MSRKPIIAGNWKMNKNPQEAKAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIVCCGESLETYEAGKAVEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEADSFLALLDFLN

SEQ ID NO: 19033 - protein, 159 aa, Streptococcus pyogenes SSI-1
MPNLYDFTVKAQDGSDISLVNYKEKVVLVVNTATKCGLTPQYQALQALYDTYHDKGFEVLDFPCNQFLNQTPGEAEEINRFCSLTYHTTFPRFAKIKVNGKDADPLFTWLKEEKSGPLGKRIEWNFTKFLIDQNGQVIKRYSSKTDPKLIEEDLKALLG

SEQ ID NO: 19034 - protein, 474 aa, Streptococcus pyogenes SSI-1
MGIFPKDFLWGGAVAANQVEGAFEADTKGLSVQDVLPNGGLGEWTDSPTSDNLTLEAIDFYHRYKEDIALFAEMGFKVFRTSIAWSRIFPNGDDDQPNEAGLQFYDDLFDELLNYGIEPLVTLSHYETPLHLAKAYNGWTDRRLIGFFERFAQTVMERYKDKVKYWLTFNEVNSILHMPFTSGGIMTEKEKLSLQDLYQAIHHELVASASVTKLAHEINPDVKVGCMILAMPAYPMTSDPRDILAAHAFENLNLLFSDIHVRGKYPSYIKSYFKENGIEIVFEDGDKELLAEHTVDFLSFSYYMSVTQAHNPEAYTSGQGNILGGLSNPYLESSEWGWQIDPIGLRLVLNQYYDRYQIPLFIVENGLGAKDQLVQTADGSMTVHDDYRIDYMSQHLVQVAKAIEDGVEVMGYTAWGCIDCVSMSTAQLSKRYGFIYVDRNDDGTGQLTRYKKKSFDWYRQVIQTNGRYLEDNFS

SEQ ID NO: 19035 - protein, 468 aa, Streptococcus pyogenes SSI-1
MTKTLPKDFIFGGATAAYQAEGATHTDGKGPVAWDKYLEDNYWYTAEPASDFYNRYPVDLKLSEEFGVNGIRISIAWSRIFPTGKGEVNPKGVEYYHNLFAECHKRHVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDSGYSGEIGVVHALPTKYPFDANNPDDVRAAELEDIIHNKFILDATYLGKYSDKTMEGVNHILEVNGGELDLREEDFAALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDDGRIDYVKKHLEVISDAISDGVNVKGYFMWSLMDVFSWSNGYEKRYGLFYVDFETQERYPKKSAYWYKKVAETQVIE

SEQ ID NO: 19036 - protein, 1165 aa, Streptococcus pyogenes SSI-1
MKKKVNQGSKRYQYLLKKWGIGFVIAATGTVMLGCTPSILTHQVAAKTIVGLARDEAQQGDGNAKSGDGFQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPRMNEVWIDENYHAHAYRPLKKGYLRINYHNQSGHYDNLAVWTFKDVKTPTTDWPNGLDLSHKGPYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDKDKSVMALKGDFKTQGAVYTVTFGEVSQVARQSWQLKDKLYAYDGELGATLAKDGSVDLALWSPSADTVKVVVYDKQDQTKVLGQADLTKSDKGVWRAHLTSDSIKGISDYTGYYYLYEITRGQEKVMVLDPYTKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPSNFEADAPGDVVQYIAAHDNLTLHDVIAKSINKDPKVAEEEIHKRIRLGNTMILTAQGTAFIHSGQEYGRTKQLLNPDYKTKVSDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLADAEQAGVTAIAKPKGVQFTKEGLTIDGLTALVLKVSSKTADPSQQKSQTDNHQTKTPDGSKDLDKSLMTRPKRAKTNQKLPKTGEASSKGLLAAGVALLLLAISLLMKRQKD

SEQ ID NO: 19037 - protein, 328 aa, Streptococcus pyogenes SSI-1
MLEDYYPSTTSYYHSGIDDDLYTAKWGMVMTFLDLNDSSLTPFEGTHFALIGFKSDKGVYINNGRVGAVESPAAIRTQLAKFPWHLGNQVMVYDVGNIDGPNRSLEQLQNSLSKAIKRMCDLNLKPIVLGGGHETAYGHYLGLRQSLSSSDDLAVINMDAHFDLRPYDQTGPNSGTGFRQMFDDAVADKRLFKYFVLGIQEHNNNLFLFDFVAKSKGIQFLTGQDIYQMGHQKVCRAIDRFLEGQERVYLTIDMDCFSVGAAPGVSAIQSLGVDPNLAVLVLQHIAASGKLVGFDVVEVSPPHDIDNHTANLAATFIFYLVQIMAQHN

SEQ ID NO: 19038 - protein, 493 aa, Streptococcus pyogenes SSI-1
MSNWDTKFLKKGYTFDDVLLIPAESHVLPNEVDLKTKLADNLTLNIPIITAAMDTVTGSKMAIAIARAGGLGVIHKNMSITEQAEEVRKVKRSENGVIIDPFFLTPEHKVSEAEELMQRYRISGVPIVETLANRKLVGIITNRDMRFISNYNAPISEHMTSEHLVTAAVGTDLETAERILHEHRIEKLPLVDNSGRLSGLITIKDIEKVIEFPHAAKDEFGRLLVAAAVGVTSDTFERAEALFEAGADAIVIDTAHGHSAGVLRKIAEIRAHFPNRTLIAGNIATAEGARALYDAGVDVVKVGIGPGSICTTRVVAGVGVPQVTAIYDAAAVAREYGKTIIADGGIKYSGDIVKALAAGGNAVMLGSMFAGTDEAPGETEIYQGRKFKTYRGMGSIAAMKKGSSDRYFQGSVNEANKLVPEGIEGRVAYKGAASDIVFQMLGGIRSGMGYVGAGDIQELHENAQFVEMSGAGLIESHPHDVQITNEAPNYSVH

SEQ ID NO: 19039 - protein, 245 aa, Vibrio parahaemolyticus RIMD 2210633
MIKLENIHKRFGDTEVLKGIDLDIKQGEIIVIIGSSGTGKSTLLRTVNFLEQADEGRITIDDISVDTQKHTKAEVLALRRRTGFVFQNYALFAHMTARQNIAEGLITVRGWKKQEALTRAQQILDDIGLGEKGDSYPAALSGGQQQRVGIGRAMALQPELLLFDEPTSALDPEWVGEVLSLMKKLANQHQTMLVVTHEMQFAKEVADRVIFMAEGNIVEQGSPQDIFDNPQDPRLKKFLNQVGIE

SEQ ID NO: 19040 - protein, 455 aa, Vibrio parahaemolyticus RIMD 2210633
MEKVMATHFDYICIGGGSGGIASANRAAMYGAKVALIEAQDLGGTCVNVGCVPKKVMWHGAQIAEAMNLYAEDYGFDVDVKGFDWSKLVESRQAYIGRIHQSYDRVLGNNKVNVIKGFAKFVDEKTVEVNGEHYTADHILIAVGGRPTIPNIPGAEYGIDSNGFFDLAEQPKRVAVVGAGYIAVEIAGVLHALGTETHLFVRKESPLRSFDPMIIDTLVEVMEAEGPTLHTHSVPKEVVKEADGSLTLHLENGESQNVDQLIWAIGRHPATDAINLASTGVATNEKGYIKVDEYQETNVKGIYCVGDIMEGGIELTPVAVKAGRQLSERLFNNKPNAKMDYDLVPTVVFSHPPIGTIGLTTQEAEEKYGKDNIKVYTSGFTAMYTAVTKHRQPCKMKLVCAGEEETVVGLHGIGFTVDEMIQGFGVAMKMGATKADFDSVVAIHPTGSEEFVTMR

SEQ ID NO: 19041 - protein, 256 aa, Vibrio parahaemolyticus RIMD 2210633
MRRPVVMGNWKLNGSKAMVTELLTGLNAELEGVEGVDVAVAPPALYIDLAERLIAEGGNKIILGAQNTDLNNSGAFTGDMSPEMLKDFGATHIIIGHSERREYHNESDEFIAKKFNFLKENGLTPVFCIGESEAQNEAGETEAVCARQINAVIDTYGVEALNGAIIAYEPIWAIGTGKAATAEDAQRIHASIRALIAAKDEAVAAQVIIQYGGSVKPENAEAYFSQPDIDGALVGGASLDAKSFAAIAKAAAAAKA

SEQ ID NO: 19042 - protein, 170 aa, Vibrio parahaemolyticus RIMD 2210633
MEYNTSALCDIYLDQVDVVEPMFSNFGGRASFAGQITTIKCFEDNSLIRETLEQDGLGRVLLIDGGGSLRKALIDAEIAAIAEENEWEGIVVYGCVREVDELEDMNLGIQALASIPVGAANQGIGELDVPVNFGGVSFLPEDYIYADNTGIILSPEPLNIDLELDDTVEE

SEQ ID NO: 19043 - protein, 206 aa, Vibrio parahaemolyticus RIMD 2210633
MSEIKFETAEQKASYGIGLQMGQQLAGSGLEGLSVDAIAAGIATALTGEMPSIEIDEINNALQELHSRAEAARQEAAKAAAADGEAFLKDNALRPEVNVLESGLQYEIINEGTGEIPTADKSVRVHYHGELTDGTVFDSSVSRGQPAEFPVTGVIKGWVEALQLMPVGSKWKLYIPQDLAYGERGAGAAIPPFAALVFEVELLDIL

SEQ ID NO: 19044 - protein, 470 aa, Vibrio parahaemolyticus RIMD 2210633
MKKTKIVCTIGPKTESVEKLTELVNAGMNVMRLNFSHGDYEEHGTRIANFRKVMEATGKQLAILLDTKGPEIRTIKLEGGNDVDLVAGQEFTFTTDTSVVGNKDKVAVTYAGFAADLNVGNTILVDDGLIEMEVIATTDTEVKCKVLNNGALGENKGVNLPGVSVNLPALSEKDKNDLKFGCEQGVDFVAASFIRKASDVQEIREVLAANGGENIHIISKIENQEGVDNFDEILELSDGIMVARGDLGVEIPAEEVIFAQKMMIEKCNRARKMVITATQMLDSMINNPRPTRAEAGDVANAVMDGTDAVMLSGETAKGKYPVEAVTIMAQIAKRTDSVLKAELGSRLDSPRLRITEAVCKGAVDTAEKLAAPLIVVATEGGKSARSVRKYFPTANILALTTNKKTAAQLVLTKGVTPVVVDAIESTDAFYVAGKELALESGLGNKGDIVVMVSGALVASGTTNTASVHVL

SEQ ID NO: 19045 - protein, 470 aa, Vibrio parahaemolyticus RIMD 2210633
MSQNVYQFIDVQRVDPAKKPIKIRKIEFVEIYEPFTKQQATAQADRCLDCGNPYCEWKCPVHNYIPQWLKLANEGRILEAVELSHQTNSLPEVCGRVCPQDRLCEGSCTLNDDFGAVTIGNIEKYITDKAFEMGWKPDMSKVEWTNKKVAIIGAGPAGLAAADILVRNGVKPVVFDRYPEIGGLLTFGIPSFKLEKGVMENRRRVFTEMGVEFRMNVEVGQDVQMQELLDEYDAVFLGVGTYKYMRAGLENEDAPGVYDALPFLISNTYKVMELEHNQPFIDMAGKKVVVLGGGDTAMDCVRTSIRQGASNVICAYRRDEENMPGSRREVKNAKEEGVKFMFNLQPLGIEVDAYGKVSGVKVVKTALGEPDDAGRRRPEPVEGSEHVLPADAVIMAFGFQPHQMDWLTPFNVELDQWGRIKAPNNQEFQYQTSNEKIFAGGDAVRGSDLVVTAIDEGRKAAEGILDYLDV

SEQ ID NO: 19046 - protein, 489 aa, Vibrio parahaemolyticus RIMD 2210633
MGKPTGFLEHGRELPQKIDPAERIKNNKEFVLNEEFGSKINTQASRCMDCGVPFCHNGCPIGNIIPEFNDAVYRDSWEEAWNILSSTNNFPEFTGRVCPAPCESACVLGINQDPITICNIEKTIVETAYREGYAKPKTPRSRTGKTVAIIGSGPAGLAAAEQLNSAGHTVTVFERDEKVGGLLRFGIPDFKLSMEVIDRKINLMAEAGVEFRVNQHVGVDVNAQQLRQEYDVVLLTGGSTVPRDLPVPGRDLKGVYFAMQFLGQNNRRANNMDLKGEEIHAAGKHVVVIGGGDTGSDCVGTSNRHGAASITQVEIMPIPPEKRPANMPWPQYPMILRTSTSHEEGVDRHWNILTKEFIGNDKGEVTGLRLADIVWEDAKPGERPSFKEVEGSERVIPCDMAFLAMGFLHPEPTGVLAQLDIALDDRGNVATQGFATNQEGVFAAGDMRTGQSLVVRCINEGRECARAIDEYLMGGTNLEAKANSLMLSA

SEQ ID NO: 19047 - protein, 160 aa, Vibrio parahaemolyticus RIMD 2210633
MRDITPDICDQFEDQVTLLNLPLQNFGQRTAFHGEIVTVRCYHDNSKVREVLEQDGTGKVLIVDGHGSCQKALLGDQLAILGIENGWEGIIVYGAVRDVAQMSQMDIGVQALGTCPFKTEKRGVGEVNVTLTMLNQIVQPKHHVYADWNGVLISKEALDF

SEQ ID NO: 19048 - protein, 352 aa, Vibrio parahaemolyticus RIMD 2210633
MAIFQGSEMQYTKLPHSSLEISKICLGTMTFGEQNIEQEAFEQLDFAVDHGVNFIDTAEMYPVPPKAETQGLTEQYIGNWLTKSGKREKVVLATKVAGPRNVPHIRENMSLNRRNIHDAIDSSLQRLQTDYVDLYQLHWPQRQTNCFGQLNYPYPDKQEEVTLIETLEALTELVKMGKVRYIGVSNETPWGVMSLLRLAEKHDLPRIVSIQNPYNLLNRSFEVGLSEISHYEGVQLLAYSPLAFGCLSGKYLHGAKPEGARCTKWERFARYFTPQGVKATEAYVNLAREHGLDPAQMALAFVNQRPFVASNIIGATNLDQLKANIDSIDIKLSDELLTDIQAIGTTYSNPCP

SEQ ID NO: 19049 - protein, 174 aa, Vibrio parahaemolyticus RIMD 2210633
MIDGDGYRLNVGIVICNNHGQVFWAKRYGQHSWQFPQGGIDEGETPEQAMFRELYEEVGLTKKDVKIIATSRHWLRYKLPKRLVRWDSKPVCIGQKQKWFLLRLECDESRINMQRGKSPEFDGWRWVSYWYPVRQVVSFKRDVYRRAMKEFASLAMPFRERKTKGKRKKQQRRG

SEQ ID NO: 19050 - protein, 392 aa, Vibrio parahaemolyticus RIMD 2210633
MTDQPISLEEIRLRLNELDDQLLSLLSERRKLSIEVAKSKVQTSKPVRDAVREQQLLVKLISNGRDKYELDAQYITKLFHTIIEDSVLLQQGYLQNLVNPQQSRKPLARVAFLGAKGSYSHLASREYFSRKNTELIELNCEHFKEVTRTVESGHADYGVLPIENTSSGSINEVYDLLQHTTLYIVGELTQPIEHCLVATKDIRLEDIKTLYSHPQPHQQCSEFLSRMKGVKLESCASTADAMQKVQEMNRDDVAAIGNASSGKLYGLQAIQGNIANQTENHTRFIVVARKPVEVSTQIPAKTTLIMSTSQEAGSLVETLLVLQRYGINMTKLESRPIMGNPWEEMFYVDLEAHLGSTEMQQALQELTKITKHLKVLGCYPSENIKPTQVKLS

SEQ ID NO: 19051 - protein, 171 aa, Vibrio parahaemolyticus RIMD 2210633
MNHFELFGLPSQFQLDGSLLSSKFRELQKRFHPDNFATASERDRLMSVQKAAQINDAYQVLKHPISRAEYILAEQGMEIRGEQQTMQDPMFLMEQMELREELEDIADCSDPESALFDFDSKVSKMYKQHLASVEQELNDGLWAEAADRVRKLKFIAKLKNEIELVEDKLLG

SEQ ID NO: 19052 - protein, 490 aa, Vibrio parahaemolyticus RIMD 2210633
MQMLRIAKEALTFDDVLLVPAHSTVLPNTADLRTQLTKNISLNIPMISASMDTVTEARLAIALAQEGGIGFIHKNMSIEQQAAEVRKVKKFEAGVVTDPVTVNPDATIADVVALTEKHGFAGFPVVTEHNELVGIITGRDVRFVTDLSKKVSAVMTPKERLASVKEGATREEVQEKMHEARVEKVLVVNDEFKLTGMITAKDFHKAERKPNACKDERGRLRVGAAVGAGAGNEERVAALVEAGVDVLLIDSSHGHSEGVLQRIRDTRAAYPDLDIIGGNVATGAGAKALIEAGVSAVKVGIGPGSICTTRIVTGVGVPQITAIADAAEVANEYGIPVIADGGIRFSGDICKAIVAGASCVMVGSMFAGTEEAPGEVILYNGRSYKAYRGMGSLGAMSQGSSDRYFQSDNAADKLVPEGIEGRIAYKGRLKEIVHQQMGGLRSSMGLTGSATIEDMRTKAEFVRISGAGMQESHVHDVQITKEAPNYRLGN

SEQ ID NO: 19053 - protein, 422 aa, Vibrio parahaemolyticus RIMD 2210633
MKDETLSIHFGYETDPTTKSVATPIYQTVAYEFDNAQHGADLFNLEVPGNIYTRIMNPTNDVLEKRMAALEGGIAGLVVSAGSAAINYAILTLAQAGDNIVSTPQLYGGTYTLFAHMLPNQGIQVKFAKDDKPESLAELIDENTKAVYCESIGNPAGNIIDLERVAELAHAQGVPVIVDNTVATPVLCKPIEFGADIVVHSLTKYVGGHGTTLGGVIVDSGKFPWAQHKGRFPVFNQPEPSYHGVVYTEAFGEAAFIGRARTVPLRNTGSALSPMNAFMLMQGLETLPLRMERHTDNALKVAEFLEQHDKVSWVSYAGLPSSAHFNLAEKYMKGKPSAILSFGLQDGYEAGVRFYDALKIFKRLVNIGDAKSLACHPASTTHRQLSEAEQKQAGVSPEMIRLSVGIEHIDDILADLEQALNA

SEQ ID NO: 19054 - protein, 443 aa, Vibrio parahaemolyticus RIMD 2210633
MSYVFHRHCHATLPIIDKGEGVYLFDKQGKQYLDACGGAAVSNLGHSHQAVKKAMLEQLERVPFAHTGFFTSDSSERLAELICQHMPEQFNHVYLVSGGSEAVESALKMARQYFVESGKPEKKQFIARQQSYHGNTLGALAVGGNEWRREPFKPILHPSHHIAPCYAYRYQQSHESELDYSLRAANELEAKILELGADNVMAFVAEPIVGATAGAVPATQGYFKRIREICDQYDVLLILDEVMCGVGRSGSFFAFEQEEAEPDLVCMAKGLGAGYQPIGAVVANDRVYQAIADGSGFFQHGHTFMAHPVACAAAVATIQTIFQDDLLTAVNRQSALLRNELASALAHLPYIGDIRGKGLFFGIELVADKESKSPLSKATLADKRIKQRAMENGLMCYPMGGTIDGVNGHHILLAPPFIIQSHHIDELVGKLSLTLKEVAEIWK

SEQ ID NO: 19055 - protein, 381 aa, Vibrio parahaemolyticus RIMD 2210633
MSKRDFYEVLGVSRDASERDIKKAYKRLAMKFHPDRNQGDESAADKFKEVKEAYEVLTDSQKKAAYDQYGHAAFEQGGGGFGGGFGGGGADFGDIFGDVFGDIFGGGRRGGGGHRAQRGADLRYNMELTLEEAVRGVTKEIEVPTLVHCDSCDGSGAKKGSSAETCGTCHGHGQVQMRQGFFAVQQTCPTCHGKGKIIKDPCNECHGQGRKQKTKTLNVKIPAGVDTGDRIRLSGEGEAGEMGAPSGDLYVQVHVKEHHIFERDGNNLYCEVPVSFAMAALGGEVEVPTLDGRVSLKVPSETQTGRMFRMRGKGVKGVRGGGIGDLIVKLVVETPVNLSSRQKELLKEFEESCGGEAATKHKPKSEGFFNGVKKFFDDLTS

SEQ ID NO: 19056 - protein, 429 aa, Vibrio parahaemolyticus RIMD 2210633
MLERLFKLSENGTNVRTEIIAGITTFLTMAYIIFVNPAILSDTGMDRGAIFVATCLAAAIGCFIMGLVANYPIAQAPGMGLNAFFTYSVVLGMGYTWQVALAAVFVSGVLFILLSIFKIREWIINSIPHSLRTGISAGIGLFLAFIALKNAGIVVDNPATLVSMGDITSLPSVLAAIGFFLTIALVHRGVKGAVMIAILGVTALGLLFGDVQWNGVMSTPPSIAPTFLQLDFSGLFEVGMISVVFAFLFVDLFDTAGTLVGVSQKAGLTDENGNIPRLNKALLADSTATSVGALLGTSNTTSYIESVSGVAAGGRTGLTAVVVGVLFLLALLFSPLAGMIPAYATSGALFYVAILMLSGLVSIDWRDLTEASPVVVTCLVMPLTFSIAEGITLGFIAYAAIKLFSGKGRDVSMSVWVMSAIFIVKYLAG

SEQ ID NO: 19057 - protein, 322 aa, Vibrio parahaemolyticus RIMD 2210633
MSKIYEDNSLTIGNTPLVRLNKVSKGNVLAKIEARNPSFSVKCRIGANMIWEAEKAGTLKPGVELVEPTSGNTGIALAFVAAARGYKLTLTMPESMSLERRKLLKALGANLELTEAAKGMKGAIAKAEEIVASNPEKYLLLQQFNNPANPQIHEKTTGPEIWDATDGEIDVLVAGVGTGGTITGTSRYIKGEKGKAITSVAVEPAESPVIAQALAGEEIQPAPHKIQGIGAGFIPGNLDLDIIDRVEPVTSEEAIEMARRLMEEEGILAGISSGAAVVAANRIAELPEFEGKTIVTILPSSGERYLSTALFAGIFTEKENQQ

SEQ ID NO: 19058 - protein, 214 aa, Vibrio parahaemolyticus RIMD 2210633
MRIILLGAPGAGKGTQANFIMDKYGIPQISTGDMLRAAIKAGTELGKQAKAVIDAGQLVSDEIILGLIKERIAQDDCEKGFLLDGFPRTIPQADGLKEMGVEVDYVIEFDVADDVIVERMAGRRAHLPSGRTYHVVYNPPKVEGKDDVTGEDLVVRDDDKEETVRARLGVYHEQTAPLIDYYGKEAAAGKTKYLKFDGTKQVAEVSADIEKALA

SEQ ID NO: 19059 - protein, 404 aa, Vibrio parahaemolyticus RIMD 2210633
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLIPAPDYPLWTASVALSGGNPVHYLCDEQSDWYPDLDDIKKKITPKTRGIVLINPNNPTGAVYSRDFLLEVIEIARQHKLIIFADEIYDKVLYDGATHTSVATLTEDVLVMTFNGLSKAYRVCGFRGGWMFLTGPKHLAQGYVNGLELLSSMRLCANVPMQHAIQTALGGYQSINELILPGGRLLEQRNRAFELINQIPGVSCVKPKGAMYLFPKIDTKMYNIKNDQQMVLDFLKQEKVLLVQGSGFNWPKPDHFRIVTLPHVEDLETAIGRFERFLSTYSQ

SEQ ID NO: 19060 - protein, 235 aa, Vibrio parahaemolyticus RIMD 2210633
MNKLLECRDIRKVYREGSLDTEVLKGVSFDIDKGELVSIVGSSGSGKSTLLHILGALDDATQGEVDFLGQNLSALSSNKQAALRNKHLGFVYQFHHLLADFTALENVAMPLLIGGIKVTEAKQAAKALLEKVGLSHRMDHRPSELSGGERQRVAIARALVNKPDLVLADEPTGNLDHNTALAIYDLMRELNKESNIAFLVVTHDNELAAKMDRQMHMQDGLLVDRLMTESASVEG

SEQ ID NO: 19061 - protein, 256 aa, Vibrio parahaemolyticus RIMD 2210633
MNDVPALDIKDLHKTFGQNEVLKGISLAAHKGDVISIIGSSGSGKSTFLRCINLLETPTAGEIWVNGELIQMKNNRAGESVPANEKQVQRIRSRLAMVFQGFNLWSHLTVLENVIEAPVHVLGVPKAQAIENAELLLKKVGLYERKDYYPGHLSGGQQQRAAIARALAVDPEVMLFDEPTSALDPELVGEVLGVMRDLADEGRTMLVVTHEMAFARDVSNHVMFLHQGLVEEQGDPAKLFTNPDSQRLQQFISSIY

SEQ ID NO: 19062 - protein, 211 aa, Vibrio parahaemolyticus RIMD 2210633
MSFKAAEVSSLSERINWEKVDGLVPAIVQDFQSSQVLMMGYMNQDALAKTGETGQVTFFSRTKERLWTKGETSGNVLQLVNISLDCDNDTLLVRVNPIGPTCHTGTTTCWDGDAQEESQMVWLHQLEQLLAARKSADPDSSYTASLYARGTKRISQKVGEEGVEVALAATSGDKAELVCESADLIYHLLVLLQDQGLSMNDVVNKLKERHK

SEQ ID NO: 19063 - protein, 164 aa, Vibrio parahaemolyticus RIMD 2210633
MITLHTNFGDIKIQLNEEKAPETSANFLQYCRDGFYDNTLFHRVIDGFMIQGGGMESGLREKSTRAPIKNEANNGLSNKVGTLAMARTMEPHSASSQFFINVNNNTFLDFRSESLDGWGYCVFGEVVEGMDVVNKIKGVSTGSYGMHQDVPLEDVVITGTTIAE

SEQ ID NO: 19064 - protein, 402 aa, Vibrio parahaemolyticus RIMD 2210633
MSEGKKTKLITAGRDKKWTNGVVNPPVQRASTVVFNTVAEKNQAAINRANKTLFYGRRGTNTHFAFQDAMVEIEGGAGCALYPCGTAAISNAILSFVEAGDHILMVDTCYEPTRDFCNVIMKKMGVETTYYDPMIGENIRDLIQPNTKILFLESPGSITMEVQDVPTMARIAHEHDIIVMLDNTWGAGVNFSPFEHGVDISIQAATKYIVGHSDVMLGTAVASEKYWDQLREQSYLMGQCVSPDDAYLGLRGIRTLDVRLRQHAENSLKVAQWLANRPEVDHVRHPALETCPGHEFFERDFTGGNGLFSFVLKTSYPKATTALLDGMKHFSMGYSWGGYESLILANEPRSFNSLRTVANPNFEGTLIRIHVGLEDVEDLIADLEAGFVRYNALVLEKEVSLK

SEQ ID NO: 19065 - protein, 215 aa, Vibrio parahaemolyticus RIMD 2210633
MSLCLENLAIRKANGDTLFSAFNMTVEKAEIVTLMGPSGCGKSTLLDAIAGHLSAEFNYSGSITLDNEKLDALPAHKRQVGILFQDDLLFPHLTVWENLAFALPNSIKGEERKAHAMQALKNIALTKLAESFPDQISGGQRARIALTRMLLAKPKVALLDEPYSKLDKDLRVQFRNWVVEQLQQANIPTLMVTHDEDDIPNGSRCLNWPWETNHA

SEQ ID NO: 19066 - protein, 458 aa, Vibrio parahaemolyticus RIMD 2210633
MTFLSQLSTHADKAFLRRLFAIALPITLQSIMFSSRSLVDVLMLGQLGEAEIAAVGVAARATFVTTIMLVGVTTGGALLTAQYWGAGDKIGVRQSTSLTWMIAMVFAALAVCLFVFFPQPIMGLTTDSQEVIELGSSYLVISSASMFAVACVASMAVGLRAMHQPGLSTFFSGIGILSNVFLNWVLIFGHLGFPALGITGAAIATVISGAIEVGCLFGYLWLKKHIIAFGWGDIRASLVLDKITRFLSLSLPTTFNFLAWAGGLFAYHAIMGQAGVQGLAALSVMTPVESIALAMMIGLSNAAAVLVGNQLGAKNFEPVYYQAWATVILNVLIAFGVAVLLFFTNQLILDAFSALSAETRHLAEQFMVILALGVILRSVPMMVIVGVLRAGGDVKFCLYQDVFAQWIIGIPLAAFAAIYLGWEPQWVYLLFLTEEVVKWCICLPRMKSKKWMKNLIEK

SEQ ID NO: 19067 - protein, 268 aa, Vibrio parahaemolyticus RIMD 2210633
MNLKLDNQQTDDAVVVTGLKMGYGDKILLENASFNVKRGEILVILGGSGCGKSSLMKHIIGLYAPISGDIYINGKSIVHAGESEKASIQRELGVMYQSGALFGSLNILENVRFPLDEFTDLGLMEKNKISRTLLELLEMGHSAELMPSQLSGGMLKRAGIARAMAIGANILILDEPSAGLDPITAANLDQTILNLRESLGYTFIIVTHELQSIFSIADRAIMLDPVSKGIIAEGYPKELRDQSMDMRVRQFFNRHPDVLTEESELSNG

SEQ ID NO: 19068 - protein, 456 aa, Vibrio parahaemolyticus RIMD 2210633
MHRYKEEASSLIKLATPVLIASVAQTGMGFVDTVMAGGVSATDMAAVSVASSIWLPSILFGIGLLMALVPVVAQLNGSARREKIPFEIQQGVVLALLISIPIIGVLLQTQFILQLMDVEAVMAGKTVGYIHAVIFAVPAFLLFQTLRSFTDGMSLTKPAMVIGFIGLLLNIPLNWIFVYGKFGAPELGGVGCGVATTIVYWVMFALLLAYVMTSSRLKSINVFGEYHKPQWKAQVRLFKLGFPVAAALFFEVTLFAVVALLVSPLGPIIVAAHQVAINFSSLVFMLPMSVGAAVSIRVGHRLGEENVDGARVASRVGIMVGLALATITAIITVLSRELIAELYTNNPEVISLAMQLLLFAAVYQCTDAVQVIAAGALRGYKDMRAIFNRTFIAYWILGLPTGYILGRTDWIVEPMGAQGFWLGFIIGLTAAALMLGVRLRWMHRQEPDVQLNFSLQ

SEQ ID NO: 19069 - protein, 427 aa, Vibrio parahaemolyticus RIMD 2210633
MVMTLTLMHRMSALQITEINIMSVTADQVHGVVQALTQSSDTLFLLLGAIMVFLMHAGFAFLEVGTVRQKNQVNALVKIIADFGISAIAYFFIGYWVAYGGTFFSDAQTLSQDNGYELVKFFFLLTFAAAIPAIVSGGIAERARFYPILIATFFTVGVVYPLFEGMIWNGNFGVQAWFESTFGYGFHDFAGSVVVHGVGGWIALVAVTFLGMRRGRIRAGKHTNFAPSNIPFLALGAWILCVGWFGFNVMSAQTLSGISGLVAMNSLMAMVGGIVASLLAGKNDPGFIHNGPLAGLVAVCAGSDLMHPLGALVTGAVAGVLFVYLFTYLQNRTKIDDVLGVWPLHGVCGAWGGIAAGVFGQSGFGGMGGVSFAVQVLGTFFGISIAVLGALVVYGAINALTGLRLSEEDEFNGADLAIHKISSTNED

SEQ ID NO: 19070 - protein, 249 aa, Vibrio parahaemolyticus RIMD 2210633
MTQQQDYMIQLKDMNKWYGEFHVLKNINLNVKKGEKIVICGPSGSGKSTMIRCINRLEEHQAGNIFVSGTELTEDLKNIEAVRREVGMCFQHFNLFPHLTVLENCTLAPIWVKKMPKEEAEAVAMKYLKRVKIPDQADKYPGQLSGGQQQRVAIARSLCMSPKVMLFDEPTSALDPEMVREVLDVMVELAEEGMTMLCVTHEMGFAKEVADRVIFMDAGEIIEENNPVDFFENPQSDRTQNFLAQILHH

SEQ ID NO: 19071 - protein, 506 aa, Vibrio parahaemolyticus RIMD 2210633
MIYAQPGSENAIVNFKSHYDNFIGGEWVKPTGGEYFDNISPINGQAYCKVARSGEADINLALDAAHNIKAKWAKTSVTERSNILLKIADRIEQHLEELAVAETWENGKPVRETLAADLPLVVDHFRYFAGCIRAQEGSAAELDEHTASYHFPEPIGVVGQIIPWNFPMLMAAWKLAPALAAGCCVVLKPAEQTPTSILVLMEKIGDLLPPGVINVVNGFGSEAGQALATSNRIAKLAFTGSTQVGNHILKCAADNLIPSTVELGGKSPNIYFSDIFDYEDEYLDKCIEGTLLGFFNQGEVCTCPSRVLVHEAIYDKFVEKLTERAQLIKQGNPLDTDTQVGAQASQEQFDKILSYLEIGREEGAKVVFGGGVSEQPESISQGYYIQPTMLEGHNKMRIFQEEIFGPVIAITKFKDEAEALEIANDTEYGLGAGVWTRDANVAYRMGRNIEAGRIWINCYHAYPAHAAFGGYKKSGIGRETHKMMLDHYQNTKNLLISYSIDPLGFF

SEQ ID NO: 19072 - protein, 482 aa, Vibrio parahaemolyticus RIMD 2210633
MKGDIGVIGLAVMGQNLILNMNDHGFKVVAHNRTAAKVDEFLEGPAKGTNIIGAYSLEELVEKLETPRKVMLMVRAGDVVDKFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFAEWNNTELNSYLVEITADILGYKDEDGEPLVEKILDTAGQKGTGKWTGINALDLGIPLTLISESVFSRCLSALKDQRVEAEKLFGKTITPVEGDKQEWVDALRQALLASKIISYAQGFMLMREASNENGWDLNYGNVALMWRGGCIIRSAFLGNIRDAYEANPELAFLGSDDYFKGILQSSLVAWRKVAAKSLEAGIPMPCTTSALTFLDGYTTARLPANLLQAQRDYFGAHTYERIDRERGEFFHTNWTGTGGNTASTTYDV

SEQ ID NO: 19073 - protein, 421 aa, Vibrio parahaemolyticus RIMD 2210633
MDIFKKQESNVRSYSNNFPVVFRKAKGCWLETEQGERYLDFLAGAGSLNYGHNNPVLKQALLEYIEMDGITHGLDMHSEAKAGFLAALDNYILKPRKLDYKVQFTGPTGTNAVEAALKLAKKVKGRSSVVAFTNGFHGCTAGALAATGNQHHRQGNGSSLTNVTRIPFEGYAGVDGLALFETMLNDNSAGMDKPAAVLLETVQGEGGLNAASNEWLQRLSKICKANDILLIVDDIQAGCGRTGTFFSFEPSGIEPDIVTLSKSIGGYGLPMAVVLLKPELDQWKPGEHNGTFRGNNHAFITAAKALEIYWSNDDFETHIKQCSQNVSEVIDRCVRRFPQMFVQKKGRGMMIGIECIHGDLAAEIAKACFDDGMVIETAGPDDEVVKFFCPLTISESELNQGLSIFERAVETIAAKHFKQAS

SEQ ID NO: 19074 - protein, 423 aa, Vibrio parahaemolyticus RIMD 2210633
MTNQQLHQRRSQVIAQGMGALYPLYVEKAENAYVWDIEGNKYIDFAAGIAVTNTGHSHKRISEAVKAQLDNFSHTCAMVTPYASFVELAEKLTELAPGETKKKAIFLTTGAEAVENAVKVARAHTGRSGVIAFKGGFHGRTNMTMGLTGKVAPYKAGFGPFPNEIYHAPYPNAFHGISVEQSLQAIDDLFACDIEPSRVAAIIFEPVQGEGGFYKAPDAFAQGLRQLCDKHGIMLIADEIQTGFARTGKMFATEYLGIEPDLMTMAKGIAGGFPISAVVGKADVMDSALPGGLGGTYAGSPLGCVAGLEVLKIIEEEDLCAKAMGIGEVVNARMTKLQQSVPAIGEIRTTGAMMAIEFTDPESGKPLQEMTKAVISKAQENGLILLSCGVKANVIRLLPPLTIEPEVLSEGLDKLEKVILEVA

SEQ ID NO: 19075 - protein, 481 aa, Vibrio parahaemolyticus RIMD 2210633
MSKGMTMQQIQNQSLVSFMVANPQQGIAVTNPATGELLGYAPVSTENDILNSIERAHVAQKEWSALPAKTRAGMLNRWFQLLLENKADLGRLMTLEQGKPLAEAQGEVLYGASFIEWFAEEAKRTYGETIPAPSADKRLVTIKQPIGVACAITPWNFPIAMITRKAAPALAAGCSFVVKPSESTPLSAFAVAELAYQAGIPRDVLQVVLGENSRQVGAIFTSHPLIRKLSFTGSTQVGRVLMQQSAADIKRTSMELGGNAPFIVFDDADIDAAVAGAMASKFRNAGQTCVCANRFYVHSKVYDEFVAKFDAAVQQLKVGNGLEEGVNIGPVISESAKQGIQALIDGAIEQGAKPVSALKELDGLFMQPVVLKGVTHDMKIVSEEIFGPVAPVIRFDSDEQLIEMANDTIYGLASYFYSQNIHRVWKIAEALEYGMVGINEGMISTEVAPFGGVKQSGIGREGAKQGIDEYMDVKYLCFGGN

SEQ ID NO: 19076 - protein, 369 aa, Vibrio parahaemolyticus RIMD 2210633
MKTQKQWIELKNNLNIENRAYINGEYSAALTGQTIPVVNPATDEIFTEIARCQSEDVDLAVSCARQAFQSGQWSESSPAHRKAVLKQFADLIDQHQEELALLETLDTGKPISHSFSTDIPGAANSLRWYAEAIDKVYGEVAPTEKDVHAFVSHQPIGVVAAVVPWNFPLWLACWKLGPALAAGNSVLLKPSEKSSLTAIFLGQLASQVGLPTGVFQVVTGFGHEAGDALAKHQDVDCIAFTGSTRIAGQLMVSSGESNLKRVFAEAGGKNANIVFEDCDDLDRAAAETAAGCFYNQGEVCVAATRLLVHESIKDQFIEKVIQASKAFTPKDPMNPSSSMGALIDQDHKSKVLEYISLGESEGAIRALWR

SEQ ID NO: 19077 - protein, 462 aa, Vibrio parahaemolyticus RIMD 2210633
MVISNFYSSGYLEKKMESYLQEVQNFKQKWPDIEFIDLIFTDINATPRGKRIPIDALEKLDKGVALPLSTITLDTKGNVVETAGLGEDLGEPDHLCYPISGTLMPTAKEQVGQLLLSMMDETGQHPNPLFIRNILASMLQTLHAKDQYPCVALELEFYLIDKTRGENGEPLTAINPTKKTREKDTEVYDLDGLDDYADFLTDLNRIALEQGLNTSGALSESAPGQFEINFNHSKDVLRACDEIIIAKRLIRQVAHQHGFDATFMAKPFGEQAGNGMHIHLSLVDKDGNNHFSQTDGQPSPFFYQTMAAMLSQTSDAMGLICPNVNSFRRFLPGAYVPTKADWGENHRGVALRVPISDSKNRRIEHRIAGADVNPYILAAVVLSAVLASDNYTKDQCPPTLSDDAVELPLRMSEALERLEHSELAQYISQDFIDLYLACKRSELAEFERAITPLEIDWMLHSA

SEQ ID NO: 19078 - protein, 268 aa, Vibrio parahaemolyticus RIMD 2210633
MSRYEKMFARLNEKNQGAFVPFVTVCDPNAEQSYKIMETLVESGADALELGIPFSDPLADGPTIQGANIRALDSGATPDICFEQIGKIRAKYPDLPIGLLMYANLVYSRGIESFYERCAKAGIDSVLIADVPTNESAEFVAAAEKFGIHPIFIAPPTASDETLKQVSELGGGYTYLLSRAGVTGAETKANMPVDHMLEKLNQFNAPPALLGFGISEPAQVKQAIEAGAAGAISGSAVVKIIEAHVEQPQIMLDKLGEFVSAMKAATQK

SEQ ID NO: 19079 - protein, 513 aa, Vibrio parahaemolyticus RIMD 2210633
MMNLAAALQRNAVSKPNKTALICGDKKFTYAEFDAIAGKIATSMIKAGVKPGDRVALSCPNLPFFPFVYFAVQKAGAVTVPLNVLLKSREIKYHLEDSKAKFYFCFEGTPELPMAKEGMKAFKEVDACETMIVMTQDQTQKEYQGLPTLTSFIEDIEPLADYVARDADDTCVILYTSGTTGLPKGAELTQQNIVMNALVAQNIMASQADDVHLVTLPLFHTFGQTVHLNASVQSGATLVLVPRFDPKHVLELIEKHRVTLFAGVPTMYIGLLHVEHNCDISSLRVAVSGGSSLPTEVFKTFEARFNVPILEGYGLSETSPIACFNHLDQERVPGSVGQPIQGVEVKVVDLDGHTLPVGEEGEIIVRGHNVMKGYLDRPEVTESVLQSGWFHTGDVGRFDESGNLFIVDRMKDLIIRGGFNVYPREIEEVFMTHPAVAMVAVIGIPHQEYGEEIKAYVVLKPNQFVEADELQLWGREQLANFKYPRFVEIREQLPMSATGKILKRELKSELEVA

SEQ ID NO: 19080 - protein, 239 aa, Vibrio parahaemolyticus RIMD 2210633
MSNKSLVELTNICKYYSSGEAEVRALDGVDLTIHQGEFLSILGPSGSGKSTLMNMLGCLDKPTDGEYQLGGQNVASLSANELAGIRNQKIGFVFQSFNLLEYATALDNVALPLVYSGIKAKERRQRAAKLLEQVGLGDRLDHKPNQLSGGQKQRVAIARALVNDPQIILADEPTGALDSKSGAEIEALFNQLHAEGRTLIIVTHDNALAERTKRIITIKDGKVISDRAPIGKENAISHC

SEQ ID NO: 19081 - protein, 339 aa, Hypocrea lixii
MAIPNRKVVITAYGPPSTALQFVTEDLPPPPKDHVQVKILYAGFAGADVNMRLGVYPMQSAPPFTPGYCFAGRVSVNGPGSGKFEPGTLVTALTKYDSDAEYINIPEKYLLAIPDGVDPKVAAALPVDWSTAYGMVHRAAKVSEGQRVFIHGISGAVGQAVMYLSLLQGATVYGTASERNHAALKEAGAHPYLYTNKDWIAAMKDLGGVHAVFDALGFESFDESYSILTPKERSVVVAYGNNLSNLTGAKRRSPWIPMAKLLFKNLYFWSNKGAIFYFITRDQKTFEPELQLLLNMTRDGIITPPIKAVWEFDDIKEAHEAWCKGSGMGSPVIRIARDA

SEQ ID NO: 19082 - protein, 480 aa, Vibrio parahaemolyticus RIMD 2210633
MTSKLRRTKIVTTLGPSTDKDNVLEEIIKAGANVVRMNFSHGTSEDHIQRAKKVRAIAARLGRQVAILGDLQGPKIRVSTFKDGKITLKVGDKFTLDSDLPKGEGNQESVGLDYKELPQDVSPNDILLLDDGRVQLQVTSVEGNKVHTRVTVGGPLSNNKGINKKGGGLSADALTEKDKADIITAAEIKVDYLAISFPRNGEDMHYARRLARDAGLEAKLVAKVERAETVATSESIDDIILASDVVMVARGDLGVEIGDPELIGVQKKLIRRARSLNRVVITATQMMESMINSPMPTRAEVMDVANAVLDGTDAVMLSGETAAGQYPVETVKSMADVCIGAEKMSEASLSTYRLDRTFETAEETIAMATMYSANHMEGIKAMIALTESGRTALMMSRLSSGLPIFALSRNESTLNRAALYRGVTPVYFDAKCDAGLPTAQAAISSLKDQGYLHEGDLVIITQGDVMDVVGSTNCMRILPV

SEQ ID NO: 19083 - protein, 232 aa, Vibrio parahaemolyticus RIMD 2210633
MNKYLAEAFGTFWLVLGGCGSAVLAAGFPDVGIGLLGVALAFGLTVLTMAFAIGHISGCHLNPAVTVGLWAGGRFDTKDVAPYIIAQVIGGLIAGGILYVIATGQAGFDVVGSGFAANGYGEHSPGQYSMLAALVSEIVMTMMFLIVIMGATDKRAPQGFAPIAIGLCLTLIHLISIPVTNTSVNPARSTAVAMYVGDWAVSQLWLFWVAPIVGGVLGAVIYKNLLGKESND

SEQ ID NO: 19084 - protein, 377 aa, Vibrio parahaemolyticus RIMD 2210633
MKIIVDENMPYAEELFSQLGEVILKPGRTLTADDLIDIDALMIRSVTKVNAELISKANKLKFVGTATAGMDHVDQALLKEKGIFFTAAPGCNKVGVAEYAFSVMMVLAQQQGFSVFDKTVGIIGAGQVGSYLEKCLKGMGINVLINDPFKQEAGDPRSFTPLAELIEQSDIITLHTPITKDGLHPTHHLIDEKVLNGLRGDQILINAARGPVVDNQALKQRLMKQDGFTAALDVFEFEPEVDMELLPLLAFATPHVAGYGLEGKARGTTMIFNSYCEFLNNELRAHASDLLPTAPVPTMMLDRAWDEATLHNITQLIYDVRKDDALFRREISKPGAFDLMRKNYWDRREYSAVTLVGNETCNLAPLAELGFQIEVSQ

SEQ ID NO: 19085 - protein, 478 aa, Vibrio parahaemolyticus RIMD 2210633
MLILFRSLLLGSLPSHIHNEVPMFGIFKPKAHIDRLSPDSIDSTYSRLRWQLFIGIFVGYAGYYLVRKNFSLAMPYLIEEGYSRGDLGVALAAVSIAYGLSKFLMGSVSDRSNPRYFLSGGLLMSALVMFCFGFMPWATGSITAMFILLFLNGWFQGMGWPACGRTMVHWWSRKERGEIVSVWNVAHNVGGGLIGPLFILGLWAFNDDWRTAFYVPAFFATLVAVFIWMTVRDTPQSCGLPPIEEYKDDYPDDYDKSHEQEMTAKEIFFKYVFNNKLLWSIAIANAFVYLIRYGVLDWAPVYLKEAKDFSVDKSSWAYFLYEWAGIPGTLLCGWISDKLFKGRRAPAGILFMVLVTLAVLVYWFNPAGNPTIDMMALIAIGFLIYGPVMLIGLYALELAPKKAAGTAAGLTGLFGYLGGAVAANAVLGYTVDHFGWDGGFIILIGSCITSIVCLTYALLGERAHHEQKEREKEQEALA

SEQ ID NO: 19086 - protein, 284 aa, Vibrio parahaemolyticus RIMD 2210633
MTTNKHPSLLGECLAEFIGTGLLIFFGVGCVAALVLTGASFGQWEISIVWGLGVSIAIYCTAGVSGAHINPAVTIALAMFHGFDKAKVVPYIIAQMLGAFFSAALVYSLYSNLFTDYEIAHNFVRSSQDALATAGIFSTYPHASLSFFGAFAVEFVITAVLMFAILALGDENNGAARGAMNPLLIGILIAVIGGSLGPLTGFAMNPARDFGPKLFAYFAGWDYALTGAKDIPYFIVPLLAPIAGACFGGWLYPKAIAAYLPRQGHGCTIPNQCDTEEETEEARA

SEQ ID NO: 19087 - protein, 459 aa, Vibrio parahaemolyticus RIMD 2210633
MAKAKRAYVCNDCGADFPRWQGQCNACGAWNTITEVRIAASPTVARNERLSGYAGSATESKVQTLSEIDLQEVPRFTSGFKELDRVLGGGVVPGAAILIGGNPGAGKSTLLLQTMCTLSGLMPTLYVTGEESLQQVAMRASRLGLPKEHLKMLSETNVDKICQIAEKEQPRIMVIDSIQVMHVSDVQSSPGSVAQVRESATALTRYAKQNNVAVFIVGHVTKDGTLAGPKVLEHIIDCSVLLDGGTDSRFRTLRSHKNRFGAVNELGVFAMTGQGLKEVSNPSAIFLSRGEEETSGSSVMVVWEGTRPLLVEIQALVDYSQLANPRRVAVGLEQNRLSLLLAVLHKHGGLQMADQDVFVNVVGGVKVTETSADLALVMALLSSFRDRPLPKDVVVFGEVGLAGEIRPVPSGQERLNEAFKHGFKKAIVPAANMPKGGIPGMQIHGVKKLSEAIEAFDEL

SEQ ID NO: 19088 - protein, 446 aa, Vibrio parahaemolyticus RIMD 2210633
MSNKRRYFGTDGVRGKVGQYPITPDFVLKLGWAAGRVLAKQGTKKVIIGKDTRISGYMLESALEAGLAAAGLKATFTGPMPTPAVAYLTQTFRAEAGIVISASHNPYYDNGIKFFSSEGTKLPDDIELAIEAELDKDIECVESSELGKATRLNDAAGRYIEFCKSTFPSTLSLSNLKIVVDCAHGATYHIAPNVFKELGADVIAMGVEPNGININEEVGATDVRALQKRVVEEQAHLGLAFDGDGDRIIMVDHLGNKVDGDQIAYIIARDALRRGELKGGVVGTLMTNLGMENGLKQLGIPFVRAAVGDRYVMEQLLAKGWKIGAENSGHVILLDKVTTGDAIVAALQVLASVVGSDMSLHDLSQGMTLYPQVLENVRFAGENNPLEAQAVLAAVEEVEAELGDKGRVLLRKSGTEPLIRVMVEGEDAELVQSSALKIADAVKASC

SEQ ID NO: 19089 - protein, 431 aa, Vibrio parahaemolyticus RIMD 2210633
MTKSSELYQKAQQTIPGGVNSPVRAFNGVGGSPLFIERADGALIFDADGRAYIDYVGSWGPMILGHNHAVIREAVIDAAQRGLSFGAPTEMEIAMAELVSELVPSMEQIRMVSSGTEATMSAIRLARGFTGRDKIMKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYVAPTGPVYQAGTLSGNPVAMAAGFACLNLLKEEGNEKRLASKTKQLADGFKSLAEKHGIPLVVNQVGGMFGFFFTDQETVTCYEDVTKCDIERFKRFFHLMLDHGVYLAPSAFEASFTSLAHGSKEIDATLEAADRCFAIIAAEAK

SEQ ID NO: 19090 - protein, 470 aa, Vibrio parahaemolyticus RIMD 2210633
MIKFGTGGWRAFIGEEFTKDNVRLVAQAVANITNRESVADRGFVIGYDRRFLSDKAGRWFAEVLAANGIVVSFIDKFVPTPIVMFKAKEMGCAYSACITASHNPADYNGIKVFIEGGRDADEIITEKIETQISTLTAQDVKSVDFDQAVEDKLIEIINPMNEFVDSIIDFIDIEAIKKANLRVLIDPMFGVAKNALQTVLINGRCEVDVINDGKNPDFGGLMPSPSAATLYRLMHLVEQEGYDIGIGTDGDADRLGIIDEKGNFIHPNEVLILLYYYLLKYKGWKGSVVRNIATTHLLDKIAEDHGEKCFEVPVGFKHISSQMEADDSLIGGESSGGLTIRGHIKGKDGVFASSLLVEMISVTGKKLSELLDEIYGKYGYAYMAEGDCKFKPAQKAVLFNKIYVEKQLPEFEFDIEKVSYEDGAKVYFKNGGWIIARFSGTEPLLRIFAEMQDKDTAERVLQQFKDFLSL

SEQ ID NO: 19091 - protein, 343 aa, Vibrio parahaemolyticus RIMD 2210633
MSCALSIKNLTCQYDAQTVLESLSLEVEQGQIVCLLGASGCGKTTLLKAIAGLLPLTSGQMSLNCQTIDDGENWLPPEERNIGMIFQDYALFPHLTVAQNIAFGLKHQSAQEKRAKVDEMLELVHLQGYADRYPHQLSGGQQQRVAIARSLAYSPDLLLLDEPFSNIDTQVRHELISEIRKIFKAQGVTAIFVTHSREEAFAFADKMAVMNHGVIEQYGTASELYYQPSSKFVADFLGGGSYLAATRISDTEYETHIGVVEASAQQEIQMQSACSLLLRPQHVQIQSDEDSAVTVLEQHFMGDHCRYVIDANGDRLLAIASQPLHIGERVAVKIETQGVLAFA

SEQ ID NO: 19092 - protein, 409 aa, Vibrio parahaemolyticus RIMD 2210633
MELATTVTELRYALDTFFFLISGALVMWMAAGFAMLEAGLVRSKNTTEILTKNFCLYAIACTTYLVIGYNIMYVDNGEGGWLPSFGGLIGTQGEGADHSLESDFFFQVVFVATAMSVVSGAVAERMKLWSFLLFSAVLTAFIYPMEGYWTWGGGFLSEAGFSDFAGSGIVHMAGASAALAGVLLLGARKGKYGKNGEIYPIPGSNMPLATLGTFILWFGWFGFNGGSQLMVSDFENATAVGQIFLNTNAAAAAGSIAALFVCKTTWGKADLTMILNGALAGLVAITADPLSPSPLYAVAIGAVSGALVVFSIIGLDKLKIDDPVGAISVHGVCGFFGLMVVPLSNGEATFGAQLLGAAVIFAWVFGASLVVWAILKATVGIRVTEEEEMEGMDMHDCGVGAYPEFVTVK

SEQ ID NO: 19093 - protein, 176 aa, Vibrio parahaemolyticus RIMD 2210633
MKHTIEVMISEQEVQERIRELGKQITERYQGSEDLVLVGLLRGSFVFMADLARAIELTHQVDFMTASSYGNTMESSRDVRILKDLDDDIKGKDVLLVEDIIDTGNTLNKIREILSLREPKSIAICTLLDKPSRREVNVPVDWIGFEIPDEFVVGVGIDYAQKYRHLPFIGKVVPQE

SEQ ID NO: 19094 - protein, 475 aa, Vibrio parahaemolyticus RIMD 2210633
MSKEIKAQVVVLGSGPAGYSAAFRCADLGLETVLVERYSTLGGVCLNVGCIPSKALLHVSKVIEEAKAMADHGVVFGEPQTDINKIRIWKEKVVNQLTGGLSGMAKMRNVTVVNGYGKFTGPNSILVEGEGESTVVNFDNAIVAAGSRPIKLPFIPHEDPRIWDSTDALELKEVPEKLLIMGGGIIGLEMGTVYHSLGSKVEVVEMFDQVIPAADKDIVKVYTKRIKDKFKLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKAEGIKYEVATFPWAASGRAIASDCSDGMTKLIFDKETHRVIGGAIVGTNGGELLGEIGLAIEMGCDAEDIALTIHAHPTLHESVGLAAEVFEGSITDLPNKKAVKKK

SEQ ID NO: 19095 - protein, 316 aa, Vibrio parahaemolyticus RIMD 2210633
MEHKQIVITEFGDANVLAIQSAETPIPKSGEVLVKVHYAGVNPIDVKTRAGLGWAASQNKDKLPWVPGYDISGKVASCGTKTSRFAVGDEVAGFIGFPLQGGGYSQYVCVPESELSHVPSSVTLEAAAVLPLAGQTAAQALSKANVSECDRVLILAGAGGVGHLAVQIAVATKAEVFTTCSERNLDYLATLGAHAVNYQFAPVSERVEGVDVLIDLVGGDAALDALKCLKDNARVITVPTISAELICDKAKLLGFEASGMLVEPDPSQLDTLLYMVGVGLLKTEVQHIYPMAEVIAAHQQVESGRTRGKVLLDMTC

SEQ ID NO: 19096 - protein, 433 aa, Vibrio parahaemolyticus RIMD 2210633
MSKIVKVLGREIIDSRGNPTVEAEVHLEGGFVGMAAAPSGASTGSREALELRDGDKARFLGKGVLKAIEAVNGPIAEALVGKDAKDQAAIDAVMIELDGTENKSKFGANAILAVSLANAKAAAAAKGMPLYEHIAELNGTAGQFSMPLPMMNIINGGEHADNNVDIQEFMIQPVGAATLKEAVRMGAEVFHNLAKVLKSKGYNTAVGDEGGFAPNLKSNAEALEVIAEAVAAAGYELGKDVTLAMDCAASEFFDKEAGIYNMKGEGKTFTSEEFNHYLAGLVEQFPIVSIEDGLDESDWDGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 19097 - protein, 410 aa, Vibrio parahaemolyticus RIMD 2210633
MAKVSLEKEKIKILLLEGLHPSSVEVLQAAGYTNIEYHKGSLSEEELIEAVKDTHFIGIRSRTNLSEEVINAANKLVAIGCFCIGTNQVDLGAAAKRGIPVFNAPFSNTRSVAELVLGQILLLLRGIPEKNALAHRGIWKKSADNSYEARGKRLGIIGYGHIGTQLGIIAENLGMRVYYYDIENKLSLGNATQIHTMSELLNKCDVISLHVPETPETKNMMGEEEFARMKPGAIFINAARGTVVDIPALCHSLEAGHLAGAAIDVFPVEPKTNADPFESPLQKFDNVILTPHVGGSTQEAQENIGVEVAGKLAKYSDNGSTLSSVNFPEVSLPEHGRECSRLLHIHKNRPGILTQINTIFAEEGINIAAQYLQTEAEIGYVVIDVETERSEEALTKLKSIEGTIRARILH

SEQ ID NO: 19098 - protein, 386 aa, Vibrio parahaemolyticus RIMD 2210633
MSVIKMTDLDLAGKRVFIRADLNVPVKDGKVTSDARIIASLPTIKHCLEAGAKVMVTSHLGRPTEGEYAEEFSLQPVVNYLNDALDCEVKLAKDYLDGLELNAGELVVLENVRFNKGEKKNEEELSKKYAALCDVFVMDAFGTAHRAQASTHGVGMHAPVACAGPLLANELEALGKAMDKPARPMVAIVGGSKVSTKLTVLESLSKIADQLVVGGGIANTFIAAAGHNVGKSLYEADLVDTAKKLMDECAIPVATDVACAKAFDENAEAEIKHVSEVQDDDMIFDLGPESTAALAEILKNAKTILWNGPVGVFEFKNFEAGTKGISEAIAASEGFSVAGGGDTLAAIDKFGIKADVSYISTGGGAFLEFVEGKVLPAVEMLEARAK

SEQ ID NO: 19099 - protein, 306 aa, Vibrio parahaemolyticus RIMD 2210633
MKPTAEILTDILAEVRPLIGQGKVADYIPALAKVPNNKLAIAVYTNEGEVIKAGDADESFSIQSISKALSLTLAMCLYKQEEIWARVGKEPSGQAFNSLIQLEMEQGIPRNPFINAGAIVVADLLQSRLSAPRQRLLEFVRQLSGDTHIVYDKVVAASEMMHGDRNAAIAYLMRSFGNFENEVIPVLQNYFHACALKMSCVDLAKTFSYLANKGTSVQTGKPVVSPTQTKQLNALLATCGLYDGAGEFAYRVGMPGKSGVGGGIIAVVPGEMTIAVWSPELDASGNSLAGTKALELLSERIGRSIF

SEQ ID NO: 19100 - protein, 477 aa, Vibrio parahaemolyticus RIMD 2210633
MQQIKNETLKEVFKQWASDDGVVVINPATEQELIRLKPSSIEELDCLIEACSAEQVRWAKLSAKERSSCLKNWHQLLMEHAEDIATIITLEQGKPLSESRGEVSYGASFVEWFAEEARRAYGEVIPAPAIDRRLSTIKQPVGVCAAITPWNFPIAMITRKAAPALAAGCGMIIKPSELTPLTALAVVELAYQAGIPKPLLPVVISEQAAEFGQVLSMDPRIKKISFTGSTRVGKILMKQASETVKAVSMELGGNAPFIVFEDADLESAADGLIASKFRNAGQTCVCTNRLYVHQNAKERFMEKVLAKMTELNVGNGLESGVTVGPVITMASKHRLEAVIDQALQEGATIANRPQKLAGRFMEPVILDNVDQGMAIVQQELFGPVLPVLTFEDDEQVLAMANDTEYGLACYFYTDSLKRIIKFTEGLEYGMVGVNEGIISTEVAPFGGIKESGVGREGAKQGLDEYLETKYICLGGLN

SEQ ID NO: 19101 - protein, 267 aa, Vibrio parahaemolyticus RIMD 2210633
MSNNDLVTVNNLTFSRGNRTIFDGIDLHVPEGKVTAIMGPSGIGKTTLLRLIGGQLYPEQGEIWFDGDNIPTLSRKKLYNARKKMSMLFQSGALFTDLNVFDNVAFPLREHTNLSEDLIRTMVLLKLEAVGLRGAAQLMPSELSGGMARRAALARAIALDPDLIMFDEPFVGQDPITMGVLVELIKDLNQALGLTSIVVSHDVPEVMSIADWVYLLADGKIIAFGTPEELSQNPDPRVQQFLQGDADGPVPFRFPAQSIEKDLFDGR

SEQ ID NO: 19102 - protein, 320 aa, Vibrio parahaemolyticus RIMD 2210633
MSLPKVVFLDRATIPNHIQVPRPEFPHHWMEYALTPPEFVVERLADADIVISNKVVLDQSVLSQLPQLKMIAVAATGFNNVDVNYCAEHGIAVANVRGYATRSVPEHVIAMLFALRRNLFGYHQDIAAGEWQRNKQFCFFTHSIGDVGGSTLGVVGSGALGQATANLAQALGMTVLFAERKGAAECRPGYVPFEEVLKHSDALTLHCPLNEHTQNLIGKAELQQMKPNAILINTGRGGLVDEQALVDALKQGEIAAAGFDVFTQEPADESNPLIANIHLPNLLLTPHVAWGSDSSIQRLADILIENINAFQRGDLLNRLA

SEQ ID NO: 19103 - protein, 223 aa, Vibrio parahaemolyticus RIMD 2210633
MKDFLIAPSILSADFARLGEDVEKVLAAGADVVHFDVMDNHYVPNLTFGAPVCKALRDYGITAPIDVHLMVKPVDRIIPDFAKAGASMITFHVEASDHVDRTLQLIKEHGCKAGVVLNPATPLAHLEFIMDKVDLILLMSVNPGFGGQSFIPHTLDKLRAVRKMIDESGRDIRLEIDGGVKVDNIREIAEAGADMFVAGSAIFGQLDYKQVIDQMRTELAQVE

SEQ ID NO: 19104 - protein, 386 aa, Vibrio parahaemolyticus RIMD 2210633
MSTRKPATIAVRTGIESDSQYHAVVPPIYLSTNYGFPAFGEVPKYDYTRSGNPNRGLLESALSELESGKGAVVTNCGTSALNLWVSAFLGPDDLIVAPHDCYGGTYRLFNTRANKGDFKVQFVDQSDEQALEAALAKKPKLILLETPSNPLVRVVDIAAVCEKAKQVGALVAVDNTFLTPVYQKPLELGADFVIHSTTKYINGHSDVIGGVVITKTEAHAEELAWWGNCIGATGTPFDSYMTLRGIRTLGARMRVHEESSQHVLNYLQQQALVAKIYHPSLPDHPGHEIAKKQQSGFGSMLSFEFAGSFEQLKVFVKELELFSLAESLGGVESLICHPASMTHRAMGEEALAEAGVSHQLLRLSVGLEDAQDLIADLDQAFVKAAQ

SEQ ID NO: 19105 - protein, 260 aa, Vibrio parahaemolyticus RIMD 2210633
MKSVLKVSLLAATVMLAVGCQKEETKPEAAPQAEQVQAETGKAVHFKTDDDKAAYAIGVSFANYLSTSIEKPSEIGINLNKDLVLKGIEDVFKGNAELNEEETRAALESLDKRVAEKMQAQAAEKAAAAKKAGDDFRAEFEKQEGVVKTDTGLLYQVITPAEGEKPKDTDTVQVHYKGTLIDGTQFDSSYDRGEPATFPLNRVIPGWTEGVQLMPVGSKFKFVIPPELAYGDQDTPSIPANSTLVFEVELLKVENDKAEQ

SEQ ID NO: 19106 - protein, 403 aa, Vibrio parahaemolyticus RIMD 2210633
MTTEIKVERGLFDEVMVPCYNPMEMIPVRGKGSRIWDQDDNEYIDFAGGIAVSCLGHCHPVMVDALTEQGNKLWHLSNVMTNEPALRLAKKLTEVSFAERVFFANSGAEANEAALKLARRYAADVHGPEKSEIIAFKQGFHGRTFFTVTVGGQAAYSDGFGPKPGDVTHLPYNDIEALQAHMSDRTCAVMMEPLQGEGGIVPPTPEFAQAVRELCDKHNALLIFDEVQTGNGRTGHFYAYQGLGITPDILSTAKSLGGGFPIGAMLTTAKLAEHLKVGTHGSTYGGNPLACAVAEAVVNEVTKPEVLAGVLEREALFRAGLEKINAKYNLFSEVRGKGLLLGAALNEEWQGRARDVLVAAGKQGLLVLVAGANVVRFTPSLVITQQEIEEGLAKLDKAIATLV

SEQ ID NO: 19107 - protein, 510 aa, Antithamnion sp.
MNNKSISPIILMILDGWGHSTNAKGNAIHEANTPIIDKLWDNYPKTLLSASGEHVGLPHKQMGNSEVGHTTIGAGRIINQDLVKISKSIKNKEFFNNYQLHNIYKYSCEKNSKVHIVGLCSNGGVHSHINHLKALIQISKQYKVMTCLHLITDGRDTLPKQAKLFVKEIIDIIDENYNTEICTISGRYYSMDRDCRWSRTEKAYKAMVENSCNQNSSSDILSIIDKYYEQNISDEFLPPTKISMHNIVHNDSLIFFNFRPDRIRQLLHSFAKPNFKGFQRKTIKNLMLTTFTEYDSTLSIPTVFPNEPKKNFLGQIISNSGLKQLRLAETEKYAHVTYFFNGGIEEPFPGENRELIASPKVETYDLPPEMSAYQLTNSLIEAINKQLYQFIVINYANPDMIGHTGNMNATIEAIEIVDQCIEKVLHTIEDTNNILIITSDHGNADYMLTDENKPCTSHSINPVPFILINNRQKKQTNLHSHGSLADIAPTILDILNINIPNEMNGKSLIT

SEQ ID NO: 19108 - protein, 510 aa, Vibrio parahaemolyticus RIMD 2210633
MSAKKPLALVILDGYGYREDTASNAIANAKTPVMDALIANNPHTLISASGMDVGLPDGQMGNSEVGHTNIGAGRVVYQDLTRITKSIADGEFEQTPALVEAIDAAVKAEKAVHIMGLMSPGGVHSHEDHIYAAVEMAAARGAEKIYLHCFLDGRDTPPRSAENSLQRFQDLFAKLGKGRVASLVGRYYAMDRDNNWERVQVAYDLLTQAKAEFTAETAVAGLEAAYARDENDEFVKATAIKAEGQEDAIMQDGDAVIFMNYRADRARQITRAFVPGFDGFERAVFPAINFVMLTQYAADIPLATAFPPASLENTYGEWLSKQGQTQLRISETEKYAHVTFFFNGGVENEFEGEERQLVASPKVATYDLQPEMSSPELTEKLVAAIKSGKYDTIICNYPNADMVGHTGVYEAAEKAIEALDESVGKVVEAIKEVGGQLLITADHGNAEMMIDPETGGVHTAHTNLPVPLIYVGDKAVEFKEGGKLSDLAPTMLSLAGLEIPAEMSGDVLVK

SEQ ID NO: 19109 - protein, 466 aa, Vibrio parahaemolyticus RIMD 2210633
MAHVNHYDVIVIGSGPGGEGAAMGLTKAGLNVAIVEKESSVGGGCTHWGTIPSKALRHAVSRIIEFNSNPLFCRNNTSLHATFSDILGHAKTVIDKQTRLRQGFYDRNDCTLLFGTARFIDTHSIAVMQNDGTEETYSADKFVIATGSRPYRPSDVDFLHERIYDSDSILSLKHDPRHIIIYGAGVIGCEYASIFRGLGVKTDLINTRDRLLEFLDNEVSDALSYHFWNSGVVIRNDETYEKIEGTEDGVIIHLQSGKKMRADCLLYANGRTGNTDKLSLDVVGLESDSRGQLKVNRNYQTAVEHIYAVGDVIGYPSLASAAYDQGRFVAQAITKGQAENYLIEDIPTGIYTIPEISSVGKTEQELTAAKVPYEVGRSSFKHLARAQIAGKDVGSLKILFHRETKEILGIHCFGERAAEIIHIGQAIMEQKGQANTIEYFVNTTFNYPTMAEAYRVAALNGLNRLF

SEQ ID NO: 19110 - protein, 232 aa, Vibrio parahaemolyticus RIMD 2210633
MIVFSQLSRDYTLGSQTVRALQDVSGEVFAGEMVALCGPSGSGKSTLLNVLGMLDSQYQGQVTFAGQPYPSGQMQAAKMRREKLGFIFQKFNLVPVMTALENVAYPLHLNGFSKTEQTELASQMLEHVGLGEFIHHMPDNLSGGQQQRVAIARALVHKPALVIADEPTASLDSQTANKVIDIMKGLGHEFGTTFIVATHDPRMASRCDRTIELVDGKIIQTHASVEEVSWAS

SEQ ID NO: 19111 - protein, 382 aa, Vibrio parahaemolyticus RIMD 2210633
MTLEIKPGQTHIKSKAMVAWAAGEPLKMEEVDVQLPKAGEVLVRIVATGVCHTDAFTLSGDDPEGIFPSILGHEGGGIVEMVGEGVTSVEVGDHVIPLYTAECGECKFCKSGKTNLCQAVRETQGKGLMPDGTSRFSINGETIFHYMGCSTFSEYTVLPEISLAKVNKQAPLEEVCLLGCGVTTGMGAVLNTAKVEKGDTVAIFGLGGIGLSAIIGARMAGASRIIGIDINESKFDLAKQLGATDVINPQKFDKPIQEVIVEMTDGGVDYSFECIGNVNVMRQALECCHKGWGESVIIGVAGAGQEISTRPFQLVTGRVWRGSAFGGVKGRSELPEIVNRYMAGEFGLQEFITHTMGLEDVNKAFDLMHEGKSIRTVIHMDK

SEQ ID NO: 19112 - protein, 331 aa, Vibrio parahaemolyticus RIMD 2210633
MINIAFFSAKSYDEASFNKIKNNRDFEFHYHDFRLTEKTAKMAHGCDVVCAFVNDDLSAPVLKQLSLGGTKLIAMRCAGFDKVDQQAAKELGLQVVRVPAYSPEAVAEHTVGLMMCLNRRLHKAYQRTRDANFSLEGLVGFNFFGKTVGVIGTGKIGIATMRIFKGLGMELLCYDPYENPLALEMGARYCSLEEIYANADVISLHCPMSEENYHLLNENAFAQMKDGVMIINTSRGELLDSVAAIEALKQGKIGALGLDVYDNEKDLFFQDKSNDVIVDDVFRRLSACHNVLFTGHQAFLTHEALNNIASVTLNSVETFFSGQVSGNELIN

SEQ ID NO: 19113 - protein, 306 aa, Vibrio parahaemolyticus RIMD 2210633
MNDLFTKTDYSLYSNSMSFLRLPYIRNPVSADADVVVLGVPLDMATSGRPGARMGPDAIRRASVNLAWEGKKFPWDFNVLDKLKVIDAGDLVFDCGDAEDFTYRLEAATSEILKSGKTMLGLGGDHFITLPILRAYAKHHGQMALIHFDAHTDTYANGSSYDHGTMFYHAPKEGLISAKNSVQIGIRTEYKQQDHGFNVINAMQANDMSVNEILEEIRRTVADKPVYVTFDIDCLDPAFAPGTGTPVCGGLNSDKALKIIRGLAGMNIVGMDVVEVSPPYDHSDVTALAGATIALEMLYAYASGRE

SEQ ID NO: 19114 - protein, 463 aa, Vibrio parahaemolyticus RIMD 2210633
MIEFPDNFLWGGAIAANQVEGAYNLGGKGLSTSDMLPNGILSPHQTREERTPGIKDLAIDFYNRYPEDITLFKEMGFTCLRLSIAWSRIFPNGDELEPNEEGLAFYDKIFDELAKHDMQPFVTLSHYEMPYALVENYGGWGDRRVIEFFERYAKTVLERYKDKVKLWLTFNEINMSLHAPFTGVGLPEDATEQQIYQAIHHQLVANAKAVKLCQEIVPNGKIGNMLLGAMNYPYTCNPDDVLAAMHENNKWLFFGDVQTRGQYPGYMKRYFRENGIEIQMQDGDLEDIASASVDFISFSYYASGCASADPKQKEVGNIVESVPNPYLEKSQWGWLIDPKGLRILLNFLHDRYQKPLFIVENGLGARDEFDENGEIQDDYRIAYLNDHLVQAHEAILDGVELMGFTSWGPIDLVANSTAEMSKRYGYIYVDRHDDGQGTLERKRKKSFYWYQDVIRTAGGSLKR

SEQ ID NO: 19115 - protein, 459 aa, Vibrio parahaemolyticus RIMD 2210633
MTQNIKPTHFRSEGDVNTTPARQAWNASMDDERTQVLLKRDSEVFLHQAMSTPCLDTLDAAEGIYIQDATGKKYMDFHGNNVHQLGYGHPHVIKRVQEQIAKLPFSPRRFTNETAIECAEKLTQICGGELNRVLFAPGGTSAVGMALKLARHITGNYKVVSLWDSFHGASLDAISVGGEACFRQGMGPLMAGVERIPPAVSYRGAFPVADGSDVHYADYLEYVIEKEGGVGAFIAEAVRNTDVQVPSKAYWKRIREICDKHNVMLIIDDIPNGMGRSGEWFTYQAYDIEPDMLCIGKGLGGGLVPIAAMVTKDKYNTAEQISMGHYTHEKSPIGCAAALATMEAIEQDGLLDKVKADSQFMREKLLEMKAKYPVIGDVRGIGMLWGIELVTDHESKARAYDEAEAVLYQCLNNGVSFKVSQGNVIQLSPPLIITREQLTEALAIFEEAIAKVCKDFNYF

SEQ ID NO: 19116 - protein, 372 aa, Vibrio parahaemolyticus RIMD 2210633
MSINQPYLNIKNVVKQFGQFTALKQISLAIEKGEFVCFLGPSGCGKTTLLRAIAGLDLPTSGAIFQNGQETTFLPPEKRDFGIVFQSYALFPNLTVQENIAVGLKNQGMSTKEALEKVEQWLETIGLPTSGQKFPNQLSGGQQQRVALARALALSPGLLLLDEPLSALDAKVRVHLRDEICKLQRKLGITTIMVTHDQDEALSMADRIVVMNHGVIEQVGTPQEIYQQPATRFVAEFVGSMNFIETSVVTESQVRIAETLLPAPSLTNRKIQRGDRFDLAVRPENIKFVENYRNSLPVRITATEFLGAFFRVDCELQNDSQAKPIVVDVPVETVQNLNIRIGDVRYIQFLESGLHGYVIPSQGNAFTKALAA

SEQ ID NO: 19117 - protein, 339 aa, Vibrio parahaemolyticus RIMD 2210633
MSYVTAKNLTKRFGDNTVFEDIQFAIEQGEFITLLGPSGCGKSTLLRSLAGLNPVDGGEIWVNGEEITHQVPQERGIGMVFQSYALFPNMTVEGNIAFGLKMKKLASDEIQREVTKVIELVDLKGKEKHYPHQLSGGQRQRVALARALVVKPRILLLDEPLSALDAKIRKHLRQQIRDIQKEMNLTTIFVTHDQEEAMIMSDRIFLMNKGEIVQAGTPEAIYTHPANEFVAGFMGHYNLVDANKAKQLFNIDTKWKVAIRPESIYVKEHGRQYGNHISAPQMGTIKNHQLLGNVIRYQVCVEECDLTVDLLNRSSERLLANGSQLELLFNLNEIQPVRA

SEQ ID NO: 19118 - protein, 374 aa, Vibrio parahaemolyticus RIMD 2210633
MKQRPNKLFEPAQLKALSLQNRIVMAPMTRARTTQPGNIPNEMMATYYQQRASAGLIISEATQISDDSQGYSFTPGVYTDAQVAGWQGVTQAVKLQGAAMFCQLWHVGRVSHPTFQNGEQPIAPSALAPVETQVWIADEQGNGNMVDCVEPRAMTQADINRVVGDFANAAKRAIESGFDGVEIHGGNGYLIDQFLRTNSNHRTDNYGGSRENRIRFLIEVVDAVIAAVGAHRVGVRLAPFITFKDMDCPDIVPTILEASKQLQERDIAYLHLSEADWADAPTIPETFRIELRKRFRNAIIVAGRYDPQRANEVLEKGYADLVAFGRPFVANPDLVSRLQHHHPLAELDGSTLFGGNERGYTDYPALQQECAEQA

SEQ ID NO: 19119 - protein, 1422 aa, Vibrio parahaemolyticus RIMD 2210633
MIEIVIDGKYRIVEEGLTLLEAAKVCGVEIPSLCGMNKSNEKIPCDLCVVEVESGGTKRACDLKVYRGLNVVTQSEQLSEHRRKALNRIMTDHYADCEAPCKTACPAGVDIQSYLYHISQNDHQKAIEVIKRTLPMPLSIGRVCPAFCESECRRSLVDEPIAIRQLKRHAADADLAAHEAYVPEKKPAKHRKIAVVGSGPGGLTAGYYLSNEGYDVTIFESMPKAGGWLRYGIPEYRLPKDILDKEIELMCRNGMQVETNKKLGVDFTLSQLSEDYDAVCLAVGASQAVEMNYPGSDLDGCYLGVDYLKDYVTEQNYVTGKKVAVIGGGNTAIDCARTARRAGADTTLIYRRTRDEMPAEDYEIVEAEHEGVTFHFLTNPAENIADENGRVKAIRLERMALGEPDASGRRSPKPTGEFFTEAFDTVIAAVSQKPDLSFLENDDLSIPLTRWNTSESDSQTMHTGTGNIFSIGDFRRGPATAVEAVGDGRVAAKAIDLFLNGDMADMPKPAFNSRKEKKLAQVDPLHFENIQKVARSIMPELTPAQREQSFAEVELGFDNEEAMKEAARCLECGCQANTDCALRDYSTEYHAEQHFDVSVDVSSASVIGHQDWLDLRAKDLRHKYEVDRSSEFIEFDANRCISCGQCIQACREQAVHGVLSFVSDKNGRPALRPDDRPRFRSDEKGVGCSGLTLMGDSKCVQCGVCVQACPTGAMVDSRDRSQGRTEQLKAVDTICTYCGVGCKLTMFVDERQNKIRYVKGADSPVNQGMLCVKGRFGFDFISSEERLTTPLIRKDGWLQPATWDEAIQLVASKLSTIKQDFGSNALAGFSSAKTTNEDNYAFQKFIRRELGTNNVDHCARLCHASSVTGLEASLGSGAMTNDIPSIKHSDVIFIIGSDTTSAHPIIASHIKQAIRHHGARLIVADPKRVDMAEHAELYLAHRPGTDVMLLNGVMQQIIKNGWYDQEYIEERVDGFDTLLQEVMSPAYNLDKVELVTGVKADDIFAMARMIGTAKRTAVYYSMGITQHTTGHDNVRSIANLQLLCGNIGIEGGGINPLRGQSNVQGACDMGALPNCYPGYQKVYNPIVRQKFAIEWDAPNLPSEQGLTLTEIIDAACKREVRGMYIMGENPVLSDPNQAHVIEGLEALDFLVVQDIFLTETAQYADVVLPSCSFAEKSGHFTNTERRVQRVNAAVKAPGEAKEDWWIIQAIANAMGSDWHYQCVSEITSEIARVTPQYAGLRWDAITPNGVQWPSNKNNPNGTRIMHQTQFTRGKGQMVGVPFRYAAELPDEEYPLVLTTGRVLEQFHTGTMTRKTKGLDNLAGPRAMISVEDAEAIGIHNGQRLKVSTRRGNIEIDAFVTKRMQKGVVFIPFHFVESPVNRLTTTATDPHAKIPEFKVAAVKIEISETAAQPEPVEEAVHHV

SEQ ID NO: 19120 - protein, 157 aa, Vibrio parahaemolyticus RIMD 2210633
MSKFLFPIIIFVLAAFFIYRTWTNHKVADENFAKGQAFLLENAKKEGVITTESGLQYLVLEKGTGDVHPTATSKVKVHYHGTLIDGTVFDSSVNRGEPITFGLNQVIKGWQEGLQYMVVGEKIRLFVPSTLGYGKNGTGPIPPASVLIFDVELLEIQ

SEQ ID NO: 19121 - protein, 300 aa, Vibrio parahaemolyticus RIMD 2210633
MSTIAFIGLGRMGNPMAQNLLASGFNVQIFDVDVEAAKQLVPFGAVVASELEEVVDGASTVITMLPAGSHVRSVYLGDLHGGVGVMNLVAPNTLLIDCSTIDPDSARLVANEAANKRLLFVDAPVSGGVAGAKAATLTFIVGGSDEAFSKANAILQYMGKNVFHAGKAGDGQMAKICNNLMLGILMSGTCEALNLGIDHGLDPKVLSNIMLQSSGRNWALELYNPCPGVMDSAPASHDYQPGFMSKLMLKDLGLGLDAALQTHSSVPMGALARNLYAFHNSSGHGELDFSSLFEFYKNNK

SEQ ID NO: 19122 - protein, 367 aa, Vibrio parahaemolyticus RIMD 2210633
MSILFSEARIGSMTLKNRFVRSATWENMATEDGHMTAKLYDIYEELAKGEVGLIVTGYANIVEEEKPNAGMMGIYNDSFIEEYKKLTELVHQYDSKIVMQIAYGGTKTTYNVGERVIFAPSDVPERGTNTQGKAMTKDEIDYIVKAFALASKRAQDAGFDGVEIHAAHTYLINQFLSPYYNRREDEYGGSLENRMRLLLEIYSETRTLVGDAFPILVKLTATEFFDGGLTFDETRIVCKKLEEVGVDAIIVSGNIHGKANELVGERFDGYTLQEEGYFHEYGQVISQDIHIPVITVGGLRDIDAIENIADNTNIQFFAVSRPLLAEPQLIKRWKEGNRAPVDCERCSKCRTKRGNFCVVYKNRNRRS

SEQ ID NO: 19123 - protein, 247 aa, Vibrio parahaemolyticus RIMD 2210633
MRYCSMSIQVSGINKSYGDTQVLHDVSFNCENGETLVLLGPSGAGKSSLLRVLNLLEGADNGKLNIANDVFDFSAEIKEKQGLALRRKVGMVFQQYNLWPHMTVMENLIEAPIKVSGMDKEEAKTQAMQILSTLHLADKADAWPMQLSGGQQQRVAIARALMMKPEVLLFDEPTAALDPEITNQVVKIIKDLSETGITQVVVTHEVDFAKKIASHVLYLEKGHIVEHGTHDAFANPQTTQFADYLKH

SEQ ID NO: 19124 - protein, 470 aa, Vibrio parahaemolyticus RIMD 2210633
MNAIAEVDVDNSLQQSLDRLKAAYVAEPYPSLDERKQRLIMLKQALIANKQALVEALSDDFGYRSEFDTAMTDVLPTVSHINYTLKRLKKWCKPSKRESGLLLAPSKVTVQYQPLGVVGIISPWNFPVILSLAPLVTALAAGNRVMMKLSEFTPKTNKVIVNICHELSEYVEVFEGEADVAQAFSQLPFDHLLFTGSTNVGRAVAKAAAENLTPVTLELGGKSPVIITEDADMKKTVDAILFGKCINAGQICVAPDYAFVPQERIEEFITLFLKRFEKLYLKSNKNQKLTHIINQRQYERLTALLEDAKTQGASLHTVEASPQEERLLYPHLVTNVSADMRIMQEEIFGPLLPIKPYKSLEEAIDYINQHQRPLALYVMSDDKSTIKHIVRNTHSGGVGINDTVLHVGAEDAPFGGIGQSGIGHYHGVEGFRTFSHAKTVLHTPKWLPRTGALMRRRAMAIKAIQKIFVR

SEQ ID NO: 19125 - protein, 366 aa, Vibrio parahaemolyticus RIMD 2210633
MTDALFQPIQLGSLSLKNRIVMPPMTRSRASQPGNVANDMMATYYAQRAEAGLIVAEGTQISPMGQGYAWTPGIYSPEQIAGWKKVTDAVHEKGGVIFAQLWHVGRVTHPDNIGGEQPISSSALKAENVKVFIDNGTDEPGFVDVVEPREMTKQDIKNVIEEYRQAALNAIKAGFDGVELHAANGYLVNQFIDSEANNRTDEYGGSIENRLRFLGEVVEAMTQAIGAERVGVRLAPFTSLNGTVDSTPVDTYTAAAALLDKLNVVYIHIAEVDWDDAPDTPHDFKTAVRKAYKGTLIYAGRYNAEKAQHAIESGLADMIGFGRPFVANPDLPSRIKHGYPLAEHDPATLFGGGEKGLVDYPAYHAG

SEQ ID NO: 19126 - protein, 244 aa, Vibrio parahaemolyticus RIMD 2210633
MKENTPVVEFSNVNKWYGDYHALKDINFSVHSGEIVVVCGPSGSGKSTLIRCINHLESIQEGQLYVFDQPSHAQSLKPGKIGMVFQHFHLFPHLTVLENLTLAPIRTLKLSKQEAEKRARHYLKRVNIEEQASKYPIQLSGGQQQRVAIARSLCMEPDLLLFDEPTSALDPEMINEVLDVMVELAQSGMTMICVTHEMGFAKKVANRVVFMDEGQIVEMNSPTALFETPQHPRTQAFLNQILSY

SEQ ID NO: 19127 - protein, 492 aa, Vibrio parahaemolyticus RIMD 2210633
MCKTKIVATLGPASESRETLTKLIRAGANVVRLNFSHGTAQEHIARANLVREIAAELDTYVGVLVDLQGPKIRISCFENGAVLLNQGDVFTLSGTLDAQSGTQEMVGLDYPELIQDVNEGDILLLDDGRIQLKVSQLHRDEQWIKTTVLNSGKLSNRKGINLLGGGLSAPALTAKDIQDIDTAAKLRADFLAISFPRNAQDIEYARSLAQKAGCHAKIVAKVERAEVVETKEAMDDVIKASDIIMVARGDLGVEIGDARLPMVQKSLINRSKHWGKPVITATQMLESMIENPLPTRAEVLDVANAIIDGTDAVMLSAESAAGKYPIEAVEAMVRIAQGAEHELECNHDCWDTLQHLCSNPGKSFALSSMISASRVHQDLGVAILTQHGETPLLMSRCQSKTKIWALSDNPALLAQMTILRGVEPLYFKAAESHVDLAPQLVECLRQKANEAHISSILMTQLDSIEGMGEINACRLLSLNVSSHMKPAEEIAA

SEQ ID NO: 19128 - protein, 459 aa, Vibrio parahaemolyticus RIMD 2210633
MFNFFKTRPDLPLSDGSKEEMQARFKRYQWHVFLGLVFGYAVFYVVRMSLGVVKKPMLDAGIVTIEELGIMGSAFFFTYAFGKFSNGFLSDYANIGRFMSFSLLLSGITAVFMGLNTTAFFFVLLWGLNGWFQSVGSAPSCVSLFQWFSPKQRGSRYSIWGGSRNIGEGITWILTASLVSYFGWRAGFIGAGIAAIAAAICMFFILKDRPQTYGLPDSATAFDEEPEIKKKNDPQATRRAQMFILKQPTVWLIAAACAAMYISRYAMSSWAVLYLQEAKGYSLIDAGFAMSTYPIAGLAGAILSGIISDKVFNSNRHIPTLLYGLANIGGMCLMFFGPDNRIVDAVALGMIGFAIGGLVVFLAGLTACDLMPKNAVGAVKGFIGLFSYIAASGQELASASLIKITEVDGVTKYDFAQAQYFWLAAGVISLLLALTVWNAKKVVDIDPVEEKELEARPSH

SEQ ID NO: 19129 - protein, 464 aa, Vibrio parahaemolyticus RIMD 2210633
MLKFLEQVRKPTLDLPVEVRRKMWFKPFIQSYLVVFIGYLTMYLIRKNFNVAQNDMISTYGLSMTDLGLIGLGFSITYGIGKTVVSYYADGKNTKQFLPFMLILSGLAMLGFSFSMGGGSASLFLMVAFYALSGFFQSTGGPSSYSTITKWTPRNKRGSYLGLWNMSHNVGGAGAAGVALFGANYLFDGHVIGMFVFPSIIAIIVGFIGMRFGSDSPEAYGLGKVEELFDEAVSEEDTAAEENQMTKKEIFVEYVLKNKVIWLLCFANIFLYIVRIGIDQWSTVYAYQELGLSKETAISGFTLFEVGALVGTLMWGYLSDLANGRRALVACVSLGLIIVSLEFYQHATNEFMYLSSLFVLGFLVFGPQLLIGVAAVGFVPKKAISVADGVKGTFAYLIGDSFAKLGLGMIADGTPIFGLTGWKGTFAALDTSAMICIVLLAFVAIAEEKKIRHAKKLQLAQNQA

SEQ ID NO: 19130 - protein, 446 aa, Vibrio parahaemolyticus RIMD 2210633
MFGFLRSPKFTQPSLSNEQIDQRYRHWRLHIMLGMYIGYAGFYFTRKTFNYAAPAMITDLGLDKGDLGLIGTLFYITYGCSKFISGTISDRSNPRYFMGLGLIATGLVNIAFGFSSSLAAFITLWILNAWFQGWGWPSCSKLLTTWYSRSERGFLWAIWNTAHNVGGALIPILVGYLTLHYSWREGFILPGIIGVLLGLFVCWRLRDKPTTMGLPSVGQWRNDALELAQENYGRGLTYREILKSYVFNNKYIWLLAFSYVLVYIVRTAINDWGNLYLTEQHHYSLINANAALSMFEIGGFVGSLVAGWGSDKLFGGNRGPMNLLFAIGIFLSVSALWLMPLTNFAFQAAGLFSIGFFVFGPQMLIGMAAAECSHKDSAGAATGFVGLFAYMGAALSGYPLALILEEYHWTGFFITISVCAAVIGLLLLPFLQAQPSRKPLEPKPRL

SEQ ID NO: 19131 - protein, 486 aa, Vibrio parahaemolyticus RIMD 2210633
MEMKTHYIDGAMYIGCSEEHFTTYNPANGEPLANIKQANQSDMEAAIESAKRGFEVWSAMTAIERSRILNKAVAILRERNDELAALEVADTGKPIQEAIAVDITTGADVIEYYAGLAPSLQGEQQPLNENQFFYTRREPLGICAGIGAWNYPIQIAMWKSAPALAAGNAMIFKPSEETPLTALKLAEIYSEAGLPDGVFNVVQGDYRVGQMLTAHPDIAKVSFTGESGTGKVVMGDSAKTLKQVTMELGGKSPLIVFDDAKLDDAVSAAMVANFYTQGEVCTNGTRVFVHESIYDDFVAQLKTRTEKLVVGDPLDENTQIGALISKEHESKVLSAIESAKASGATLLTGGYKVTDNGLQNGNFVAPTVFIDCDDSMSHVQQEIFGPVMSVLKFSEEAEVIERANDTDYGLAAGVFTQNLSRAHRVIHKIQAGICWVNAWGDSPAEMPVGGYKQSGIGRENGVETLKHYTQTKSVLVQLSDFESPYA

SEQ ID NO: 19132 - protein, 298 aa, Vibrio parahaemolyticus RIMD 2210633
MDKIAFIGLGNMGAPMAKNLLKAGLNVEVFDLNPNAVAELTALGASSADSVQQAVQGADVVVTMLPASQHVQSVYLGQYGILDSVDAGTLLIDSSTIDPATARSVGEQAELRGISFVDAPVSGGVAGAAAGTLTFIVGGSQENFVQAKAVLNHMGKNIFHAGDAGAGQVAKICNNMMLGILMSGTCEALNLGMENGLDPKVLSDIMLQSSGRNWALELYNPCPGVMENTPASNGYQGGFMSQLMAKDLGLAMEAAVASQTSTPMGSLARNLFNFHNGQGNGQKDFSSLFEFYQKQNQA

SEQ ID NO: 19133 - protein, 348 aa, Vibrio parahaemolyticus RIMD 2210633
MRIEQELKLGFKDVLFRPKRSTLKSRSQVNLTRDFTFKHSGRQWSGVPVIAANMDSVGSFEMAKALAEHGVMTAVHKHYTVNDWADFVKSADNATLKNVMVSTGTSDADFQKTKDIMALSDELIFICVDIANGYSEHLVEYVERVRAEFPDKVISAGNVVTGDMCEELILAGADIVKVGIGPGSVCTTRVKTGVGYPQLSAIIECGDAAHGLGGMIIGDGGCSCAGDVSKAFGGGADFVMLGGMLAGHEESGGEIIEKDGETFMKFYGMSSQSAMDKHSGGVAKYRAAEGKTVLLPFRGSVHGTISDILGGVRSTCTYVGAAKLKELTKRTTFIRVQEQENNVFGKEK

SEQ ID NO: 19134 - protein, 513 aa, Vibrio parahaemolyticus RIMD 2210633
MDFNLALKLYTAEQVKNGEVVAAHMAGVSMYSLMQRAGMAVYERFLHLYPRAKNVLVVCGKGNNGGDGYVFASLAKQAQLNVQVFQIGDVTQLQGDALRAYQDWQTVDGKNSSWDDWNTALLEAEVIIDAMLGTGLKGEVRTEYRRYIEQINQIQCPVIAVDIPSGLCANTGSVLGDAIQADHTVTFIGVKQGLCTAQARDRIGELHFCGLGVNVEFDAIEEESALGIDHKVIPRLLPKPKATAHKGDNGKLLCVGGNQGMSGAIRLCASAAVRSGAGLTASITHPDSFIPLQVSCPEVMSQSITTDLLRDTENALTKRIRWADVLVFGPGFGDDEWAYQAYQYLSQEQKPKVVDADGLNILAMLSQRCDGTLVCDNQRVITPHPGEAARLLNVTTKQIESDRYSAARQLQERYGGVVVLKGAGTLVFDGVRMYVCLAGNPGMATGGMGDVLSGVIGALLAKGLPISIAARLGVMIHSHAADLNAEKHGEVGLLATDVVETLRAATHIQRAKN

SEQ ID NO: 19135 - protein, 181 aa, Vibrio parahaemolyticus RIMD 2210633
MKGLLKLAAYLGFISMSSFVLASECPDILQGKQRMLNSTEEIELCEVFKGKTLLVVNTASQCGFTPQYEQLETLYQTYKDKNFAVIGFPSNDFRQDKGSEENTAKICYLDYGVTFPMMARSSVLGNDANPVFSEISTQAGVTPKWNFYKFLISKEGKVIATFPSSTSPTSTTLTNMIEQQL

SEQ ID NO: 19136 - protein, 292 aa, Vibrio parahaemolyticus RIMD 2210633
MEKQRVAFIGLGVMGYPMAGYLSKAGYETKVYNRTKAKADKWAAEYNGIACETPREAAEGCDIVFTCVGNDNDVRSVVYGEEGLLVGLKSGAFLVDHTTTSAELAVELADACKKVGNHFIDAPVSGGQAGAENGVLTIMCGGEPSVFDHVAPVMDVYAKQITLLGENGQGQRCKMVNQICIGGILQGLSEALLLAQKSGLDIEQVVETLKHGAAGSWQMENRATTMAQDKFDFGFAIDWMRKDLGFCLEEAERVGLELPLTKMVDEQYAGLQREGLGRMDTSVLIKAVAKNQ

SEQ ID NO: 19137 - protein, 343 aa, Vibrio parahaemolyticus RIMD 2210633
MKIKALSKLKPEQGIWMTEVDKPEVGHNDILIKIKKTAICGTDVHIYNWDEWSQKTIPVPMVVGHEYVGEVVAIGQEVRGFEIGDRVSGEGHITCGHCRNCRGGRTHLCRNTIGVGVNREGAFAEYLVIPAFNAFKIPDEISDDLASIFDPFGNAVHTALSFDLVGEDVLITGAGPIGIMAAAVAKHVGARHVVITDVNEYRLELARKMGVTRAVNVAEEKLEDVMAELGMTEGFDVGLEMSGNPAAFNSMLTTMNHGGRIALLGIPPSDMGIDWNQVIFKGLVIKGIYGREMFETWYKMASLIQSGLDLSPIITHHYKIDDFQEGFDVMRSGMSGKVILDWE

SEQ ID NO: 19138 - protein, 1329 aa, Vibrio parahaemolyticus RIMD 2210633
MDNKTFKLSTIAKTVLPLISIAVISGCGSDSTSDDTTNPGSGLYPAGENEVVIYYKRDIASASTASDYEGWGLHLWNGEGCTSTDLEAMGIAGTGTDWSAPRPFDGINDTYGAYYVLKVNPDASDPHECMNFILHKGDEKAFGSSNSKVELTKIGESKGLFGFHGSSELYYEPIEERPVDIDGQKAHWLDANTIAWEAAANADSMKLFYSLTNDIKMDEDKQISGGTAVELTKAGDLSDGLKSRFRHLASLQAAGIDVDDATLRTILKSQIVMVAYNANGDVISATEVQKPGVLDAVFADSKAGNAISQELGAIVEGGAATFKLWAPTAQDVALIIYDENLKEETTVAMKEDSATGIWVSEAQSNVVNKYYRYQVKVYHPTTGVIETRLVTDPYSLSLSKNSMYSQVIDLDDPSLMPQGWSDYERPTVKKDEDHVLYESHLRDFSFNDTKGTKEYNGKYLALTEADRESVSHLQALKDAGLTTLHILPAFDIATVDEEAANRVDITDTVGKLCGIKPEASVCDEVDGAKVIEDVLNSYDPATGSAQALMNDLRMLDSFNWGYDPFHYTVPEGSYATDPNGSKRILEFREMVQATHKMKLKLIMDVVYNHTNASGINDKSVLDKIVPGYYHRLNVNTGGVENSTCCDNTATENLMMGKLMVDSLKVWADDYKVDGFRFDLMGHQPKDVMVYALEQIRKIDENTLFYGEGWDFGEVSNNARFDQATQLNMAGTEIGTFSDRLRDAVRGGSPFDGGVDSEGKHPLRFNQGFGNAAYANEETKVDAESVNGRLHNQDLVRLGMAGNLADFVLLDYKGDTKLGKNVDYNGAPAGYTKVPSENISYVSKHDNQTLWDNNAYKIATATPSADRARMQSVSLSTVMLGQGIPFIHMGSELLRSKSMQRDSYDSGDWFNRVFFDGSDNNWNVGLPREDKDGANWELIKKIVSDTTAKPDATDIELTKQQFLELLKIRSSSELFRLDTAQEVMNRVDFRNVGKDQVEGLIVMSIDDGKSAGADLDSKYDAIVAVVNSTSSEKSFVVKGATGFELHEVQQNSADDIVKGASFANETFTVPALTTAVFVQPQDGAQGAGLPVNTDNKDVSSIPPFGETVVYVKGTMNNWSDNSDWAMTFIGNGMYSVTGVLEAGSHEFKFADTGWANPNIGCSVATVGSGSLELGAEENCKLTVAETGKYNFTLNALYVQDEKVEKPVVSVTKSADAPTFGETALYLRGTITSWDTPAQDSAAKFSYVANDVYSLDIDLAAGSYEMKIASADWAADTNFGGEGSVELGKALTMEVGGGSANLKIAIAEAGNYNFHFNAADKSAPIVTVTKN

SEQ ID NO: 19139 - protein, 1043 aa, Vibrio parahaemolyticus RIMD 2210633
MFTATNVLTPEFIGQPLDKLWSLISPLYMVDESQWLEQLLPLATPTTEEKSAITNQTTKLIEAIRADKKSIQMIDALLLEYSLDTQEGILLMCLAEALMRIPDAATADALIKDKLSVADWKSHLKNSDSVFVNASTWGLMLTGKVVGLGEQGTQSPSQAVNRLVNKFSEPVIRKAMYQAMKIMGHQFVRGRTIEEAQKNGRPMRDKGFTYSFDMLGEAALTTADANKYFKDYLMAIEAVGRETYGNDTSPAPSVSIKLSALHPRYEVANEERVMTELYETLMQLLKRAIEVDVAITIDAEEADRLELSLKLFEKIYRSDLVKGWGKFGLVVQAYSKRALPVLVWLNALAKEQGDLIPLRLVKGAYWDSEIKWSQQAGYENYPVYTRKEATDVAYLACARFLLSEGVRGNIFPQFASHNAHTVTAIAVMAQHKDFEFQRLHGMGDSLYNHVMEKYGQPVRIYAPVGSHADLLPYLVRRLLENGANSSFVHRLVDARCPISELTHHPVDALTSFATLNNDKIPMPSGIFPERKNSYGVNIDIESEAKPFEAQVESFLNNKWVAGPVINGERFAESMIKENLAEIITAPYDRRVEVGQVAFATLDHVSAAIEAAQAAFPEWKGTAIEQKAKCLETLADLMEANLAELVAICHQEAGKTIHDSIDEVREAVDFCRYYAKQAQNLQPFELEGFDGVKRISSREGLGVFVCISPWNFPLAIFLGQVTAALVAGNTVVAKPAEQTSLIAARAIDLMLEAGFPAGVIQLLPGRGGEIGHALTSHDAIAGVAFTGSTATAQRINVTLAERTAKPVPFIAETGGQNAMIVDSTALPEQVVRDVIRSAFASAGQRCSALRVLFVQEDVADRIITLIQGAMKELHVGLPYLHKTDVGPVIDRNAKQKLLAHLEQMSSTQKKVAQLQLEEACQYGDFVAPSAFEISGIDVLKEEQFGPILHIVRFKASELPNVVEQINQTGFGLTMGIHSRNETTYRWIEKHARVGNCYINRDQVGAVVGVQPFGGQGLSGTGPKAGGPHYLYRFTQHLLAQAENA

SEQ ID NO: 19140 - protein, 485 aa, Achillea millefolium
MSPQTETKASVGFKAGVKDYKLTYYTPEYETKDTDILAAFRVTPQPGVPPEEAGAAVAAESSTGTWTTVWTDGLTSLDRYKGRCYGIEPVLGEENQYIAYVAYPLDLFEEGSVTNMFTSMVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNEIIREATKWSPELAAACEVWKEIKFEFQAMDTLDGDKDKDKKR

SEQ ID NO: 19141 - protein, 354 aa, Thinopyrum ponticum
MDGNKGPVVVTGASGFVGTWLVMKLLQAGYTVRATVRDPANVEKNKPLLELPGAKERLSIWKADLSEEGSFDDAIAGCTGVFHVATPMDFDSQDPENEVIKPTVEGMLSIMRACKEAGTVKRIVFTSSAGSVNIEERQRPAYDQDNWSDIDFCRRVKMTGWMYFVSKSLAEKAAMEYASENGLDFISIIPTLVVGPFLSAGMPPSLVTALALITGNEAHYSILKQVQLVHLDDLCDAMTFLFEHPEANGRYICSSHDATIHGLAKMLGDRFPEYSIPQKFAGVDDDLQPIHFSSKKLLDHGFSFRYTAEDMFDAAIRTCREKGLIPPGDVPAPAAGSKLGALAAGGGQAIGAET

SEQ ID NO: 19142 - protein, 354 aa, Thinopyrum ponticum x Triticum aestivum
MDGNKGPVVVTGASGFVGSWLVMKLLQAGYTVRATVRDPANVEKNKPLLELPGAKERLSIWKADLSDQGSFDDAIAGCTGVFHVATPMDFDSQDPENEVIKPTVEGMLSIMRACKEAGTVKRIVFTSSAGSVNIEERQRPAYDQDNWSDIDFCRRVKMTGWMYFVSKALAEKAAMEYASENGLDFISIIPTLVVGTFLSAGMPPSLVTALALITGNEAHYSILKQVQLVHLDDLCDAMTFLFEHPEANGRYICSSHDATIHGLATMLRDRFPEYRIPHKFPGVDDDLQPIHFSSRKLLDHGFSFRYTAEDMFDAAIRTCREKGLIPLGDAPPPAAAGKLGALAAGEGQAIGAET

SEQ ID NO: 19143 - protein, 485 aa, Blennosperma nanum
MSPQTETRASVGFKAGVKDYKLTYYTPDYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEDMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFAQDWVSLPGVLPVASGGIHVWHMPALTEIFGDDSVLQFGGGTLGHPWGNAPGAVANRVALEACVQARNEGRDLATEGNEIIREATKWSPELAAACEVWKEIKFEFQAMDTLDGDKDKDKKR

SEQ ID NO: 19144 - protein, 323 aa, Aspergillus oryzae
AATGSVTTNPTSNDEEYITQVTVGDDTLGLDFDTGSADLWVFSSQTPSSERSGHDYYTPGSSAQKIDGATWSISYGDGSSASGDVYKDKVTVGGVSYDSQAVESAEKVSSEFTQDTANDGLLGLAFSSINTVQPTPQKTFFDNVKSSLSEPIFAVALKHNAPGVYDFGYTDSSKYTGSITYTDVDNSQGFWGFTADGYSIGSDSSSDSITGIADTGTTLLLLDDSIVDAYYEQVNGASYDSSQGGYVFPSSASLPDFSVTIGDYTATVPGEYISFADVGNGQTFGGIQSNSGIGFSIFGDVFLKSQYVVFDASGPRLGFAAQA

SEQ ID NO: 19145 - protein, 308 aa, Cicer arietinum
MAVPVIDFSKLNGEERAKTMAQIANGCEEWGFFQLINHGIPEELLERVKKVSSEFYKLEREENFKNSTTVKLLNDIAEKKSSEKLENVDWEDVITLLDNNEWPENTPCFRETMLEYRSELKKLAENIMEVMDENLGLPKGYIKKALNDGDEDNAFFGTKVSHYPPCPYPELVNGLRAHTDAGGVILLFQDDKVGGLQMLKDGEWIDVQPLPNAIVINTGDQIEVLTNGRYKSCWHRVLTSTDGNRRSIASFYNPPLKATISPAPQLAEKENQQVDDTYPKFVFGDYMSVYAEQKFLPKEPRFKAVKAI

SEQ ID NO: 19146 - protein, 1229 aa, Neurospora crassa
MPNGSRISKNQPRSLTDEHALGMNTSRPTTSPAAAVVNRSSDPDPVPDPAARHKPNPDRPGASDGPSKSGKPRGRSIEPPSSSPQPAPRHRHPSRHRSPDRSGRSSRLPHRSRGSPRSRRDRSREPRGRDGHFPPDRRHRSPVLPRGRGDAAHERGQNVDHGKHHSQLPPHPARASQRGSSRTPGSSKRRRSRTPSPGGPDSKKSRRGRSPRRGEKDDVNSLQLPRDCRRSPVDRRPSRSPSHHERRRSRDRKRSGRSRSPDRSRRRKSRSPDRGVFDRASGRVRRRSPSPRHRGRSDRPDRPERRHQSKSRSRTPPHRENRHPASDAGSRRRPSPDPDSREPYDHPQGSPRDRRRSKSSKKGKVRDDQKFDPASGVNSIEVNMAARNGYRGGYGAPMPPGYTETHDGRNYSHSSGHATPNSSFHGSPPAQSPYGAGRGWNNPQFSPQSQYGYPHGNYGPPTGPQAHYHSNQGHSPPYPPTGPAAQYPTGPFRGGHRAASGGFRGGSFGVARGGHRGGSKNAQWSPNAHNARGQYITPTTTITTATDNNPAHAQNNAAPSKYADSGQNTQEGTREDVNSSSRPDKDLQGDDTNSSGKEKEEQMQPPTRPAAASQSQPSNKFSFSMKNATKPVVAAPRPEISLKFNAVVPPREPSQKQPPKAPAAAPPTAPSAHRSNRDRHDLPKNVPTEPASARARHNDRRGPDPHRPVDSHRPVDSHRPVDSHRPAEQQKPRTRIVKKIVKKLKEKPALPPDLAKSKSVYHRKPGNESVIGSGTYGKVFKALNVYTKKQVALKRIRMEGERDGFPVTAVREIKLLRSLSHRNIVKLMEVMVEMNECFMVFEYLSHDLTGLINHPNYTLDPAQKKHLALQLFEGLDYLHTRGVLHRDIKAANILVSNEGVLKLADFGLARFYAKHHQLDYTNRVITIWYRSPELLLGETQYGPAVDIWSAACVMMEIFTKRAIFPGDGSEINQLDKIHSVLGTPTRNDWPNIIEMPWFELLRPTQRRANVFAEKYKELVTPAAFELLLWMFKYDPDKRPSAAQVLAHPYFTTEEPAPRQAVELKDIDGEWHEFESKALRKENERKEREARRAVKDGAPAAAAAPSGGGGSSSTREKDRDPRKRPAESREPPPSERDSKRPHLDSHAANKPSTILSSSAPPPPQQQQREPERSSVPTRPREQHQQEQQQEQQQCRPSASSSSHLPPAQAQARARAPTNAPSGPAASQSHN

SEQ ID NO: 19147 - protein, 352 aa, Neurospora crassa
MSSSKAKDKASSADVSKKGKKDKKEKKASKTAKEVTAASEPAEVIAETESASKKEKKSRKSKNDSSRQDGKRKREEDNDDMAKNNDEKAAGDEVKPSKKRKSEDKSKSNDKDEKKKEEKKTKDKKDKKRKHGDHHSDEEEEQKDEPVVKVAKIVTGEGAEPNKAEKEKKSKKDAKKSKGEKESSDSSEKKHKEEKKEKKEKKDKKSKTDKEEEEPVVEKEEKAESKKESKKSKKEKKEKKEKKERKKGDETKTTEAKGSTATLAATTTTIPNPAAVLAANWNVNALDGGASRQSKMMRLLGGKKLAADGAAAAAAAKKTFDVNQVSQELEQQFKAGIHQKFETGGQRRGLGA

SEQ ID NO: 19148 - protein, 338 aa, Neurospora crassa
MAPKTMKAVDIKNGKGSADNLFINPDTPLPQAQPGQALVKVKAFGLNRMDLIQREGHYPLPPQAPSTLGVEFSGTIESFGDGDHGDFNVGDEVFGLAYGGAYAEYIAVSSKMLLHKPAHLSFEQAAGVPETWITATQALHFVLGGIGEQGKTILWHAGASGVSIAGIQLSKLAGAKQIFATAGSADKCKFIENELGATAAFNYKEQDWVEEIMKKTDGRGVDLVVDFIGASYFQKNLDVVARDGRICMLGLMGGAVADKVDISKLLYKRARVEGSTLRSRDENYQGQLRDKLSEYLPKFESGELKIFIDTVLPFEEIVKAHKQLEANTTMGKIICTVS

SEQ ID NO: 19149 - protein, 371 aa, Neurospora crassa
MADLLLPEPFASIPREPLTFGPSPIQPLPRISQALGGKVNVFAKREDLNSGLAFGGNKTRKLDSLTNKSGPSAPRYLVPDAISRGCDTLVSIGGIQSNHTRQVAAAASKLGLHAALVQEHWVPDWTDPGYDKVGNIQLSRLMGADVRLEPLAGFGIEHKQTLAKLKDDLEKEGRKPYYIPAGASDHPLGGLGFARWAFEVVAQEEELGIHFDTVVVCAVTGSTMAGMVAGFKLVEMLERHSERLGKVNKRRVIGIDASAKVEQTRAQVLRIAKQTAAKIGLKEEDITESDIVLDDRYHAGVYGVPDEKTIEAIKFGARTEAFITDPVYEGKSLAGMMDMIKNGEIEAGSNVLYAHLGGQLALNAYSALGLE

SEQ ID NO: 19150 - protein, 492 aa, Neurospora crassa
MPVELRKRKAPPPPPAPVKKRATKATKAAAKAKEQVEDVASKAAETASKAAEVATETATAAAQTAAEAVANGAAKVATALAGNPKVGDLIDLDNFGGEVETNDGTKTSLKKLVEESKAGVVLFTYPKASTPGCTRQVCLFRDSYTALSSATGLSIYGLSSDSPKANTTFKEKQKLPYPLLCDPSYALIGAIGLKKAPKGTTRGVFVVDKQGKVLAAEAGGPEATVKVVERVVSEMGEEGKTEKKKEEEEAEEKGEKKEGEEEEKAEKDEAKEEGEEKKEDKAETKEREEKAEAKESEEKKDEKDETEAAGKKDEKKNEKDETEAAEKKDEKKDEKDETEAEEKKEEQDKDSETKDDDEKKAEKKDAATEEEKKKEKEDTTNGEKKDEKKKTEEKKSDDDKAEDKKEDKEAEEEKKDEKKDEKKDEKKDEKKDEKKDEKKDEKKDEKKDEKKDEKKDEKKDEKKDEKKDEKKDEKKDEKTEEKEKEDTEMKDA

SEQ ID NO: 19151 - protein, 378 aa, Neurospora crassa
MSPSKTTKSSSQSKISLTNPSIPLNSLILVTGCNGLLASHVADQLLAAGYRVRGTVRNPDKCSYLTSLYSHRHGGPGKFELVEISDVTAPNAWDDAVKGVAGIVHCVGATDLTIQESDSAAQEELEWQVGLLEAARRAGTVKSFVFTSSAWALWMPDASKKVTLTEQSWNEDAVALARDKNVDPKTKGMAGFMALKTLVEQGIWEWVKREKPGFAFNTVLLDTVLGECLDPKNQGIPSTLGMVHWIWENKHMAIIDLMEPQWFVDCVDMAKVYVAALASSPKVDRERLFVFGERYSFGEVARLLGEMFPERTEKFGKPKKEGWDQTEVPNQRAEELLKRVGQKKGWTGLKESVRANAESILRLEREGGTGAPQSTYAR

SEQ ID NO: 19152 - protein, 291 aa, Neurospora crassa
MSEIAHPTIQDGWFREISNMWPGQAMTLKVEKVLHHEKSLYQDVLIFKSTDHGNVLVLDNVIQCTERDEFSYQEMITHLAMNSHPNPKKVLVIGGGDGGVLREVVKHDCVEEAILCDIDEAVIRLSKQFLPHMSAGFEHPKVKVHVGDGFKFLEDFKNTFDVIITDSSDPEGPAESLFQKPYFQLLHDALREGGVITTQAENQWLHLPLITKLKKDCKEVFPVAEYAYTTIPTYPSGQIGFMVCSKDPNANVKVPLRSWSQEEEEKLCRYYNSEIHKASFILPTFAKKALE

SEQ ID NO: 19153 - protein, 1790 aa, Neurospora crassa
MSSHDKNGRATSSSGKASSFFSRATGKNKADKRNASDEGGRYLAADNDAASTHTARSSRHYRDSSVISLDRPDTPESGLNMTAGVVTTIPYDPVSPDNRSPVALDHLPRPDQMPLRRELVPHHLNKGTGDFHQYPTIDQSPSSPYNGQSPSASSSRSTLATANITMASTGRQAQFQQWGPPRESSLPGYNSRGHSYMTTRSSGDNASIYSGRDGHYQEAPGTSHRSSRIGLPSTSSQSSYLSPHAHKDRDTQRLTKVAAGHQGSEGFNFPKPDDDNVIEQMFINLMQKRGWHNLPDQAKRQMIAYPAAKKWTLIYQDRLTEWQGEQKRRQTAKIGQYSNVDITQSSDDEGSPEWYVRKVMENALDSKGLGGLEVNLRTQQIGWVKRFIDCQGQIALTNVLLKMNRKTAYGPAQPDNGRLDKNLDREYDIVKCLKALMNNKFGADDALAHQQVIVALATSLISPRLTTRKLVSEVLTFLCHWGEGKGHVKVIEAMDVVKAQQGENGRFDAWMRLVEVTVDGRGKMGSLVGASEEVRSGGIGMENLLMEYAVATLILVNMLVDAPEKDLQLRIHIRAQFTACGIRRILNKMEAFQYELIDKQIERFRSNEAIDYEDMLERENSSIKDSIEGEVKDLNDPVQIVDAIQQRLNGTKTQDYFVSALQHLLLIRDNDGEERLRMFQLVDSMLSYVAMDRRLPDMDLKQSLNFTVQSLLDKLHTDSEARQALDEALEARQIADAAMAERDEMKERLALGADGLVAKLQKQIDEQAMFIEAQKRRAEGLKSELASLQTLRAKEAQRYELETRELYLMLRDAQDVAASNATKGNAKLGEEDVARMQGILDRERLLERLQMQIERQKTQFKLEGRVWGEVIGPSDRLRALREEMDGFGDDTPEVVPPKDFTNSMLGSVKRSTRIPRKPVGSRSDHVEDVLEESDVEIGDDGEIVYEKPRVVKIRRPVVDPKQTNGMFNELTGKVRRYDASDSEEGDGITTGPSHPSMESQTPITPSDTETPKIQVTDATGPSAPAAASGPPPPPPPPPPPPPPPGFLPGAPAPIPGAGGPPPPPPPPPPPPPPPGGLPGAAPPMPGAGGPPPPPPPPPPPPMPGMAGPASGRFLAQNAGLPTTNSVGLPVVRPKKKLKAFHWDKVDTPLATHWAAHTPSPESREEKYHELSKKGILDEVEKLFMAKEIKKLGGGGAKKDDKKQIISNDLRKAFEIALAKFSQFPVEKVVQMIIHCDKDVLDNPVVMDFLQKDDLCNISDNTAKVMAPYSKDWTGPDAGKDTREQDPNELTRQDQIYLYTAFELHHYWKSRMRALALTRSFEQEYEEITEKMRAVVAVSESLRDSVSLMNVLGLILDIGNYMNDANKQARGFKLSSLARLGMVKDDKNESTLADLVERIVRQQYPEWEDFAKDIEGVIAAQKINIEQLQADAKRYIDNIKNVQMSLDSGNLSDPKKFHPQDRVSQIVQRVMKDARFKAEQMQLYLEEMVRTYNDIMVFYGEDPSDDNARREFFSKLASFITEWKRSREKNIQLEEQRKRNEASMKRKNAQFKALQASEAQGPASPTSTGAMDSLLEKLRAAAPQTRDQRDRRRRARLKDRHQVRIASGQQVPDFNEIPEVEAALQTGKSAASATTDDDGAGNGLVSPDALPPTKEAPDAEEDDVARRAAALLQSFQGGDGAEDDAEKRESLRKSRRQTAAEERNMRRRRREKAQTSTAGEEGKDESTAADGSEAAPSASAEDLSAAEAKTDGPSSPRPGTATGAEASEETETTPTATATDTNPEESKETTG

SEQ ID NO: 19154 - protein, 437 aa, Neurospora crassa
MATSTTSDLKLSQPLTLPNGLTLPNRLVKAAMAEQMGFGNHLPNPELAAVYATWARGDWGLILTGNVQVDHAHKGDAHDISPNHPGTTPEQTVTAFKAWADAARLNGQSKTPVVVQINHPGRQSPMGAGTRGLWEKAVAPSPVPLVLGEAFVPRLLSKVLFGTPRELTVAEIKDIVQKFAVTARITAEAGFNGVEIHAAHGYLLAQFLSKKTNRRGDEYGGSAENRARIVGEIIKECRRQVTEAVGEEEAKKFVVGIKLNSADWQAGRDGKEEEETDTAEEVLKQIELFEQWGIDFVEVSGGSYEDPQMANGPKPEKSERTMAREAFFLEFAKIIRTKFPKLPLMVTGGFRTRQGMEAALESDDCDMIGIGRPAIINPSLPANLILNPEVPDADARLFDKKRAEPHWIVEKLGMKSIVGAGVEVTWYVSELKKLAKF

SEQ ID NO: 19155 - protein, 369 aa, Arabidopsis thaliana
MEEEDDEVMVREGLMASQREIFSISGPIHLTSIDWNNSYHRTSVASCLVQAVYTLERDRQQNRIGLKSQANHWWEFFNFTLAETLIDDSDGSIYGAVFEYKHFFSYNYHHTPHSKPPPRHVIAFRGTILKPHSRSRDLKLDLRCIRDSLHDSTRFVHAIQVIQSAVAKTGNAAVWLAGHSLGAAVALLAGKIMTRSGFPLESYLFNPPFSSIPIEKLVKSEKLKHGVRFAGSLVKAGVAIAVKGRHHNKGQEDDSFMKLASWIPYLYLNPLDTICSEYIGYFKHRNKMFEIGAGKIERIATRNSLRSLLSGGGGGGSSSDSSSEPLHLLPSAYMTINASKSPNFKRAHGIHQWWDPMFNGEYVLHQFNN

SEQ ID NO: 19156 - protein, 462 aa, Arabidopsis thaliana
MYSVILHGRRLVQLQKWRHLRFVVQNGSAFSNSYSSASATDLSSRDGRKVKNFTVSYLVDSLGLATKLAESISKKVSFVNKGNPDLVLSLFRSYGFTNSQISSIITDYPRLLLIDAEKSLDIKLQFLESRGASSPELTQIVSTVPKILGMKEGKSLGRYYDFVKEIIEADKSSKYETLCQPLPEANRQGNKIRNVSVLRDLGVPQKLLFSLLISDAQPVCGKENFEESLKKVVEMGFDPTTSKFVQALRAVYRFTDKTIEERVNVYKGFGFAVEDVWAMFKKCPYFLNSSEKKIGQTIETLKKCGLLEDEVISVLKKYPQCIGTSEQKILNSIEIFLGLGFSRDEFITMVKRFPQCLILSAETVKKKIEFVVKKMNWPLKDVVSNPTVLGYNLEKRTVPRCNVIEALMSKRLLGDTGSELPPMSSVLVCTDELFLKRYVRNHGDKELVLELMTIYTRGRVSS

SEQ ID NO: 19157 - protein, 482 aa, Arabidopsis thaliana
MDRVSNLPDGVRGHILSFLPAKHIALTSVLSKSWLNLWKLIPILDIDDSEFLHPEEGKAERLEIRQSFVDFVDRVLALQDDSPIDRFSLKCITGIHPDHVNRWICNVLQRGVSDLDLFIDFSYEDTQEDEDMLPQEMFVSKTLVKLKIRNDRCVDWWCGKGGTSLPMLKSLYIDSDLILWGKMKRFLSSFPVLEELRMASMEWKESHETVSSASLRKLSILGTGCEDYVNPKSISFDTPSLLYLNYSDLVAEDYPLVNMGKLLEARINLIVKDDQIKRVREPNNDLLQDDAGNVVLQFGNVVKLMNGIQNIQILYLTADTLEVLSLCCESMPVFNNLKTLGIKSEEGRGWQAVPALLRNCPHLEYLIIEGLLHNVTDKCGDACDCISREDKGRSLASCPVKKVEIQGFRGTMREINMIGHFLRSFKCLKEMGIFPEEEGPTNFENPGAFEYVEKILKLYNEISNCDVYFLVWGYMRRKWTTQ

SEQ ID NO: 19158 - protein, 457 aa, Lactobacillus brevis
MRKVSTGFVYFFGALGGLLFGYDTGVISGAILFIQKQMNLGSWQQGWVVSAVLLGAILGAAIIGPSSDRFGRRKLLLLSAIIFFVGALGSAFSPEFWTLIISRIILGMAVGAASALIPTYLAELAPSDKRGTVSSLFQLMVMTGILLAYITNYSFSGFYTGWRWMLGFAAIPAALLFLGGLILPESPRFLVKSGHLDEARHVLDTMNKHDQVAVNKEINDIQESAKIVSGGWSELFGKMVRPSLIIGIGLAIFQQVMGCNTVLYYAPTIFTDVGFGVSAALLAHIGIGIFNVIVTAIAVAIMDKIDRKKIVNIGAVGMGISLFVMSIGMKFSGGSQTAAIISVIALTVYIAFFSATWGPVMWVMIGEVFPLNIRGLGNSFASVINWTANMIVSLTFPSLLDFFGTGSLFIGYGILCFASIWFVQKKVFETRNRSLEDIEATLRAKTGEDAAELSTTK

SEQ ID NO: 19159 - protein, 500 aa, Pseudomonas fluorescens
MNTLPSQVWRTNIGSAPSQLLNYIDGNFVTSASSFANINPVNGKLISDVFEADAKQVNEAVVAAQNALKGPWGKLSVQDRAALIHKIADGIQARFEEFVAAEVADTGRPVHQARTLDIPRAIANFRTFADLAKTSHTDLFEMSTSDGSGALNYTVRKPLGVIGVISPWNLPLLLFTWKVAPALACGNTVVAKPSEESPSSATLLAEVMHDAGVPPGVFNLIHGFGKDSAGEFLTQHPGISALTFTGESKTGSTIMKAVADGVKEVSFELGGKNAAVVFADADLDAAIEGVLRSSFTNSGQVCLCSERVYVHRSIFDEFVSGLKVEAERLVVGYPDQDGVNMGPLISHGHRDKVLSYYRLAVDEGATVVTGGGVPKFNDERDQGAYVQPTIWTGLSDKARCVTEEIFGPVCHISPFDDEDEVINRVNDSNYGLACAIWTTNLSRAHRVSRQIHVGLVWVNTWYLRDLRTPFGGVKLSGLGREGGRFSMDFYSDIANICIKI

SEQ ID NO: 19160 - protein, 271 aa, Burkholderia multivorans
MSRIQQTFAALAQQGRKGLIPFITAGDPDPAKTVEFMHALAAGGADVIELGVPFSDPMADGPVIQRSSERALARGVTLKHVLADVKRFRETNQTTPVVLMGYANPIERHGVDAFAADARAAGVDGVLVVDYPPEEAAVFAEKMRAAGIDPIFLLAPTSTDARIAEVGKIASGYVYYVSLKGVTGAGNLDVSSIAGKIPAIKSRVPVPVGVGFGIRDAETARAVAEVSDAVVIGSRLVQLLESAAPEGAVAALQAFIAELRAALDGAANTAR

SEQ ID NO: 19161 - protein, 138 aa, Burkholderia multivorans
MNTETKPLPAWLDKVRWDDNGLVPVIAQEASTNDVLMFAWMNREALAKTIDTQRAVYYSRSRKRLWFKGEESGHVQHVHEVRLDCDEDVVLLKVEQVSGIACHTGRHSCFFQKFEGTVDAGDWVAVDPVLKDPEHIYK

SEQ ID NO: 19162 - protein, 401 aa, Ancylobacter aquaticus
MAKVLCVLYDDPIDGYPTTYARDNLPKIDHYPGGQTLPTPKAIDFTPGTMLGSVSGELGLRKYLESNGHTLVVTSDKDGPDSVFEKELVDADIVISQPFWPAYLTPERFAKAKNLKLALTAGIGSDHVDLQSAIDRGVTVAEVTYCNSISVAEHVVMMILGLVRNYLPAHDWARKGGWNIADCVKHSYDLEAMSVGTVAAGRIGLAVLRRLAPFDVKLHYTDRHRLPESVEKELNLTWHASPTDMYPHCDVVTLNCPLHPETEHMVNEETLKLFKRGAYIVNTARGKLCDRDAIARALENGTLAGYAGDVWFPQPAPADHPWRTMAWNGMTPHMSGTSLTAQTRYAAGTREILECFFEGRPIRDEYLIVQGGNLAGVGAHSYSKGNATGGSEEAGKFKKAG

SEQ ID NO: 19163 - protein, 408 aa, Sphingomonas sp. P2
MRSIAIVGANLAGGRAVEALRQAGFDGRITLIGEEPWRPYERPPLSKEVLWDPANVPDNFFLQDEAWYDDNRIDMRLGTRAEAIDLAGGGVRLSGGELVQADRILLATGGHARKLNLAGSNCANVHYLRTRDDATRMALDLREGASIVIVGMGVIGAEVAASAVKLGCKVTVVEPMPVPMERALGRRFGQWLGEEHRKRGVATHFNCGVTGFRFSDNRVSAVEADDGTVIPCDAVIVGVGIVPATSLARDAGIEVNNGIIVDRRCQTSNLAVFAAGDVAEQDGFFGGRFRQETYQNAADQAQAAALAMLGQEVSYCKPMWYWSDQFDLNIQFCGQIPVEAEVAIRGEMDSNAFVAFFLAGEAIEGVLTVNRAPDMGVGKRLVERRARASAASLADAGMSLRDLLKQAG

SEQ ID NO: 19164 - protein, 192 aa, Arabidopsis thaliana
MGEAVKDGREEVIQAWYMDDSEEDQRLPHHKDPKEFVSLDKLAELGVLSWRLDADNYETDEDLKKIRESRGYSYMDFCEVCPEKLPNYEVKVKSFFEEHLHTDEEIRYCVAGTGYFDVRDRNEAWIRVLVKKGGMIVLPAGIYHRFTVDSDNYIKAMRLFVGEPVWTPYNRPHDHLPARKEYVDNFMINASA

SEQ ID NO: 19165 - protein, 463 aa, Arabidopsis thaliana
MCSSLVPHGKRLVQFQKGRDFSVSVKLLQNVFSVFSNSFSSVATAADVSFRDSRKGNNFTVSYLVDSLGLASKLAESISMKVSFENKGNPDTVLNLLRSHEFTDSQISSIISDYPTLLVADAENSLGPKLLLMQSRGASSSELTEIVSKVPKILGMKGDKSIGRYYDIVKEIIEADKSSKFEKLCHSLPEGSKQENKIRNVLVLRDLGVPQRLLFSLLFSNHHVCCGKEKFEESLNKVVGMGFDPTTPKFVEALCIVYGLSDKRLEENFNVYKRFGLTVNDVWELFKKCPAFLGYSENRIIQTFEALKRCGLCEDEVLSVFKKNPLCLRASEQQILNSMETFIGLGFSRDEFVMMVKCLPQCIGYSAEMVKKKTEFVVKKMNWPLKVITLFPQVLGYSMEKRTVPRCNVIKALMSKGLLGSELPPMASVLACTDQTFLKRYVVEHDEKLVLELMSIFNQDRVS

SEQ ID NO: 19166 - protein, 240 aa, Campylobacter fetus
MHCLWRNELCTIMLAFRLMMAEIYGLLGGSGSGKTTLLKTLIYLKEPTSGDIFWDNQNLWQANLQTRDELRLKMGVMFQFGALYSGMNVLDNIGILLKEYSDYDEQDINEIAKMWLIKVGLSKEAMSLYPSELSGGMKKRVALARSLALSPKVLFLDEPNSGLDPMSSRALDKLICTIRDSLGITVVMVTHDIDSIFGILDRFLIIDNHKIAYEGDLKGALEYKENPLRELFTMRSLNGK

SEQ ID NO: 19167 - protein, 441 aa, Cryptococcus neoformans var. neoformans
MDNTPRHLFQTPNNVYILQQPWQFVKELGQGAYGCVSSARNSSTGETCAVKKVTNVFQKKILTKRCLRELRLLHHFRGHKNITCLYDMDIVFDPPGSGQFREVYLYEELMEADLHAIIRSGQPLSDAHFQSFLYQTLCGLKYIHSANVLHRDLKPGNLLVNADCELKICDFGLARGFQPGAVQTDQGQAGFMTEYVATRWYRAPEIMLSFANYTSSIDMWSVGCILAELLGGKPIFKGEDYVDQLNKILNLLGTPTEDTLRRVGSPRAQDYIRSLPIKPRVKFGTLYPNASPLALDLLSKLLTFDPAKRYGCEEALEHPYLAVWHDPADEPLCEVPFDFSFEEEDSVSGMRDLILEEVRSFRYLVRQQTMPPVRKDSHELPPAPPAPQHPGAGVGPAFHEKRTAKAIWRNILGLHWRNSWRGRNYHRIIFVESVTVIGKHR

SEQ ID NO: 19168 - protein, 440 aa, Emericella nidulans
MRLHFLPLVALCATTASSLAFDSSTSQPPGAQVYSVNDAAGLKRIGAHHPKYHDRRTVTIRSSHNDTDDVSADFLWGIRRANHGGRLLLKKGQKYVIGRKLDLSFLDNVEVQLDGELKFTDDVPYWQENNFYYDFQKSISFWRWGGHDVRIFGRGTLNGNGQRWYNEFAGQEILDPDNTYYRPILFVAENATRLSVEGITELNSPCWTNFLVNSKDISFDNVFINAYSTNASAEPKNTDGFDSLNVNGLSVTNTRVDIGDDCFSPKPNTTNIFVQNLWCNNTHGVSMGSIGQYPGVLDIIEHAYIENVTLLNGENGARLKAWAGEDVGYGRINNITYKNIHVENTDYPIVLDQCYFNIPADECASYPSQVNVTNIVFENVYGTSSGAEGNVVAELICSPNAICEDIKLKGINLTTPEGEKGVVVCDGISGGVGVECQSSE

SEQ ID NO: 19169 - protein, 3475 aa, Nodularia spumigena
MAQNIDNKKLIAATLSKMEAMQARITELETRQSAPIAVIGMGCRFPGGISSPEIYWNYCQAGGDAIVEVPANRWDISKYYAPEPTPGKMNSRYGGFLQEDITEFDARFFSISAREATSMDPQQRLLLEVTWEALENANIPPTNLAGDRVGVFVGITSVDHAMTVYKSNYEQIDSFFGTGNSLSAAAGRLSYFLNLRGPAMSIDAACASSLVAIHQAIRSLRNHECELALVAGVNLILNPAITINLSQSGMMSPDGRCKTFDAAANGYVRGEGCGVLVLQRLSAAQKKGDRILAVLRGSAVNHNGAAAGLTVPSGPAQQDLLRQALTDARVSPQQVGYIEAHGTGTSLGDPIEMNAIAAVYGKRSQPLYVGSVKTNIGHLEAAAGIAGMIKTILSLQHGEIPPHLHFQKPNPLINWQGYPIKIPSQIIPWSNHGEIRIAGVSSFGFSGTNAHVIVEQAPAAKTTEIKLQRPSHLLTISAHNETALKELAQRFHTRLESDPEIGDICHSAAIGRSPLPERLAIVADTLPELQQKLSAFANEKTIDHLTFSQRFSGEKQPKIAFLFTGQGACYAGMGEQLYQTQPTFRKYIDQCADILANHLEYSLQNILFGNQTDLLNQTAYAQPAIFALEYSLTMLWKSWGIEPNLLIGHSVGEYVAACVAGVFSLEAGLQLVVKRGQLMQTAPTGKMAVVFADQATVLSLLENYTDTVSIAAINHPQQIVISGESHSIDQIIANCKTQNIPVQFLSLSGAYHSPLMEAILDEFETAAQSIDYDEPKTLLLSGIDGQPLETAPNASYWRKQCRQTVQFLQSIITALNKGYNLFLEIGYRPILAEQGRRYHDEAIWLSSLNRGLDSWQTMLATLAQLYIHGVSFNAEKFNQDYGYRNVQLPTYPFQRKRFQFQPPSQINEEHIEREQTKMTVAKVSHTQKHQQEIGKQLKSILAVLLKEDENEIRDDETLLNLGADSIILTDFTRKIEEKFSVKVRIDQLFTDLQRIVDIANYLSNYIAQEALETSEPISVGNIILSQNSELNNYLWVISQLQPIVVAYILKALGALGQSLNQAETWTTENLLQTLPIAPKYYLLITRYLKTLEQAGIIQNQGNVWTVKNLPTPFSLPETIENLQTHCPAAKPELEMLQRCGENLAEVIKGNIDPLELIFPAGSLIHAESIYGNSPVSRLMNQRVAQEINRILENFSSGDRPYQIIEVGGGTGATSEAILNNLNLTNVTYSFTELSPVLLNKARQKFQHRDHLNFHQLNIEKSPISQGIPAHSYHIVVAANVLHSTRNITETLNHIRELLLPGGFLVLLETVENNSWLDLTFGLTPGWWRFQDKELRLDTPLLSGETWCSVLKRCGFTTTDIFSQQNNVSIYNGQELIIASAPAESAIVSQPKTVAVSIPTSGKEALMMAQLQSLKDLKDIHEKTIIKQLEILQSASVAPSPTSEVLIRQTEPAPPQKATIEIAPLPQKIKTDSPKKPSSPSLNPLALKLAENKSLTEKQQAFISNLQIIYNQKTAKSKAYSQNSRKTMVDVKPTIDFRMALKEFQYPIVSESAQGAYFRDIDGNDYIDLAMGFGVNFFGHSPDFVIAAVQQQMQHGIGLGMQSNIAAETAALVSEITGVERVAFSNTGTEAIMAAVRIARSRTKRLKIVLFSGSYHGTFDGILARVGEEPGTAQPLSLGTPSGMVEDVIVLTYGAEESLEIIAAQADNLAAVLVEPVQSRKPDLQPQEFLQKLRKLTHEKEIALIFDEIITGFRMALGGAQEWFDVEADIVVYGKAIGGGLPISMICGKADFLDTIDGGFWSYGDNSHPHTELTGYGGTFCRHPLALAACRAVLLHLRAQGGTLQKRVNQLTNRLATEVNEFFQETGIPIRIVNFGSLFRFEPFGAYSLFLQPIELPLFYYLLNLKGIYTWEKRVCFLSTDHTNQDIDKVVIAVKEAIRELRQAGFFENAKPPQAKKREESDRSDDEDGRSSINQRFPTSEAQRQLWLLAELDTTASASYNVTTSLELRGNIEILYLQQAINEVVNRHEALRTQILEQGELQEVFNTVKIDLPLINLIDAENPEAAALTLRTQLSQKPFDLGSAPLFAAVLMRLAPEHYLLSLKTHHIVADGWSLGLILNEIGKLYSAKIGVSTDNLAPPMQFRQYLALRQQEAQSSQMQEHRDFWLKTYEGEIPVFELPTDFPRPAVKTYTGGRESKIIAPQLWRNLQTVGRQNQATLFMTMFAAYTAFLRRISGDDDLVIGIPISGRQFEGSEGLVGFCSQFLPVRIQTNITASFVDHLRHTKETLIAAFKHQSHALEELLAALQLQRDFSRSPLISVSFNMDPSLTLPEFEGLEVLLPPEPIGYTPFDLGFNFIEINDALIIYCNYNTELFKPETIKQFLESFEFLMEGVINNGNRLLSQLPLLTQSQEAKLLAELQGQTIDFPQTATIIDDFIAKVNSTPNAPALIVGDNTLSYGELNQKVNQLTNYLHQKYQLSSGKAIALIIGRNQNLIIAILATFKTGATYVPIDPEYPQSRIDFILKDSGCDVCLTESNFVSQLPQDIEAICLDKIDHTLAKFDTSEPHIKRDSSQIAYILYTSGSTGTPKGVMGCHISILNVIRSLRLTFDLDQHPDWHYIFTAPITHDPSLRNIFLPLTIGAALYMYEVKHIGHLVSFLQENQINALHTTPSIYREILAVLDTGETIPSLKYISAGGEKLDRETAIALRKRFPADIVSNVYGSTETCVGVAQYRIDENLNTDVPLGEVFHNNRLFVLDEFNNTVPLHVVGEICVEGVALASGYHNLPQITAEKFQPSFMTEGKTIFRTGDLGKQIAPGVIEFLGRKDNQVKVNGYRIDPGEIEYQLSRHSQIERAIVLPTNVDNQTQLSAYCKTESDIEISEIREFLSNFLPVYMIPTFFIFLKQFPLTRHGKIDLRSLAEFKGIGNLTQLAYTAPRNNLESKLVHIWEKILTKQPIGIFDNFFEIGGHSLLLSRVVTHVHKELNVLVKLAEFFKVPTIAGLAALVSKTQYDYQEPIPAITQQTSYPMSHGQRRLWALEFLDRNHTAYGMPSAYLFKGNLNIAAFENAFQHLLQRHEILRTTFTLIDNEPRQVVHESMNFQVKQIDLTEDEEQAEIIAEAIHNNAKNTFNLETGSLLKVNLLKVTQQSYIVLFNMHHIISDGWSAGVLIKDFLVLYHAYGQQNLELPPPLRIHYKDYSSWQEKRLNTSELQAQRDYWLNKLTPAPTRLNLPLDYARPGVQSFQGSAVIWQPDPELIKGFRVLLQNQESSLFMGLLTLVKSFLFCYTEQNEITVGSPIAGRNHPDLEEQIGFYVNMLVLRDQIAVDDSFATLLAKVKTTTLEAYDNQEYPFDKLVSDLNFPRDPSRNPLFDTAIVLQNNQNVELLLDGITVHPLDQEIVSAKFDLEFTFVEESQLYLKLIYNTDIFVHERISLMLKLLEGLLEEIVKLPEIPFLKLSFNTENSDEGDSKLFATNFNF

SEQ ID NO: 19170 - protein, 341 aa, Nodularia spumigena
MTAIFPQFSTVNLKNQKVLLIGRMYDETGEKLLEEYTNIQILKDPTKNEINQAIQEASGVFVRYPTKLDAQAIGLAKKLKVISTSGFGTDAIDISVATKHGVVVVNNPGLSTTAVAEHTICMILALAKKLTFLNQCVKTGNYLIRNQVQPMQLEGKTLGIVGLGRIGSAVASKCSAAFQMRVLAYDPYVLPSQAEAVGGTLVENLDYLLAESDFVSLHPELTDETYEMFALEAFKKMKPTAFLINTSRGKIVCEQDLVVAIGEKWISGAAIDVFEPEPPCQDNPLYDFDNVILSPHLAGVTPEAAIAATLSAANQILQVLQGQKPPYIVNPEVLDNFPHLQ

SEQ ID NO: 19171 - protein, 477 aa, Cichorium intybus
MSPQTETKASVGFKAGVKDYKLTYYTPEYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTAYVKTFQGPRHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNEIIREAAKWSPELAAACEVWKEIKFEFQAMDTLDK

SEQ ID NO: 19172 - protein, 485 aa, Chromolaena sp. Dillon 4105
MSPQTETKASVGFKAGVKDYKLTYYTPEYETKDTDILAAFRVTPQPGVPPEEAGAAVAAESSTGTWTTVWTDGLTSLDRYKGRCYGIEPVPGEDNQYIAYVAYPLDLFEEGSVTNMFTSIVGNVFGFKALRALRLEDLRIPIAYIKTFDGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIKKDRDRGIYFTQDWVSLPGVLPVASGGIHVWHMPALTEIFGDDSVLQFGGGTLGHPWGNAPGAVANRVALEACVQARNEGRDLATEGNAIIREAAKWSPELAAACEVWKEIKFEFEAMDVLDTEKDKTKKR

SEQ ID NO: 19173 - protein, 485 aa, Chrysanthemum maximum
MSPQTETKASVGFKAGVKDYKLTYYTPEYETKDTDILAAFRVTPQPGVPPEEAGAAVAAESSTGTWTTVWTDGLTSLDRYKGRCYGIEPVLGEENQYICYVAYPLDLFEEGSVTNMFTSMVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEDMMKRAVFARELGVPIVMHDYLTGGFTANTTLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNEIIREATKWSPELAAACEVWKEIKFEFQAMDTLDDDKDKDKKR

SEQ ID NO: 19174 - protein, 475 aa, Cycas circinalis
  misc_feature (1)..(10): Xaa can be any naturally occurring amino acid
XXXXXXXXXXVGFKAGVKDYRLTYYTPEYQTKDTDILAAFRVTPQPGVPPEEAGAAVAAESSTGTWTTVWTDGLTSLDRYKGRCYDIEPVPGEKNQFIAYVAYPLDLFEEGSVTNMFTSIVGNVFGFKALRALRLEDLRVPPAYSKTFQGPPHGIQVERDKLNKYGRPLLGCTIKPKLGLSAKNYGRAVYECLRGGLDFTKDDENVNSQPFMRWRDRFCFCAEAIYKAQAETGEIKGHYLNATAGTCEEMIKRAVFARELGVPIVMHDYLTGGFTANTSLAHYCRDNGLLLHIHRAMHAVIDRQRNHGMHFRVLAKALRMSGGDHIHGGTVVGKLEGERDVTLGFVDLLRDDFIERDRSRGIYFTQDWVSMPGVLPVASGGIHVWHMPALTEIFGDDSVLQFGGGTLGHPWGNAPGAVANRVALEACVQARNEGRDLAREGNEVIREASKWSPELAAACEVWKEIKFEFEAMDVL

SEQ ID NO: 19175 - protein, 485 aa, Dimorphotheca pluvialis
MSPQTETKASVGFKAGVKDYKLTYYTPDYKTKDTDILAAFRVTPQPGVPPEEAGAAVAAESSTGTWTTVWTDGLTSLDGYKGRCYGIEAVLGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIAQDASRGIYFTQDWVSLPGVLPVASGGIHVWHMPALTEIFGDDSVLQFGGGTLGHPWGNAPGAVANRVALEACVQARNEGRNLATEGNEIIREAAKWSPELAAACEVWKEIKFEFQAMDTLDTDKDKDKKR

SEQ ID NO: 19176 - protein, 2603 aa, Phoma sp. C2932
MVPYYQPASSCGSNTMAAMDEHQHNEDATIPIAIIGMSCRFPGNATSPEKLWELCAQGRSAWSSIPKSRFRQEGFYNPNAERVGTSHVVGGHFLEEDPSLFDASFFNLSAEAAKTMDPQFRLQLESVYEAMESAGITLEHIAGSDTSVYAGACFRDYHDSLVRDPDLVPRFLLTGNGAAMSSNRVSHFYDLRGASMTVDTGCSTTLTALHLACQGLRNRESKTSIVTGANVILNPDMFVTMSSLGLLGPEGKSHTFDARANGYGRGEGIATVIIKRLDDALRAQDPIRCIIRGTALNQDGRTATLTSPSQTAQSDLIRACYRAAALDPNDTAFLAAHGTGTRTGDAVEIAAAADVFGEKRSPERPLWIGSVKTNIGHSEATSGLASVIQAALALEKGLIPPNINFKEPNEKLGQVSAAVRVPSNLQKWPSVSGVRRASVNNFGYGGANAHVILESGIPGHTPIANGSGRSNGTGNGHNGANGTTNGHNGTNGTTNGHFDATQATNGHYGTDETPDYAPLDSFVISISAKEEASARSMVTNLADYLRTLQVQDETKHFKSIAHTLGSHRSMFKWTAAKSITGPEELIAAAEGGQFQASRALERTRLGFVFTGQGAQWFAMGRELINTYPVFRQSLDRADRYLKEFGCEWSIIDELSRDAENSNVNDMTLSPPLCTAVQISLVQLLESWGIVPTAVTGHSSGEIAAAYAAGALDFKSAMAVTYFRGEVGLACQDKIVGKGGMIAVGLGPEDAEDRIARVQSGKIVVACINSQSSVTVSGDLSGIVELEDLLKAEGVFARRVKVQAAYHSHHMQVIANGYLTSLKDMLKPTKKFGKIIYSSPTTGRRETNAKLMASAQHWVNNMLSPVRFAESFQNMCFSNRNSSQSEEIFQDVDIVLEVGPHGMLQGPIQQMMSLPIFERARLPYISCLLRGQSAVHTMQTVAAGLMGWGYRVDMVAVNFPQGTYGVKILHDLPSYPWNHDNSHWWEPRLNKAHRQRVHPPHDLLGSLIVGRDLREPTWRHFIRVQDIPWIRDHVVQSALVYPGAGFICMAMEAMVQLHELRDSQSRKVAGYRLAEVDILRAMLIPDTSEGLEAHISLRPCSTKLLLTNEWYDFCVSSVGDDDKFVDHCRGRITIEFDTSGSADTPRTSLRERSRSTGLMRSVDPSNLYSFLRAQGIYHGPIFQNLKTISSRKDHSESSFVVANTASVMPNGFQSPHVIHPTTLDSIFQGAYTALPGAGLDQNTAMIPRSIQELYLSSALTSDVGQCLVSDTSLIRYDGQSFTVNVDVSSKADSEHTPVLEIKGLRNQSVGQMAPQPGDSSNNDLCFKLDWAPDISSVKQERLKEKFGFPLDPTEADIIMGLRQACIHFIHRSLQSLTAPDRDQLDWHQKRFYDWMVLQIQLAEEDRLAPNSSAWLQCSSSDEQKLLENVRASSVNGQMVVHVGKSMLAILRHEIAPLELMLQDKLLYRYYTDAIKWDRSYQQIDQLVKLHAHKCPTAKIIEIGAGTGGCTRAVLDALSNQGIARCAQYDFTDVSSGFFEAAQQKFAAFDDVIRFQKLDIEKDIEMQGFECGSYDLVIASQVLHATGKMEHTMANVRKLLKPGGKLLLVETTRDEMDLQLVFGLLPGWWLSSEEERQMSPSLSTNSWEKVLKKTGFDGLDIELRDCDSDEFYSFSVMMATASSTIASSSMAFAIVYGEVPLPDQFLDDMKTAISSSAVSDPVVGHLDSIDATGKFCIFIEDPETDILSSPDEKSYASIQKLVTRCKGLIWVSRGGAMHGTRPNSSLKTGLLRTLRLEYTEKRFISLDLDSARPQWNHDSITTINEVLCGALAQNADSSIKDSEFAEQDGQLFVPRISCDIARNEDLSSDSNSPAQMEPFHQPGKLLQMGIKTPGLIDTLQFSKTDATDNLPNDYIEIEPKAFGLNFRDVMVAMGQLEESIMGFECAGVVRRVGPSSAGHNIKVGDRVCALLGGQWTNTVRVHWHSVAPIPQAMDWETAASIPIVFVTAYISLVKIARMQAGETVLIHAASGGVGQAAIILAKHVGAEIFATVGTDEKRDLLIKEYKIPDDHIFSSRNALFAKSIRQRTNGKGVDVVLNCLAGGLLQESFDCLADFGRFIEIGKRDIELNHCLNMGMFARSATFTAVDLIAIGRDRSYMFAEALPKIMTLLQEKAIRPVTPISIYKIGDIETAFRLMQAGKHMGKIVITAPEDAMVPVITRPPKLQLRPDASYLIVGGLGGIGRSLCKNFVENGARSLVLLSRNANVSQQSGEFLDELRSTGCIVGVVDCDISSKTQVEATMLRLKKDMLPIRGIVHAGMVLQDSVFERMSLDDYNTAIRPKVQGSWNLHSGLSDCDLDFFIMLSSLAGVSGSASQANYTAGGAYQDALAKYRRAQGLSAVSIDLGMVQSVGYVAETKGVAERLVRMGYSPISEMEVLKIVEHAITNPPPEASSAQIITGISTKPGRHWTESSWLQDARFATLRERARDVKELSNSQGGAQDKQLAAGQELSMATSLVEAIDVVGRAITAKLATMFLIAAESIIASKSLSEYGVDSLVAVELRNWLAAQLSSDVSVFDVTQSQSLTALATTVATKSSRIDKSLLVA

SEQ ID NO: 19177 - protein, 332 aa, Arabidopsis thaliana
MLVDGKLVCVTGAGGYIASWIVKLLLERGYTVRGTVRNPTDPKNNHLRELQGAKERLTLHSADLLDYEALCATIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYILAETALHRGEVVEILAKFFPEYPLPTKCSDEKNPRAKPYKFTTQKIKDLGLEFKPIKQSLYESVKSLQEKGHLPLPQDSNQNEVIIES

SEQ ID NO: 19178 - protein, 386 aa, Arabidopsis thaliana
MGKGFNVVVVREYDPKRDLTSVEELEESCEVGSLLVDLMGDPLARIRQSPSFHMLVAEIGNEIVGMIRGTIKMVTRGVNALRQADDVSPEINTTKLAFVSGLRVSPFYRRMGIGLKLVQRLEEWFLRNDAVYSYVQTENDNIASVKLFTEKSGYSKFRTPTFLVNPVFNHRVTVSRRVKIIKLAPSDAESLYRNRFSTTEFFPSDINSILTNKLSLGTYLAVPRGGDNVSGSLPDQTGSWAVISIWNSKDVYRLQVKGASRLKRMLAKSTRVFDGAFPFLKIPSFPNLFKSFAMHFMYGIGGEGPRAAEMVEALCSHAHNLARKSGCAVVAAEVASCEPLRVGIPHWKVLSPEDLWCLKRLRYDDDGVDWTKSPPGLSIFVDPREI

SEQ ID NO: 19179 - protein, 470 aa, Escherichia coli
  misc_feature (153)..(154): Xaa can be any naturally occurring amino acid
  misc_feature (275)..(275): Xaa can be any naturally occurring amino acid
MIIITEPLLSFVLQKQGIKSPPMDKKMNNDNTDYVSNESGTLSRLFKLPQHGTTVRTELIAGMTTFLTMVYIVFVNPQILGAAQMDPKVVFVTTCLIAGIGSIAMGIFANLPVALAPAMGLNAFFAFVVVGAMGISWQTGMGAIFWGAVGLFXXTLFRIRYWMISNIPLSLRIGITSGIGLFIALMGLKNTGVIVANKDTLVMIGDLSSHGVLLGILGFFIITVLSSRHFHAAVLVSIVVTSCCGLFFGDVHFSGVYSIPPDISGVIGEVDLSGXLTLELAGIIFSFMLINLFDSSGTLIGVTDKAGLIDGNGKFPNMNKALYVDSVSSVAGAFIGTSSVTAYIESTSGVAVGGRTGLTAVVVGVMFLLVMFFSPLVAIVPPYATAGALIFVGVLMTSSLARVNWDDFTESVPAFITTVMMPFTFSITEGIALGFMSYCIMKVCTGRWRDLNLCVVVVAALFALKIILVD

SEQ ID NO: 19180 - protein, 463 aa, Escherichia coli
  misc_feature (176)..(176): Xaa can be any naturally occurring amino acid
MLAFLNQVRKPTLDLPLEVRRKMWFKPFMQSYLVVFIGYLTMYLIRKNFNIAQNDMISTYGLSMTQLGMIGLGFSITYGVGKTLVSYYADGKNTKQFLPFMLILSAICMLGFSASMGSGSVSLFLMIAFYALSGFFQSTGGSCSYSTITKWTPRRKRGTFLGFWNISHNLGGAGAXGVALFGANYLFDGHVIGMFIFPSIIALIVGFIGLRYGSDSPESYGLGKAEELFGEEISEEDKETESTDMTKWQIFVEYVLKNKVIWLLCFANIFLYVVRIGIDQWSTVYAFQELKLSKAVAIQGFTLFEAGALVGTLLWGWLSDLANGRRGLVACIALALIIATLGVYQHASNEYIYLASLFALGFLVFGPQLLIGVAAVGFVPKKAIGAADGIKGTFAYLIGDSFAKLGLGMIADGTPVFGLTGWAGTFAALDIAAIGCICLMAIVAVMEERKIRREKKIQQLTVA

SEQ ID NO: 19181 - protein, 440 aa, Escherichia coli
  misc_feature (176)..(176): Xaa can be any naturally occurring amino acid
  misc_feature (206)..(206): Xaa can be any naturally occurring amino acid
  misc_feature (399)..(400): Xaa can be any naturally occurring amino acid
MMLPFLKAPADAPLMTDKYEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMXAAALHYGWRAGMMIAGCMAIVVGIFLCWRXRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGXXLAKVLDTWHWSGFFVVISIAAGISALLLLPFLNAQTPREA

SEQ ID NO: 19182 - protein, 445 aa, Escherichia coli
  misc_feature (355)..(355): Xaa can be any naturally occurring amino acid
MSHQHTTQTSGQGMLERVFKLREHGTTARTEVIAGFTTFLTMVYIVFVNPQILGVAGMDTSAVFVTTCLIAAFGSIMMGLFANLPVALAPAMGLNAFFAFVVVQAMGLPWQVGMGAIFWGAIGLLLLTIFRVRYWMIANIPVSLRVGITSGIGLFIGMMGLKNAGVIVANPETLVSIGNLTSHSVLLGILGFFIIAILASRNIHAAVLVSIVVTTLLGWMLGDVHYNGIVSAPPSVMTVVGHVDLAGSFNLGLAGVIFSFMLVNLFDSSGTLIGVTDKAGLADEKGKFPRMKQALYVDSISSVTGSFIGTSSVTAYIESSSGVSVGGRTGLTAVVVGLLFLLVIFLSPLAGMVPXYAAAGALIYVGVLMTSSLARVNWQDLTESVPAFITAVMMPFSFSITEGIALGFISYCVMKIGTGRLRDLSPCVIIVALLFILKIVFIDAH

SEQ ID NO: 19183 - protein, 470 aa, Escherichia coli
  misc_feature (333)..(334): Xaa can be any naturally occurring amino acid
MKAFPETFLWGGATAANQVEGAWQEDGKGISTSDLQPHGVMGKMEPRILGKENIKDVAIDFYHRYPEDIALFAEMGFTCLRISIAWARIFPQGDEVEPNEAGLAFYDRLFDEMAQAGIKPLVTLSHYEMPYGLVKNYGGWANRAVIDHFEHYARTVFTRYQHKVALWLTFNEINMSLHAPFTGVGLAEESGEAEVYQAIHHQLVASARAVKACHSLLPEAKIGNMLLGGLVYPLTCQPQDMLQAMEENRRWMFFGDVQARGQYPGYMQRFFRDHNITIEMTESDAEDLKHTVDFISFSYYMTGCVSHDESINKNAQGNILNMIPNPHLKSSEXXWQIDPVGLRVLLNTLWDRYQKPLFIVENGLGAKDSVEADGSIQDDYRIAYLNDHLVQVNEAIADGVDIMGYTSWGPIDLVSASHSQMSKRYGFIYVDRDDNGEGSLTRTRKKSFGWYAEVIKTRGLSLKKITIKAP

SEQ ID NO: 19184 - protein, 485 aa, Felicia bergeriana
MSPQTETKASVGFKAGVKDYKLTYYTPEYETKDTDILAAFRVTPQPGVPPEEAGAAVAAESSTGTWTTVWTDGLTSLDRYKGRCYGIEPVLGEENQYIAYLAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEDMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRNLASEGNEIIREATKWSPELAAACEVWKEIKFEYEAMDTLDDDKDKTKLR

SEQ ID NO: 19185 - protein, 378 aa, Aspergillus niger
MVTSSSVIGLTLWAALVSASPVADPLVTPAPKLEDLEKRATSCTFSGSEGASSASKSKTSCSTIVLSDVAVPSGTTLDLTDLNDGTHVIFEGETHFGYEEWSGPLVSVSGTDITVTGADGAYLNGDGSRWWDGEGSNGGKTKPKFFYAHDLTSSTISGIYIQNSPVQVFSIDGSTYLTMEDITIDNTDGDDGEAANTDGFDIGDSTYITITGANVYNQDDCVAVNSGENIYFSGGVCSGGHGLSIGSVGGRSDNTVKNVTFYDSDIKSSQNGVRIKTIYGDTGSVSEVTYKEITLSDITDYGIVVEQNYDDTSESPTDGITIEDFVLDNVQGSVESSGTNIYIVCGSDSCTDWTWTDVDVTGGKTSSDCENVPDDISC

SEQ ID NO: 19186 - protein, 157 aa, Saccharomyces cerevisiae
MVVFKNIGHIITKALALGSSTVMMGGMLAGTTESPGEYLYQDGKRLKAYRGMGSIDAMQKTGTKGNASTSRYFSESDSVLVAQGVSGAVVDKGSIKKFIPYLYNGLQHSCQDIGCRSLTLLKENVQSGKVRFEFRTASAQLEGGVNNLHSYEKRLHN

SEQ ID NO: 19187 - protein, 2238 aa, Streptomyces cinnamonensis
MASEEQLVEYLRRVTTELHDTRRRLVQEEDRRQEPVALVGMACRFPGGVASPEDLWDLVAAGKDAIEDFPTDRGWDLEALYDPDPAAYGTSYVRHGGFVDDAGSFDADFFGISPREALAMDPQQRLMLETSWELFERAGIEPVSLKGSRTGVYAGVSSEDYMSQLPRIPEGFEGHATTGSLTSVISGRVAYNYGLEGPAVTVDTACSASLVAIHLASQALRQRECDLALAGGVLVLSSPLMFTEFCRQRGLAPDGRCKPFAAAADGTGFSEGIGLLLLERLSDARRNGHKVLAVIRGSAVNQDGASNGLTAPNDAAQEQVIRAALDNARLTPSEVDAVEAHGTGTKLGDPIEAGALLATYGQHRARPLLLGSLKSNIGHTHATAGVAGVIKTVMAIRNGLLPATLHVEELSPHVDWDAGAVEVVTEPTPWPETGHPRRAGVSAFGISGTNAHLILEEAPPEEDVPAPVVVESGGVVPWVVSGRTPEALREQARRLGEFVAGDTDALPNEVGWSLATTRSVFEHRAVVVGRDRDALTAGLGALAAGEASAGVVAGVAGDVGPGPVLVFPGQGAQWVGMGAQLLDESAVFAARIAECERALSAHVDWSLSAVLRGDGSELSRVEVVQPVLWAVMVSLAAVWADYGVTPAAVIGHSQGEMAAACVAGALSLEDAARIVAVRSDALRQLQGHGDMASLSTGAEQAAELIGDRPGVVVAAVNGPSSTVISGPPEHVAAVVADAEARGLRARVIDVGYASHGPQIDQLHDLLTERLADIRPTNTDVAFYSTVTAERLTDTTALDTDYWVTNLRQPVRFADTIEALLADGYRLFIEASAHPVLGLGMEETIEQADMPATVVPTLRRDHGDTTQLTRAAAHAFTAGADVDWRRWFPADPAPRTIDLPTYAFQRRRYWLADTVKRDSGWDPAGSGHAQLPTAVALADGGVVLNGRVSAERGGWLGGHVVAGTVLVPGAALVEWVLRAGDEAGCPSLEELTLQAPLVLPESGGLQVQVVVGAADEQGGRRDVHVYSRSEQDASAVWQCHAVGELGRASVARPVRQAGQWPPAGAEPVEVGGFYEGVAAAGYEYGPAFRGLRAMWRHGDDLLAEVELPEEAGSPAGFGIHPALLDAALHPLLAQRSRDGAGAGAHGGQVLLPFSWSGVSLWASEATTVRVRLTGLGGGDDETVSLTVTDPAGGPVVDVAELRLRSTSARQVRGSAGPGADGLYELRWTPLPEPLPVPAPANGRDVAADLSGCAVLGELVAEPGPGIDLEGCPCYPGVGALADNASPPSMILAPVHSDTTGGDGLALTERVLRVIQDFLAAPSLEQKQTRLAFVTRGAADTGSTTGGSAAPAEAVDPAVAAVWGLVRSAQSENPGRFVLLDTDAPLDQASVAPLVDAVRSAVEADEPQVALRGGRLLVPRWARAGEPVELAGPAGARAWRLVGGDSGTLEAVVAEACDDIVLRPLAPGQVRVAVHTAGVNFRDVLIALGMYPDPDALPGTEAAGVVTEVGPGVTRLSVGDRVMGMMDGAFGPWAVADARMLAPVPPGWGTRQAAAAPAAFLTAWYGLVELAGLKAGERVLIHAATGGVGMAAVQIARHVGAEVFATASPGKHAVLEEMGIDAAHRASSRDLAFEDAFRQATDGRGVDVVLNSLTGELLDASLRLLGDGGRFVEMGKSDPRDPELVALEHPGVSYEAFDLVADAGPERLGLMLDRLGELFAGGSLVPLPVTAWPLGRAREALRHMSQARHTGKLVLDVPAPLDPDGTVLVTGGTGTIGAAVAEHLARTGESKHLLIVSRSGPAAHGAEELVSRIAEFGAEATFVAADVSEPDAVAALIEGIDPAHPLTGVVHAAGVLDNALIGSQTTESLTRVWAAKAAAAQQLHEATRESRLGLFVMFSSFASTMGTPGQANYSAANAYCDALAALRRAEGLAGLSVAWGLWEATSGLTGTLSAADRARIDRYGIRPTSAARGCALLAAARAHGRPDLLAMDLDARVPAASDAPVPAVLRTLAAAGAPATARPTAAAAADGATDWSGRLAGLTEEARLELLTELVCTHAAGVLGHADAGAVQVDAPFKELGFDSLTAVELRNRIAAATGLKLPAALVFDYPQARVLAAHLAERLVPEGAGAMGGVSGAEGVRDAYGAGGPGGDMTAQVLLEVARVEHTLSAAVPHGLDRAAVAARLEALLARCTATTAATGAAGAAVEGDGDSDGDGAVDQLETATAEQVLDFIDNELGV

SEQ ID NO: 19188 - protein, 4132 aa, Streptomyces cinnamonensis
MVSEEKLVDYLKRVSADLHATRQRLREAEERGQEPVAVVEAACRYPGGIRTPEDLWDLVAAGGNALGAFPDNRGWDLRRLFHPDPDHPGTTYAREGGFLHDADLFDPEFFGISPREAAVLDPQQRLLLECAWEALERAGIDPRSLQGSRTGVYAGAALPGFGTPHIDPAAEGHLVTGSAPSVLSGRLAYTFGLEGPAVTIDTACSSSLVAVHLAAHALRQRECDLALAGGVTVMTTPYVFTEFSRQRGLAADGRCKPFAAAADGTAFSEGAGLLVLERLSDARRAGHRVLAVIRGSAVNQDGASNGLTAPNGPAQQRVIRAALAGARLSPAEVDAVEAHGTGTRLGDPIEADALLATYGQERHGGRPLWLGSVKSNIGHTQGAAGAAGLIKMVQALRHETLPATLYADEPTPHADWESGAVRLLSAPVAWPRGEHGEHTRRAGISSFGISGTNAHLILEEAPAADAEGAGGDGDGDGGGVRPVVRVGATGPREEQGQGQGQEQHQQQRQQRQRSSMMPTPHLPWLLSARSPAALRAQADALANHVAHADHSIADIGGTLLRRTLFEHRAVVLGTDRDERAAALAALAAGRAHPALTRAAGPARNGGTAFLFTGQGSQRPGMGRQLYDTFDVFAESLDETCARLDPLLEQPLKPVLFAPADTAQAAVLHGTGMTQAALFALEVALYRQVTSFGIAPSHLTGHSVGEIAAAHVAGVFSLADACTLVAARGRLMQALPAGGAMLAVQAAEDDVLPLLAGQEERLSLAAVNGPTAVVVSGEAAAVGEVEKALRGRGLKTKRLNVSHAFHSPLIEPMLDDFREVARGLTFHAPTLPVVSNLTGRLADAELMADAEYWVRHVRRPVRFHDGLRALSEQGVVRYLELGPDPVLATMVQDGLPAPAEGEEPEPVVAAALRSKHDEGRTLLGAVAALHTDGQPADLTALFPADAGQVPLPTYRFQRRRYWRVAPDAAAPARAAGLQETGHPLLPAVIRQADGGILLAGRLSLRTHPWLADHTIAGGVPLPATAFVELALLAGRHAACDTIDDLTLETPLLLDDTGTGVGAAVGAGADALVDAIEVQLALGAPDGSGRRALTVHSRPADDAADDGDAADAADAAGRGGPGGSGDLGDPGDPGDLGDGGGSRGWRRHATGILSAGPAAEPAAPDAAPWPPADATALDVDALYARLDAQGYSYGPAFRAVHAAWRHGDDLYADVRLADEQRAEADAFALHPALLDAALHAVDELYRGSEGRGQEQGQGGQEPEQGRGDADAPVRLPFSFSDIRHHATGATRLWVRLSPQGDDRLRLSLTDGEGGQVATVDALQLRLIPADRWRAARPTTAAPLYHLDWHELPLPEPAETDPAAHSWAVLGAHDAGLAPAAHYPDLAALKAAVEAGEPVPDIVFAPFPAQGTETDVPAQVRAHARHALELLRDWLTTEAFAAARLVVLTTGAVTARPEDGPADLATAPVWGLVRAAQAEQPDHVVLVDIDKDIDKDTDEETDQATDAGTASRHALPAALAAAAAQAETQLALRAGTVLVPRLAVVPPRTDTPALHATAPESTTDTVDSTGIAGAAESGGTVLITGGTGGLGQAVARHLAAAHGARHLLLVSRRGDAAEGVAELRADLADDGVDVRVAACDITDRDALAGLLADIPAAHPLTAVVHTAGVIDDSLITAMTPERLDAVLAPKADAAWHLHELTRDKDLSAFVLFSSGASVLGNGGQANYAAANTFLNTLAEHRRAAGLAATSVAWGLWESASGGMAARLGDADRARIHRTGVTGLTDEQALALFDAALTAEHPTVLATRFDRAVLRGQAAARTLQPALRGLVRTPRPTASAGAIGSTAATGSATDENAPSSWAARLARLSAADRDRALNELIREQIATVLAHPSPDTIELGRAFQELGFDSLTALELRNRLSTATGIRLPATLVFDHPSPTALVRHLHSHLPDEAQHTSPTAPGASAEGTAATATGIDDDPIAIVGMACRYPGGVTSPEQLWQLVATGTDAIGPFPEDRGWDTAGLFDPDPDQVGHSYTREGGFLYDAARFDAGFFGISPREAAATDPQQRLLLETAWQAFEHAGIDPAALRGTPCGVITGIMYDDYGSRFLARKPDGFEGRIMTGSTPSVASGRVAYTFGLEGPAITVDTACSSSLVAMHLAAQALRQGECELALAGGVTVMATPNTFVEFSRQRGLAPDGRCKPFAAAADGTGWGEGAGLVVLERLSDARRKGHRVLALLRGSAVNQDGASNGMTAPNGPSQERVIRTALAGAGRGPEDIDVVEAHGTGTTLGDPIEAQALLATYGQGRPEDRPLWLGSVKSNIGHTQAAAGVAGVIKMVMALRHEQLPTTLHADEPTPHVQWDGGGVRLLTEPVPWSRGERTRRAGVSSFGISGTNAHLILEEPPEEDLPEPVAAEPGGVVPWVVSGRTPDALREQARRLGEFVVGAGDVSAAEVGWSLATTRSVFEHRAVVAGRDRDDLVAGMQALAAGETPTDVVSGAAASSGAGPVLVFPGQGSQWVGMGAQLLDESPVFAARIAECEQALSAYVDWSLSDVLRGDGSELSRVEVVQPVLWAVMVSLAAVWADYGVTPAAVVGHSQGEMAAACVAGALSLEDAARIVAVRSDALRQLQGHGDMASLGTGAEQAAELIGDRPGVVVAAVNGPSSTVISGPPEHVAAVVAEAEARGLRARVIDVGYASHGPQIDQLHDLLTEGLADIRPANTDVAFYSTVTAERLTDTTALDTDYWVTNLRQPVRFADTIEALLADGYRLFIEASAHPVLGLGMEETIEQADIPATVVPTLRRDHGDTTQLTRAAAHAFTAGADVDWRRWFPADPTPRTVDLPTYAFQHQHYWLEEPSGLTGDAADLGMVAAGHPLLGACVELAESDSYLFTGRLSRRAPSWLAEHVVAGTVLVPGAALVEWVLRAGDEAGCPTIEELTLQAPLVLPESGGLQVQVVVGATDEQSGRRDVHVYSRSEQDASAVWVCHAVGVVSSEMPEAAAELSGQWPPAGAEAVDVEDFYARAAEAGYAYGPAFQGLRALWRHGTELFAEVVLPEQAGGHDGFGIHPALLDAALHPLMLLDRPADGQMWLPFAWSGVSLNADRATHVRVRLSPRGEAAERDLRVVIADATGAPVLTVDALTLRAADPGRLGAAARGGVDGLYTVDWTPLPLPQPLPLPRTDAGGSADWVILSDNSSAALADAVSSATAAGGGAPWALLAPVGGGSADDGLPVVRRTLSLVQEFLAAPELTESRLVIVTRGAVATDADGDVAASAAAVWGLIRSAQSENPGRFVLLDVEEEHLHPDGGELPYAALRHAVEELDEPQLALRSGKFLVPRMTPAAAPEELVPPVGTSGWRLGTSGTATLENLSVIDAPEAFAPLEPGQVRISVRAAGMNFRDVLIALGMYPDKGTFAGSEGAGHVTEVGPGVTHLSVGDRVMGLFEGAFAPLAVADARMVVPIPEGWSFQEAAAVPVVFLTAWYGLVDLGRLRAGESLLIHAGTGGVGMAATQIARHLGAEVFATASPAKHGVLDGMGIDAAHRASSRDLDFEETLRAATGGRGMDVVLNSLAGEFTDASLRLLAEGGRMVDMGKTDKRDPDRVAAEHAGAWYRAFDLVPHAGPDRIGEMLAELGELFASGALAPLPVQTWPLGRAREAFRFMSQAKHTGKLVLEIPPALDPDGTVLITGGTGVLAAAVAEHLVREWGVRHLLLAGRRGSEAPGSSELAEELTELGAEVTFAAADVSDPDAVAELVGKTDPAHPLTGVIHAAGVLDDAVVTAQTPESLARVWAAKATAAHLLHEATREARLGLFLVFSSAAATLGSPGQANYAAANAYCDALVRQRRAEGLAGLSIGWGLWQTASGMTGHLGETDLARMKRTGFTPLTTEGGLALLDAARAHGRPHVVAVDLDARAVAAQPAPSRPALLRALAAGATPGARTARRTAAAGSVAPAGGLADRLAGLPHPERRRLLLDLVRGNVAGVLGHSDHDAVRPDTSFKELGFDSLTAVELRNRLAAATGLKLPAALVFDYPESATLVDHLLERLSPDGAPPPVKDAADPVLNDLGRIESSLDALALDADARSRVTRRLNTLLSKLNGAATAGSPADVTDLDALDALDDVSDDEMFEFIDREL

SEQ ID NO: 19189 - protein, 407 aa, Medicago sativa
MKFSTAIIVSFLFLANFCAVQSVVLDISKFGGAPNSDITQAIGNAWKEACLSTTAAKIMIPGGTYRMNGVELKGPCKAPIEVQVDGTIQAPADPSQMKAADQWIKFLYMEHLTLSGKGVFDGQGATVYKKAAPAAAWSGKNSNVKIFMNLGFMFVNNSMVHGLTSKDSKNFHVMVLGCNNFTFDGFTVTAPGDSPNTDGIHMGRSTDIKILNTNIATGDDCISLGDGSRKITVQNVKCGPGHGISVGSLGKYTTEDNVEGVIVKNCTLTATQNGVRIKTWPDAPGTITVSDIHFEDIIMNNVMNPVIIDQEYCPWNQCSKKNPSKIKLSKISFKNIQGTSGTPEGVVLICSSGVPCDGVELNNVGLTFNGKPAIAKCSNVKPLVTGTAPACQAPGASPAAGRKSPAK

SEQ ID NO: 19190 - protein, 335 aa, Allium cepa
MEVERVQAIATLTANLGTIPPEFIRSDHERPDLTTYHGPVPELPVIDLANSSQENVVKQISEAAREYGIFQLVNHGIPNEVINELQRVGKEFFQPPQEEKEVYATVPDSGSFEGYGTKLQKDLEGKKAWVDYLFHNVWPEHKINYKFWPRNPPAYRKANEEYTKHLQVVVDKMHSYLSLGLGLESHVLKEAVGGDDLEYLLKINYYPPCPRPNLALGVVAHTDMSSLTILVPNEVPGLQVFKDDHWFDAKYIPNALICHIGDQLEILSNGKYKSVLHRTTVNKEKSRMSWPVFCSPPGDTMIGPLPQLVNDENPPKFKTKKYKDYAYCKINKLPQ

SEQ ID NO: 19191 - protein, 352 aa, Allium cepa
MPIESVIIAPPAPRVETLSKSNLHSIPLEYIRPEHERACLGDALEQLHNSNSGPQIPITDLDSRDCIEKVTKAAKEWGVMHIVNHGISSELMEKVRAAGKAFFNLPLEAKEEYANDQSKGKIQGYGSKLANNASGQLEWEDYFFHLIFPDDKVDLSVWPKQPSDYIEIMQEFGSQLRILASKMLSILSLGLQLPTKDRLEQELKGPEDLLLQLKINYYPKCPQPHLALGVEAHTDVSALSFILHNNVPGLQVLYEGEWVTAKLVPDSLIVHVGDSLEILSNGIYKSVLHRGLVNKEKVRISWAVFCEPPKDAVVLKPLDEVVTDDAPARYTPRTFAQHLERKLFKKKGWRFG

SEQ ID NO: 19192 - protein, 383 aa, Allium cepa
MMKEIGAAGGAVVVTGAGGYVGSWLVMKLLHYGYTVRATLRDSSDEAKTKPLLELPGADTRLSLWEADLLQDGSFDHVISGSIAVFHVATPMDFDSIDPENEVIKPAVNGMLSIMKSCKKAGTVKRVIFTSSAGTVNVEEHQKPEYDENSWSDIDFCRRVKMTGWMYFVSKSLAEKAAWEFAKANGIDLVTIIPTLVVGAFITTAMPPSMITALSLITGNEAHYSIIKQAQLVHLDDLCEAHILLLNHPKAEGRYICSSHDVTIYDMAKMIRQNYPQYYIPQQFEGIDKGIQPVRFSSKKLVDLGFRYKYSMESMFDEAIKTCVERKFIPLQTAVELQLKPYELLEHNNKNGVVTNTIKIVGQMVNTKAMITEHEENEPIATH

SEQ ID NO: 19193 - protein, 280 aa, Chlamydomonas reinhardtii
MPPQTSFGLQDPHYFLGRAEILGWINDTLGLRLTKVEDTCNGAVACQLLDVLHPGAVPMAKVDYNANSEYQMINNYKVLQDCFNKLKIDKYVEVARLVKGRPLDNMEFMQWFKAYWDQIIPPGSAPAPYDGPSRRALCKTGDMKHSGGGPAPPKAGGIKAGPPAVSAAPRAAPAAAPRVAAGPKGSPGDRDQMDKLNHQLEDLRLKADGYEKEKDFYYSKLRDVELLCQTPTVCELPIMKRVQEILYAATAEDGGRIMRETQVEFAGREYTEEELSAADG

SEQ ID NO: 19194 - protein, 401 aa, Populus tremuloides
MATKKSVSSLKEADLKGKRVFVRVDLNVPLDDNFNITDDTRIRAAVPTIKYLMGHGARVILSSHLGRPKGVTPKYSLKPLVPRLSELLGVDVKMANDCIGVEVEKIVAEIPEGGVLLLENVRFYKEEEKNDPEFAKKLASLAEIYVNDAFGTAHRAHASTEGVAKYLKPAVAGFLMQKELDYLVGAVANPKKPFAAIVGGSKVSSKIGVIESLLEKVDLLFLGGGMIYTFYKAQGHSVGSSLVEEDKLDLATSLIEKAKVKGVKLLLPADVVVADKFAPDANSKVVAASEIPDGWMGLDIGPDSIKTFNEALDTTKTIIWNGPMGVFEFEKFAAGTEAIARKLAELSGKGVTTIIGGGDSVAAVEKAGLADKMSHISTGGGASLELLEGKPLPGVLALDDA

SEQ ID NO: 19195 - protein, 481 aa, Oryza sativa (japonica cultivar-group)
MEPKNAIALDEHVLDSTIRKRKRVGATQCAEANDAPNLSQNGPKQNLALFPDSTGHKKSKMMCSADDILERYNNFKISGMPVRVMSHQHGGWRDFPEDVVNSVQQSFQLKRPITSAVFQNRHILLDFMQMVCLDSVMAISKPIAWIDDHGKCFSPDSCAGVIPSEPLQHGKNEFLKSFHDLSSSYEAHEHDGMSAAESSSSASFDAVLSDVQEVNNVVEDKQKVLNESGEVSGENKKGHLSHMNETADGAMQAPRNNQSVQRADSAVRNLLFQGSGHLFTEKDIIGIYRTPMLDQLGRSRYSLFQKEVQVTKNQRGNANERYAWLACTKGTMEEMMMNGALEIAKPLQGPMYGVGAHLAPANSSNICVGLSDIDENGIIRMMLCRVIMGNVEVVFPGSNQCQPTSESFDSGVDDLQRPKHYIIWDANVHKHIYAEYAVIIKVPYMNNGDTASNISEIRNSGALDNPTKVCILWFSWCAVVH

SEQ ID NO: 19196 - protein, 379 aa, Salmonella enterica subsp. enterica serovar Typhi Ty2
MAKRDYYEILGVSKTAEEREIKKAYKRLAMKYHPDRNQGDKEAEAKFKEIKEAYEVLTDAQKRAAYDQYGHAAFEQGGMGGGFGGGFNGGADFSDIFGDVFGDIFGGGRGRQRAARGADLRYNMDLTLEEAVRGVTKEIRIPTLEECDVCHGSGAKAGTQPQTCPTCHGSGQVQMRQGFFAVQQTCPHCQGRGTLIKDPCHKCHGHGRVEKSKTLSVKIPAGVDTGDRIRLAGEGEAGEHGAPAGDLYVQVQVKQHPIFEREGNNLYCEVPINFAMAALGGEIEVPTLDGRVMLKVPSETQTGKLFRMRGKGVKSVRGGAQGDLLCRVVVETPVGLSEKQKQLLKDLQESFGGPTGEKNSPRSKSFFDGVKKFFDDLTR

SEQ ID NO: 19197 - protein, 380 aa, Salmonella enterica subsp. enterica serovar Typhi Ty2
MDFNLNDEQELFVAGIRELMASENWEAYFAECDRDSVYPERFVKALADMGIDSLLIPEEHGGLEAGFVTVAAVWMELGRLGAPTYVLYQLPGGFNTFLREGTQEQIDKIMAFRGTGKQMWNSAITEPGAGSDVGSLKTTYTRKNGKVYLNGSKCFITSSAYTPYIVVMARDGASPDKPVYTEWFVDMSKAGIKVNKLEKLGLRMDSCCEITFDDVELDEKDMFGREGNGFNRVKEEFDHERFLVALTNYGTAMCTFEDAARYANQRVQFGEAIGRFQLIQEKFAHMAIKLNSMKNMLLEAAWKADNGTITSGDAAMCKYFCANAAFEVVDTAMQVLGGVGIAGNHRITRFWRDLRVDRVSGGSDEMQILTLGRAVLKQYR

SEQ ID NO: 19198 - protein, 446 aa, Salmonella enterica subsp. enterica serovar Typhi Ty2
MPQPRNFDDLKFSSIHRRIMLWGSGGPFLDGYVLVIIGVALEQLTPLLHLDAEWIGALGAATLAGLFIGTSLFGYICDKVGRRKMFLLDIIAIGVISVATMFVSTPLELLVMRVLIGIVIGADYPIATSMITEFSNTRQRAFSIGFIAAMWYVGATCANLVGYWLYDMEGGWRWMLGSAFIPCLIILIGRFDLPESPRWLLRKGRVKECEQMMIKLFGEPVCFDDEPPQETRFLQLFNRRHFPFVLFVAAIWSCQVIPMFAIYTFGPQIVGLLGWEQGRNAALGNVVISLFFMLGCIPAMFWLNSIGRRPLLIGSFAMMTIALALLGLVSNLGIILVVVAFAVYAFFSGGPGILQWLYPNELFPTDIRASAVGVIMSLSRIGTIVSTWALPIFITRYGINNVMLIGALISLVGLGVSVMFAPETRGLTLTQTGNMTLRGTPSDNPR

SEQ ID NO: 19199 - protein, 329 aa, Salmonella enterica subsp. enterica serovar Typhi Ty2
MQYRTLGANGPRVSAIGLGCMGMSAFYGAHDDSTSIKTLHYALDQGVTLLDTADMYGPYTNERLVGRAIADRRDRVFLATKFGIVLDPANPMARGVNGRPEYVRRSCEQSLQRLGVDHIDLYYQHRVDPSVPIEETVGAMADLVREGKVRYLGLSEASTQTLERAHNVHPITALQSEYSLWSREAEISALSTCERLGIGFVAYSPLGRGFLTGTIKTPEDFAANDFRRTNPRFMGENFSRNLRLAEAIKQMAREKECTPAQLALAWLLARNRHLVPIPGTRHCARVDENLGALSLTLSPQELAAIEAVFPHDAAAGPRYWPEIMSTLNR

SEQ ID NO: 19200 - protein, 347 aa, Salmonella enterica subsp. enterica serovar Typhi Ty2
MRIEEDLKLGFKDVLIRPKRSTLKSRSDVELERQFTFKHSGQTWSGVPIIAANMDTVGTFEMAQALAGFDILTAVHKHYSVEEWAAFINTASADVLKHVMVSTGTSDADFEKTVQILALNPALNFVCIDVANGYSEHFVQFVAKAREAWPSKTICAGNVVTGEMCEELILSGADIVKVGIGPGSVCTTRVKTGVGYPQLSAVIECADAAHGLGGMIVSDGGCTMPGDVAKAFGGGADFVMLGGMLAGHEESGGSVVEENGEKFMLFYGMSSESAMNRHVGGVAKYRAAEGKTVKLPLRGPVGNTARDILGGLRSACTYVGASRLKELTKRTTFIRVQEQENRIFNSL

SEQ ID NO: 19201 - protein, 456 aa, Salmonella enterica subsp. enterica serovar Typhi Ty2
MDSQQHGEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 19202 - protein, 475 aa, Salmonella enterica subsp. enterica serovar Typhi Ty2
MMSTEIKTQVVVLGAGPAGYSAAFRCADLGLETVIVERYNTLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIQLPFIPHEDPRVWDSTDALELKEVPKRMLVMGGGIIGLEMGTVYHALGSEIDVVEMFDQVIPAADKDIVKVFTKRISKKFNLMLETKVTAVEAKEDGIYVSMEGKKAPAEAQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEIFEGSITDLPNPKAKKK

SEQ ID NO: 19203 - protein, 286 aa, Salmonella enterica subsp. enterica serovar Typhi Ty2
MAENTMWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVETITMVEIDAGVVSFCRQYLPNHNAGSYDDPRFTLVIDDGVNFVNQTHQTFDVIISDCTDPIGPGESLFTSAFYEGCKRCLNPGGIFVAQNGVCFLQQDEALDSHRKLSHYFSDVGFYQAAIPTYYGGIMTFAWATDNDALRHLSSEIIQARFHAAGLKCRYYNSAIHAAAFALPQYLHDALSAQ

SEQ ID NO: 19204 - protein, 178 aa, Salmonella enterica subsp. enterica serovar Typhi Ty2
MKHTVEVMIPEAEIKARIAELGRQITERYKDSDSEMVLVGLLRGSFMFMADLCREVQVPHEVDFMTASSYGSGMSTTRDVKILKDLDEDIRGKDVLIVEDIIDSGNTLSKVREILGLREPKSLAICTLLDKPSRREVDVPVEFVGFSIPDEFVVGYGIDYAQRYRHLPYVGKVVLLDE

SEQ ID NO: 19205 - protein, 426 aa, Salmonella enterica subsp. enterica serovar Typhi Ty2
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAELVTNLVPTMDMVRMVNSGTEATMSAIRLARGFTGRDKIIKFEGCYHGHADCLLVKAGSGALTLGQPNSPGVPADFAKHTLTCTYNDLTSVRAAFEQYPQEIACIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGIHETLDELTTRLAEGLLEAAEEANIPLVVNHVGGMFGIFFTDAESVTCYQDVMACDVERFKRFFHLMLEEGVYLAPSAFEAGFMSVAHSMDDINNTIDAARRVFAKL

SEQ ID NO: 19206 - protein, 490 aa, Salmonella enterica subsp. enterica serovar Typhi Ty2
MPMLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLHEVKALTERNGFAGYPVVTEDNELVGIITGRDVRFVTDLNQPVSVYMTPKERLVTVREGEAREVVLAKMHEKRVEKALVVDDNFHLLGMITVKDFQKAERKPNSCKDEQGRLRVGAAVGAGAGNEERVDALVAAGVDVLLIDSSHGHSEGVLQRIRETRAKYPDLQIIGGNVATGAGARALAEAGCSAVKVGIGPGSICTTRIVTGVGVPQITAVSDAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCATIDELRTKAEFVRISGAGIQESHVHDVTITKESPNYRLGS

SEQ ID NO: 19207 - protein, 364 aa, Salmonella enterica subsp. enterica serovar Typhi Ty2
MSIEIARIKKSFGRTQVLNDISLDIPSGQMVALLGPSGSGKTTLLRIIAGLEHQSSGHIRFHGTDVSRLHARERKVGFVFQHYALFRHMTVFDNIAFGLTVLPRRDRPTAAAIKTKVTQLLEMVQLAHLADRFPAQLSGGQKQRVALARALAVEPQILLLDEPFGALDAQVRKELRRWLRQLHEELKFTSVFVTHDQEEATEVADRVVVMSQGNIEQADAPDRVWREPATRFVLEFMGEVNRLTGTVRGGQFHVGAHRWPLGYTPAYQGPVDLFLRPWEVDISRRTSLDSPLPVQVIEASPKGHYTQLVVQPLGWYHDPLTVVMAGDDVPQRGERLFVGLQNARLYHGDQRIEPHEALALAESA

SEQ ID NO: 19208 - protein, 303 aa, Salmonella enterica subsp. enterica serovar Typhi Ty2
MNTLEQTIGNTPLVKLQRLGPDNGSEIWVKLEGNNPAGSVKDRAALSMIVEAEKRGEIKPGDALIEATSGNTGIALAMIAALKGYRMKLLMPDNMSQERRAAMRAYGAELILVTKEQGMEGARDLALAMSERGEGKLLDQFNNPDNPYAHYTTTGPEIWRQTSGRITHFVSSMGTTGTITGVSRFLREQEKTVTIVGLQPEEGSSIPGIRRWPTEYMPGIFNASLVDEVLDIHQNDAENTMRELAVREGIFCGVSSGGAVAGALRVARATPGAIVVAIICDRGDRYLSTGVFGEEHFSQGAGI

SEQ ID NO: 19209 - protein, 412 aa, Salmonella enterica subsp. enterica serovar Typhi Ty2
MADSRPERRFTRIDRLPPYVFNITAELKMAARRRGEDIIDFSMGNPDGATPPHIVEKLCTVAQRPDTHGYSTSRGIPRLRRAISHWYQERYDVDIDPETEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGAFTPLQVAAIAALEGDQQCVRDIAEQYKRRRDVLVKGLHEAGWMVEMPKASMYVWAKIPEQYAAMGSLEFAKKLLNEAKVCVSPGIGFGDYGDTHVRFALIENRDRIRQAVRGIKTMFRADGVLPSHPKPVEASTE

SEQ ID NO: 19210 - protein, 304 aa, Salmonella enterica subsp. enterica serovar Typhi Ty2
MSWIERIKSNITPTRKASIPEGVWTKCDSCGQVLYRAELERNLEVCPKCDHHMRMSARNRLHSLLDEGSLVELGSELEPKDVLKFRDSKKYKDRLASAQKETGEKDALVVMKGTLHGMPVVAAAFEFAFMGGSMGSVVGARFVRAVEQALEDNCPLVCFSASGGARMQEALMSLMQMAKTSAALAKMQERGLPYISVLTDPTMGGVSASFAMLGDLNIAEPKALIGFAGPRVIEQTVREKLPPGFQRSEFLIEKGAIDMIVRRPEMRLKLASILAKLMNLPAPNPDAPREGVVVPPAPDQESEA

SEQ ID NO: 19211 - protein, 429 aa, Salmonella enterica subsp. enterica serovar Typhi Ty2
MDTLQQSPPAEPEGGLRRNLKKRHLLMMSLGGTIGTGLFIGIAEPLSSVGPAGTLLAYLFAGTIMLATMMCLGELSCAFPHSGSFQHYALMFMPSPCWSYTIGWLYWFSWVFSLAADLTAAGFIAHQFFPAVPVYMFCLAILLILTAINLTSAKSFGECEYWLSAIKVFAIVLFICAGGVMIYSLMGHSDWHPTLKTDGMWFPHGWEQIVVCMTIVIYSFQGVELVGNAAGETESPHIILPKVILGIGLRIILFYGLAIAVLALVYPHELTPNGQSPFVWVFSHAGIPGADTLMTLVIFSAAVSAANSAIYASSRMLWSMAGDRFAPACFGKTNGGGVPVYAILITALLALVSLLTRYIPAQQFYLYLIASTGQVGCLAWITIGWCQYRFRQSVRNGTYASDLLRYRSPLFPWTARFVIITNFAIMVGT

SEQ ID NO: 19212 - protein, 258 aa, Salmonella enterica subsp. enterica serovar Typhi Ty2
MMSENKLHVIDLHKRYGGHEVLKGVSLQARAGDVISIIGSSGSGKSTFLRCINFLEKSSEGAIIVNGQNINLVRDKDGQLKVADKNQLRLLRTRLTMVFQHFNLWNHMTVLENVMEAPIQVLGLSKHDARERALKYLAKVGIDERAQGKYPVHLSGGQQQRVSIARALAMEPDVLLFDEPTSALDPELVGEVLRIMQQLAEEGKTMVVVTHEMGFARHVSSHVIFLHQGKIEEEGNPEQVFGNPQSPRLQQFLKGSLK

SEQ ID NO: 19213 - protein, 452 aa, Salmonella enterica subsp. enterica serovar Typhi Ty2
MLSIFKPALHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPSCGRTMVHWWSQKERGGIVSVWNCAHNVGGGIPPLLFLLGMAWFNDWKAALYMPAFGAIVVALFAFAMMRDTPQSCGLPPIEEYKNDYPDDYNEKAEEELTAKQIFMQYVLPNKLLWYIAIANVFVYLLRYGILDWSPTYLKEVKHFALDKSSWAYFLYEYAGIPGTLLCGWMSDKVFRGNRGASGVFFMTLVTIATIVYWMNPAGNPNVDMACMIIIGFLIYGPVMLIGLHALELAPKKAAGTAAGFTGLFGYLGGSVAASAIVGYTVDFFGWDGGFMVMIGGSILAVILLVVVMIGEKRHHDELQLKRNGG

SEQ ID NO: 19214 - protein, 489 aa, Salmonella enterica subsp. enterica serovar Typhi Ty2
MGSKTKTTEAPALRRELKARHLTMIAIGGSIGTGLFVASGATISLAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGYDVNDLPYRSGFFPLGPIFAFVLCLIITLGQNYEAFLKDTIDWGGVAATYIGIPLFLLIWFGYKLIKGTHFVRYSEMHFPERVKK

SEQ ID NO: 19215 - protein, 413 aa, Salmonella enterica subsp. enterica serovar Typhi Ty2
MPQQNYLDELTPGFTPLLAIKEASRCLLCHDAPCSQACPAQTDPGKFIRSIYFRNFKGAAETIRENNALGAVCARVCPTEKLCQRGCTRSGIDKPIDIARLQRFITDFEQQTAMQIYQPGSKTRGKVAIIGAGPAGLQASVTLTHLGYDVTIYEKQPQPGGWLRHGIPAFRLPQSVLDQEIARIVEMGVNIKCNCDVGGSLSLAQLKAEYRAVLMTVGMSCGSDLPLFEQASHVEIAVDFLQRARQADGDISVPRSALIIGGGDVAMDVASTLKILGCPSVTCVAREELAEFPASEKEFTSTQALGVSIIDGFTPVAVSGNKVTFHHVRHSGELTLEAENIILAVGQHARLDNFAEIKAQHNIIDTHNYQTDDPAIFAAGDIVKGDKTVVYAVKTGKEAAQAIHHYLEEACSC

SEQ ID NO: 19216 - protein, 452 aa, Salmonella enterica subsp. enterica serovar Typhi Ty2
MTQRRDLQALIDAAPVGKMQWRVIICCFLVVMLDGFDTAAIGFIAPDIRTHWQLSASELAPLFGAGLLGLTAGALLCGPLADRFGRKRVIELCVALFGALSLLSAFSPDIETLVLLRFLTGLGLGGAMPNTITMTSEYLPARRRGALVTLMFCGFTLGSAMGGIVSAQLVPLIGWHGILALGGILPLMLFFGLLFALPESPRWQVRRQLPQAVVARTVSAITGERYHDTQFFLHETAAVAKGSIRQLFAGRQLVITLMLWVVFFMSLLIIYLLSSWMPTLLNHRGIDLQQASWVTAAFQVGGTLGALLLGVLMDRLNPFRVLAVSYALGAVCIVMIGLSENGLWLMALAIFGTGIGISGSQVGLNALTATLYPTQSRATGVSWSNAIGRCGAIVGSLSGGMMMALNFSFDTLFFVIAIPAAISAVMLTLLTVVVRLSISVPDDLPRASVVNE

SEQ ID NO: 19217 - protein, 480 aa, Salmonella enterica subsp. enterica serovar Typhi Ty2
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 19218 - protein, 479 aa, Salmonella enterica subsp. enterica serovar Typhi Ty2
MSFLPVIMAGGTGSRLWPLSREYHPKQFLSVEGKLSMLQNTIKRLASLSTEEPVVICNDRHRFLVAEQLREIDKLANNIILEPVGRNTAPAIALAAFCALQNADNADPLLLVLAADHVIQDEIAFTKAVRHAEEYAANGKLVTFGIVPTHAETGYGYIRRGELIGNDAYAVAEFVEKPDIDTASDYFKSGKYYWNSGMFLFRASSYLNELKYLSPEIYKACEKAVGHINPDLDFIRIDKEEFMSCPSDSIDYAVMEHTQHAVVIPMSAGWSDVGSWSSLWDISNKDHQRNVLKGDIFAHACNDNYIYSEDMFISAIGVSNLVIVQTTDALLVANKDTVQDVKKIVDYLKRNDRNEYKQHQEVFRSWGKYNVIDSGKNYLVRCITVKPGEKFVAQMHHHRAEHWIVLSGTARVTKGEQIYMVSENESTFIPPDTIHALENPGMIPLQLIEIQSGTYLGEDDIIRLEQRSGFSKEWTNERS

SEQ ID NO: 19219 - protein, 468 aa, Salmonella enterica subsp. enterica serovar Typhi Ty2
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLIDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRTDKEGIFHTEWLE

SEQ ID NO: 19220 - protein, 203 aa, Salmonella enterica subsp. enterica serovar Typhi Ty2
MLTEQQRRELDWEKTDGLMPAIVQHAVSGEVLTLGYMNPQALDKTIESGHVTFFSRTKQRLWTKGETSGHVLNVVSIAPDCDNDTLLVLANPVGPTCHKGTSSCFGDASHQWLFLYQLEQLLAERKTADPASSYTAKLYASGTKRIAQKVGEEGVETALAATVNDRFELTNEASDLMYHLLVLLQDQDLNLTTVIDDLRKRHQ

SEQ ID NO: 19221 - protein, 264 aa, Salmonella enterica subsp. enterica serovar Typhi Ty2
MNDSLKAQCGAEFLGTGLFLFFGIGCLSALKVAGASLGLWEICIIWGLGISLAVYLTAGISGGHLNPAVTIALWLFACFPKQKVLPYIIAQFAGAFGGDLLAYVLYSSLFTEFETAHHMVRGSVESLQLASIFSTYPAAALNVWQAALVEVVITSILMGMIMALTDDGNGIPKGPLAPLLIGILVAVIGASTGPLTGFAMNPARDFGPKLFTWLAGWGNMAMSGGREIPYFIVPIVAPVIGACAGAAIYRYFIGKNLPCNRCKL

SEQ ID NO: 19222 - protein, 328 aa, Salmonella enterica subsp. enterica serovar Typhi Ty2
MPLHHLTRFPRLELIGAPTPLEYLPRLSDYLGREIYIKRDDVTPIAMGGNKLRKLEFLVADALREGADTLITAGAIQSNHVRQTAAVAAKLGLHCVALLENPIGTTAENYLTNGNRLLLDLFNTQIEMCDALTDPDAQLQTLATRIEAQGFRPYVIPVGGSSALGAMGYVESALEIVQQCEEVVGLSSVVVASGSAGTHAGLAVGLEHLMPDVELIGVTVSRSVAEQKPKVIALQQAIAGQLALTATADIHLWDDYFAPGYGVPNDAGMEAVKLLANLEGVLLDPVYTGKAMAGLIDGISQKRFNDDGPILFIHTGGAPALFAYHPHV

SEQ ID NO: 19223 - protein, 267 aa, Salmonella enterica subsp. enterica serovar Typhi Ty2
MAEPLTVSPELTANYAYFFDLDGTLAEIKPHPDQVVVPHKILQLLDRLAAHNAGALALISGRSMTELDALAKPFRFPLAGVHGAERRDISGKTHIVRLPEAVVREVEALLRSTLAALPGTELETKGMAFALHYRQAPEHEAALLALAQHVTQHWPQLALQPGKCVVEIKPKGTNKGEAIAAFMQEAPFTGRIPVFVGDDLTDEAGFGVVNHAGGISVKVGVGATQAAWRLESVPDVWRWLEQINYPQQEQQVMNNRRDGYESFSRSI

SEQ ID NO: 19224 - protein, 480 aa, Salmonella enterica subsp. enterica serovar Typhi Ty2
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIQTAALIGVDYLAVSFPRCGEDLNYARRLARDAGCDAKIVAKVERAEAVCDQNAMDDIILASDVVMVARGNLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSAADGVVAAHEAVNLLRDKGYLVSGDLVIVTQGDVMSTVGSTNTTRILTVE

SEQ ID NO: 19225 - protein, 408 aa, Salmonella enterica subsp. enterica serovar Typhi Ty2
MSLSVTRENFDEWMVPVYVPAPFIPVRGEGSRLWDQQGKEYIDFAGGIAVNALGHAHPALREALNEQANRFWHTGNGYTNEPALRLAKKLIDATFAERVFFCNSGAEANEAALKLARKYAHDRVGNHKSGIVAFKNAFHGRTLFTVSAGGQPTYSQDFAPLPPDIRHAAYNDLNSASALIDDNTCAVIVEPVQGEGGVIPATNAFLQGLRELCDRHQALLIFDEVQTGVGRTGELYAYMHYGVTPDILTTAKALGGGFPIGAMLTTQDYASVMTPGTHGTTYGGNPLATAVAGKVLDIINTPEMQNGVRQRHDAFIERLNTINVRFGMFSEIRGLGLLLGCVLQTEFAGKAKLIAQEAAKAGVMVLIAGGDVVRFAPALNVSDEEIATGLDRFALACERLQAGGASCG

SEQ ID NO: 19226 - protein, 470 aa, Salmonella enterica subsp. enterica serovar Typhi Ty2
MKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKVICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYNNDSRKLRITEAVCRGAVETAEKLEAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 19227 - protein, 457 aa, Salmonella enterica subsp. enterica serovar Typhi Ty2
MQKYTSEARQLLALAIPVILAQVAQTAMGFVDTVMAGGYSATDMAAVAIGTSIWLPAILFGHGLLLALTPVIAQLNGSGRRERIAHQVRQGFWLAGFVSVLVMIVLWNAGYIIRSMHNIDPALADKAVGYLRALLWGAPGYLFFQVARNQCEGLAKTKPGMVMGFLGLLVNIPVNYIFIYGHFGMPELGGIGCGVATAAVYWVMFIAMLSYIKHARSMRDIRNEKGFGKPDSVVMKRLIQLGLPIALALFFEVTLFAVVALLVSPLGIVDVAGHQIALNFSSLMFVLPMSLAAAVTIRVGYRLGQGSTLDAQTAARTGLGVGICMAVVTAIFTVTLRKHIALLYNDNPEVVALAAQLMLLAAVYQISDSIQVIGSGILRGYKDTRSIFFITFTAYWVLGLPSGYILALTDLVVDRMGPAGFWMGFIIGLTSAAVLMMLRMRYLQRQPSAIILQRAAR

SEQ ID NO: 19228 - protein, 365 aa, Salmonella enterica subsp. enterica serovar Typhi Ty2
MSSAKLFTPLKVGAITATNRVFMAPLTRLRSIEPGDIPTPLMAEYYRQRASAGLIISEATQISAQAKGYAGAPGLHSDEQIAAWKKITQGVHAQGGHMAVQLWHTGRISHASLQPGGQAPVAPSAINAGTRTSLRDENGQAIRVETSTPRALDTHEIPGIVNDFRQAIANAREAGFDLVELHSAHGYLLHQFLSPSSNHRTDRYGGSVENRARLVLEVVDAGIKEWGADRIGIRLSPVGTFQNVDNGPNEEADALYLIEALGKRGIAYLHMSEPDWAGGEPYSDAFREKVRARFHGPIIGAGAYTPEKAEDLIEKGLIDAVAFGRDYIANPDLVARLQRKAELNPQRPESFYGGGAEGYTDYPTL

SEQ ID NO: 19229 - protein, 308 aa, Salmonella enterica subsp. enterica serovar Typhi Ty2
MARAMDNAILETILQRVRPLIGQGKVADYIPALASVEGSKLGIAICTVDGQHYQAGDAHERFSIQSISKVLSLVMAMRHYPEEEIWQRVGKDPSGSPFNSLVQLEMEQGIPRNPFINAGALVVCDMLQGRLSAPRQRMLEVARALCGVSDITYDATVARSEFEHSARNAAIAWLMKSFGNFHHDVPTVLQNYFHYCALKMSCMELARTFVFLANQGEAFHLDEPVVTPMQARQINALMATSGMYQNAGEFAWRVGLPAKSGVGGGIVAIVPHEMAIAVWSPELDPAGNSLAGIAALEQLTQTLGRLVY

SEQ ID NO: 19230 - protein, 481 aa, Salmonella enterica subsp. enterica serovar Typhi Ty2
MTIWENAMQYQLLINGVLVDGEGERQSVYNPATGEVILEIAEASPVQVDAAVLAADSAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDKSTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 19231 - protein, 210 aa, Salmonella enterica subsp. enterica serovar Typhi Ty2
MILHPSLASADPLRYAEALTALHDAPLGSLHLDIEDTSFINNITFGMKTIQAVAQYSRHPLSFHLMVSSPQRWLPWLAAIRPGWIFIHAESVQNPSEILADIRAIGAKAGLALNPATPLLPYRYLALQLDALMIMTSEPDGRGQQFIAAMCEKVSQSREHFPAAECWADGGITLRAARLLAAAGAQHLVIGRALFTTANYDVTLSQFTAL

SEQ ID NO: 19232 - protein, 243 aa, Salmonella enterica subsp. enterica serovar Typhi Ty2
MALLELKEISKEYSGKKVLDAVSLKIQSGDMKVVMGPSGCGKTTLLRCLLRLEEPDYGDIYFHGENIYDKEFTILEFRKKVGCVFQNYALYRHLNVMDNITLALCKVFGMPGQLAREKALHELQKLDMVSHSAKYPSQLSGGQQQRVALARTMVTDPELIIFDEPTSALDPLMTREVGMLIKQLHDNGVTILCVTHDIRLARLLSDNVTFLNHGKIRAEGAFTDLALRETDPDIHCFFSEAQR

SEQ ID NO: 19233 - protein, 268 aa, Salmonella enterica subsp. enterica serovar Typhi Ty2
MERYENLFAQLNDRREGAFVPFVTLGDPGIEQSLKIIDTLIDAGADALELGVPFSDPLADGPTIQNANLRAFAAGVTPAQCFEMLALIREKHPTIPIGLLMYANLVFNNGIDAFYARCEQVGVDSVLVADVPVEESAPFRQAALRHNIAPIFICPPNADDDLLRQVASYGRGYTYLLSRSGVTGAENRGALPLHHLIEKLKEYHAAPALQGFGISSPEQVSAAVRAGAAGAISGSAIVKIIEKNLASPEQMLAELRSFVSAMKAASRA

SEQ ID NO: 19234 - protein, 1320 aa, Salmonella enterica subsp. enterica serovar Typhi Ty2
MGTTTMGVKLDDATRERIKMAASRIDRTPHWLIKQAIFSYLDKLENSDTLPELPALFAGAANESEEPVAPQDEPHQPFLEFAEQILPQSVSRAAITAAWRRPETDAVSMLMEQARLSPPVAEQAHKLAYQLAEKLRNQKSASGRAGMVQGLLQEFSLSSQEGVALMCLAEALLRIPDKATRDALIRDKISNGNWQSHIGRSPSLFVNAATWGLLFTGRLVSTHNEANLSRSLNRIIGKSGEPLIRKGVDMAMRLMGEQFVTGETIAQALANARKLEEKGFRYSYDMLGEAALTAADAQAYMVSYQQAIHAIGKASNGRGIYEGPGISIKLSALHPRYSRAQYDRVMEELYPRLKSLTLLARQYDIGLNIDAEEADRLEISLDLLEKLCFEPELAGWNGIGFVIQAYQKRCPLVIDYLVDLASRSRRRLMIRLVKGAYWDSEIKRAQMEGLEGYPVYTRKVYTDVSYLACAKKLLAVPNLIYPQFATHNAHTLAAIYHLAGQNYYPGQYEFQCLHGMGEPLYEQVTGKVGDGKLNRPCRIYAPVGTHETLLAYLVRRLLENGANTSFVNRIADATLPLDELVADPVEAVEKLAQQEGQAGIPHPKIPLPRDLYGEGRINSAGLDLANEHRLASLSSALLSNAMQKWQAKPVLEQPVADGEMTPVINPAEPKDIVGWGREATESEVEQALQNAVNQAPVWFATPPQERAAILQRAAVLMEDQMQQLIGLLVREAGKTFSNAIAEVREAVDFLHYYAGQVRDDFDNETHRPLGPVVCISPWNFPLAIFTGQIAAALAAGNSVLAKPAEQTSLIAAQGIAILLEAGVPPGVVQLLPGRGETVGAQLTADARVRGVMFTGSTEVATLLQRNIATRLDAQGRPIPLIAETGGMNAMIVDSSALTEQVVVDVLASAFDSAGQRCSALRVLCLQDDIAEHTLKMLRGAMAECRMGNPGRLTTDIGPVIDSEAKANIERHIQTMRAKGRPVFQAARENSDDAQEWQTGTFVMPTLIELENFAELEKEVFGPVLHVVRYNRNQLAELIEQINASGYGLTLGVHTRIDETIAQVTGSAHVGNLYVNRNMVGAVVGVQPFGGEGLSGTGPKAGGPLYLYRLLAHRPPNALNTTLTRQDARYPVDAQLKTTLLAPLTALTQWAADRPALQTLCRQFADLAQAGTQRLLPGPTGERNTWTLLPRERVLCLADDEQDALTQLAAVLAVGSQALWSDDAFHRDLAKRLPAAVAARVQFAKAETLMAQPFDAVIFHGDSDKLRTVCEAVAAREGAIVSVQGFARGESNMLLERLYIERSLSVNTAAAGGNASLMTIG

SEQ ID NO: 19235 - protein, 352 aa, Salmonella enterica subsp. enterica serovar Typhi Ty2
MLELNFSQTLGTHCLTLNETLPASGITAIFGVSGAGKTSLINAISGLTRPRKGRIVLNGRVLHDAENGICLTPEKRRIGYVFQDARLFPHYKVRGNLRYGMAKSMTGQFDKLVSLLGIEALLDRLPGSLSGGEKQRVAIGRALLTAPELLLLDEPLASLDIPRKRELLPYLQRLAREINIPMLYVSHSLDEILHLADKVMVLEDGQVKAFGPLEEVWGSSVMHPWLPKEQQSSILKVSVLEHHPHYAMTALALGDQHLWVNKLNQPLQSTLRIRIQASDVSLVLQPPQQTSIRNVLRAKVANCYDDNGQVEVQLEIGGRTLWARISPWARDELNIKPGLWLYAQVKSVSITA

SEQ ID NO: 19236 - protein, 250 aa, Salmonella enterica subsp. enterica serovar Typhi Ty2
MAVTKLVLVRHGESQWNKENRFTGWYDVDLSEKGVSEAKAAGKLLKEEGFSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNDTILPRMKSGERVIIAAHGNSLRALVKYLDNMSEDEILELNIPTGVPLVYEFDENFKPIKHYYLGNADEIAAKAAAVANQGKAK

SEQ ID NO: 19237 - protein, 441 aa, Salmonella enterica subsp. enterica serovar Typhi Ty2
MTQYQALIIGFGKAGKTLAATLAKTGWRVAIIEQSASMFGGTCINIGCIPTKTLVYDAEREGDFSVAMQRKAAVVNFLRDKNFHNLADLDNVDVIEGRAEFIDNHTLRVFQADGERVLRGEKIFINTGAESVIPAITGLTTTAGVFDSTGLLSLSQRPARLGILGGGYIGLEFASMFANFGTKVTIFEAAPQFLPREDRDIAQAITHILQEKGVELILNANVQAVSSTEGAVQVETPEGAHLVDALLVASGRKPATAGLQLQNAGVAVNERGGIIVDDYLRTTADNIWAMGDVTGGLQFTYISLDDFRIVRDGLLGDGKRSTRDRQNVPYSVFMTPPLSRVGLTEEQARASGATVQVVTLPVAAIPRARVMNDTRGVLKAVVDVNTQRIVGVSLLCVDSHEMINIVKTVMDADLPYTVLRDQIFTHPTMSESLNDLFSLIK

SEQ ID NO: 19238 - protein, 164 aa, Salmonella enterica subsp. enterica serovar Typhi Ty2
MVTFHTNHGDIVIKTFDDKAPETVKNFLDYCREGFYNNTIFHRVINGFMIQGGGFEPGMKQKATKEAIKNEANNGLKNTRGTLAMARTQAPHSATAQFFINVADNDFLNFSGESLQGWGYCVFAEIVEGMDVVDKIKGVATGRSGMHQDVPKEDVIIENVTVSE

SEQ ID NO: 19239 - protein, 292 aa, Salmonella enterica subsp. enterica serovar Typhi Ty2
MKLGFIGLGIMGSPMAINLARAGHQLHVTTIGPVADELLSLGAVNVETARQVTEFADIIFIMVPDTPQVEEVLFGEHGCAKTSLQGKTIVDMSSISPIGTKRFAQRVNEMDADYLDAPVSGGEIGAREGTLSIMVGGEQKVFDRVKPLFDILGKNITLVGGNGDGQTCKVANQIIVALNIEAVSEALVFASKAGADPVRVRQALMGGFASSRILEVHGERMINRTFEPGFKIALHQKDLNLALQSAKALALNLPNTATCQELFNTCAANGGSQLDHSAMVQALELMANHKLS

SEQ ID NO: 19240 - protein, 351 aa, Salmonella enterica subsp. enterica serovar Typhi Ty2
MMSSNWVKNAINEINADHQRSADTHLIRLPLSAFPGIQLYLKDESTHPTGSLKHRLARSLFLYGLCNGWIKEDTPIIEASSGSTAISEAWFARLLGLPFIAAMPACTAKRKIEQIQFYGGHCHFVESACEIYAASERLAHELNGHYMDQFTYAERATDWRGNNNIADSIFRQMRNEPHPVPRFIVMSAGTGGTSATIGRYIRCQGYDTQLMVVDPENSVFLPYWQDRDASLRSPVGSKIEGIGRPRVEPSFIPDVVDEMLRVPDAASVATAHWLETQLGRKVGASTGTNMWGALQLAARMREAGETGAIVTLLCDSGDRYLDTYYHPAWVSDHIGDLTPWSAAIAKLLTGD

SEQ ID NO: 19241 - protein, 456 aa, Salmonella enterica subsp. enterica serovar Typhi Ty2
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKMFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKVFAKTSRRGIPWVTVLVMTIALLFAVYLNYIMPENVFLVIASLVTFATVWVWIMILLSQIAFRRRLPPEEVKALKFKVPGGVVTTIAGLIFLVFIIALIGYHPNTRISLYVGFAWIVLLLIGWIFKRRRDRQLAQA

SEQ ID NO: 19242 - protein, 417 aa, Salmonella enterica subsp. enterica serovar Typhi Ty2
MYTPLNWTTTQRHVAFASFTSWMLDAFDFFILVFVLSDLAEWFHASVSEVSIAIMLTLAVRPIGALLFGRMAEKYGRRPILMLNILFFTVFELLSAWSPTFMAFLIFRVMYGVAMGGIWGVASSLAMETIPDRSRGLMSGIFQAGYPCGYLFASVIFGLFYSMVGWRGMFLIGALPVVLLPYIWFKVPESPVWLAARARKENTALLPVLRKQWKLCLYLVLVMAFFNFFSHGTQDLYPTFLKMQHGFDPHLISIIAIFYNIAAMLGGIFYGTLSERIGRKKAIMIAAFLALPVLPLWAFSSGSFTIGLGAFLMQFMVQGAWGVVPTWLNELVPANARAVLPGFVYQLGNLLASVNATLQARIAETHGGNYGLAMAIVAGAVAILICVFVAFGRETRGVVISGTDSDALPESAIGHRT

SEQ ID NO: 19243 - protein, 386 aa, Salmonella enterica subsp. enterica serovar Typhi Ty2
MTSENPLLALRDKISALDEELLALLAKRRALAIEVGQAKLLSHRPVRDIDRERALLDRLIHLGKAHHLDAHYITRLFQLIIEDSVLTQQALLQQHLNNTHPHSARIAFLGPKGSYSHLAARQYAARHFEQFIESGCAKFTDIFHQVETGQADYAVVPIENTNSGAINDVYDLLQHTSLSIVGEMTVTIDHCVLVSGATDLNTIETVYSHPQPFQQCSKFLSRYPHWKIDYTESTSAAMEKVAQANSPRVAALGSEAGGMLHGLQVLERIAANQTQNITRFLVLARKAINVSDQVPAKTTLLIATGQQAGALVEALLVLRNHNLIMTKLESRPIHGNPWEEMFYLDIQANLESQVMQSALKELGEITRSMKVLGCYPSENVVPVEPA

SEQ ID NO: 19244 - protein, 482 aa, Salmonella enterica subsp. enterica serovar Typhi Ty2
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQTDKRLLVIKQPIGVTAAITPWNFPSAMITRKAGPALAAGCTMVLKPASQTPFSALALAELAQRAGILAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILADVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 19245 - protein, 427 aa, Salmonella enterica subsp. enterica serovar Typhi Ty2
MNTNNTLMQRCHNAVPRGVGQIHPIFAERAENCRVWDVEGREYLDFAGGIAVLNTGHLHPGIVSAVEAQLKKLSHTCFQVLAYEPYLALCERMNQKVPGDFAKKTLLVTTGSEAVENAVKIARAATKRSGAIAFSGAYHGRTHYTLSLTGKVHPYSAGMGLMPGHVYRALYPCPLHNISDDDAIASIERIFKNDAAPEDIAAIIIEPVQGEGGFYAASPAFMQRLRALCDQHGIMLIADEVQSGAGRTGTLFAMEQMGVAADITTFAKSIAGGFPLAGVTGRADVMDAIAPGGLGGTYAGNPIACVAALAVLDIFEQENLLQKANTLGKTLRDGLMEIAETHREIGDVRGLGAMIAIELFENGDPGKPNATLTADIVARAREKGLILLSCGPYYNILRILVPLTIEASQIRQGLEIIAQCFDEAKQA

SEQ ID NO: 19246 - protein, 477 aa, Salmonella enterica subsp. enterica serovar Typhi Ty2
MRKLTLPKDFLWGGAVAAHQVEGGWNKDGKGPSICDVLTSGAHGVPREITQNVVAGKYYPNHEAVDFYGHYKEDIRLFAEMGFKCFRTSIAWTRIFPNGDESQPNEAGLKFYDDMFDELLKYNIEPVITLSHFEMPLHLVQHYGGWTNRKVVDFFVRFAEVVFERYKHKVKYWMTFNEINNQRNWRAPLFGYCCSGVVYTEHENPEETMYQVLHHQFVASTLAVKAARRINPQMKVGCMLAMVALYPFSCKPEDVMFAQESMRERYVFTDVQLRGYYPSYVLNEWERRGFNIKMEDGDLEVLREGTCDYLGFSYYMTNAVKAEGGSGDAISGFEGSVPNPYVKASDWGWQIDPVGLRYSLCELYERYQKPLFIVENGFGAYDKVEEDGSINDDYRIDYLRAHIEEMKKAVTYDGVDLMGYTPWGCIDCVSFTTGQYSKRYGLIYVNKHDDGTGDMSRSRKKSFNWYKEVIASNGEKL

SEQ ID NO: 19247 - protein, 494 aa, Salmonella enterica subsp. enterica serovar Typhi Ty2
MSDVTLLAEVTTFLRQRHGQFIAGERQAGNGTNFSVTNPATGKIIADVVSTTPAQAKEAMQSARRAFDVWRKMPTLQRGALLLKLADTLAAHREELAQLESVCSGKTIMLSRGLELDQSVAFLRYFAGWAGKITGETLNVSLPSMGEERYTAFTQRQPIGVVVGIVPWNFSIMIAIWKLAAALVCGCTIVIKPSEYTPLTLLRVAELAKEAGFPDGVINVVNGAGGEIAQQLIAHPDCAKVSFTGSVATGEKVRRSATSSGKRVTLELGGKNAALFLNDLTAQAMVNGILEAGYLNQGQICAAAERFYLPQEKLDTVMTLLRQRLSEIVPGSPLDEKTVMGPLANQVQLEKVLRLIQRAREEGDTIVYGGETLPGEGYFLQPTAVKVRSKNSTLMHEETFGPVCSFIGYQNEKEALSHINDSPFGLAASVWSENISKALRYAEDIDAGMVWVNMHTFLDPAVPFGGMKGSGIGREFGSAFIDDYTELKSVMVRY

SEQ ID NO: 19248 - protein, 429 aa, Salmonella enterica subsp. enterica serovar Typhi Ty2
MKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDGFRQLAREYPNLVHEARGKGMLMAIEFVDNETGYRFASEMFRQRVLVAGTLNNAKTIRIEPPLTLTIELCEQVLKSARNALAAMQVSVEEV

SEQ ID NO: 19249 - protein, 294 aa, Salmonella enterica subsp. enterica serovar Typhi Ty2
MKVGFIGLGIMGKPMSKNLLKAGYSLVVSDRNPEAIADVIAAGAETASTAKAIAEQCDAIITMLPNSPHVKEVALGENGIIEGAKPGTVLIDMSSIAPLASREISDALKAKGVEMLDAPVSGGEPKAIDGTLSVMVGGDKAIFDKYYDLMKAMAGSVVHTGDIGAGNVTKLANQVIVALNIAAMSEALTLATKAGVNPDLVYQAIRGGLAGSTVLDAKAPMVMDRNFKPGFRIDLHIKDLANALDTSHGVGAQLPLTAAVMEMMQALRADGHGNDDHSALACYYEKLAKVEVTR

SEQ ID NO: 19250 - protein, 315 aa, Salmonella enterica subsp. enterica serovar Typhi Ty2
MNITIATLSELLVEFLAKKENQGFSSPGEFWGPYPSGAPAIFADQVAKLGFRSLLFSCVGNDAFGVMNITRLSRDGVNVQGISVLPNATTGSAFVSYRSQAQRDFIFNMPDSACGLLSADHLDETLLRQYRHFHIMGSSLFSFRLIDAVRKAISIVKENGGTISFDPNIRKEMLKIREMSQAFEYILDYTDFFLPSDGELDYFGLSKSRDEEKIVARLHKRGIAHVIIKRGARGASYYSKDEQHHVAGYPVKVVDPTGAGDCFGATFVSLFLAGYSVPDALAHANAAGSLAISARGPMEGTSTLAQIKELMRQQN

SEQ ID NO: 19251 - protein, 281 aa, Salmonella enterica subsp. enterica serovar Typhi Ty2
MSQTSTLKGQCIAEFLGTGLLIFFGVGCVAALKVAGATFGQWEISVIWGLGVAMAIYLTAGVSGAHLNPAVTIALWLFACFDKRKVVPFIISQVAGAFCAAALVYGLYYNLFVDFEQTHHIVRGSVESLDLAGIFSTYPNPHINFVQAFAVEMVITAILMGLILALTDDGNGVPRGPLAPLLIGLLIAVIGASMGPLTGFAMNPARDFGPKMFAGLAGWGEIAFTGGRDIPYFLVPLFGPIVGAILGAFAYRKFIGRHLPCDICVVEEKDSTAATQQNASL

SEQ ID NO: 19252 - protein, 255 aa, Salmonella enterica subsp. enterica serovar Typhi Ty2
MRHPLVMGNWKLNGSRHMVNELVANLRKELTGVAGCDVAIAPPEMYIDLAKRAAAGSHIMLGAQNVDLNLSGAFTGETSAEMLKDIGAQYIIIGHSERRTYHKESDELIAKKFAVLKEQGLTPVLCIGETEAENEAGKTEEVCARQIDTVLKTQGAAAFEGAVIAYEPVWAIGTGKSATPAQAQAVHKFIRDHIAKADAKIAEQVIIQYGGSVNASNAAELFAQPDIDGALVGGASLKADAFAVIVKAAEAAKQA

SEQ ID NO: 19253 - protein, 254 aa, Salmonella enterica subsp. enterica serovar Typhi Ty2
MNSQFAGLTREACVALLASYPLSVGILAGQWIALHRYLQQLEALNQPLLHLDLMDGQFCPQFTVGPWAVGQLPQTFIKDVHLMVADQWAAAQACVKAGAHCITLQAEGDIHLHHTLSWLGQQTVPVIDGEMPVIRGISLCPATPLDVIIPILSDVEVIQLLAVNPGYGSKMRSSDLYERVAQLLCLLGDKREGKIIVIDGSLTQDQLPSLIAQGIDRVVSGSALFRDDRLVENTRSWRAMFKVAGDTTFLPSTA

SEQ ID NO: 19254 - protein, 319 aa, Salmonella enterica subsp. enterica serovar Typhi Ty2
MKAMNKVWVIGDASVDLVPEKQNSYLKCPGGASANVGVCVARLGGECGFIGCLGDDDAGRFLRQVFQDNGVDVSSLRLDAALTSAVLIVNLTADGERSFTYLVHPGADTYVSPQDLPPFRQHEWFYFSSIGLTDSPAREACLEGARRMREAGGYVLFDVNLRSKMWRNTDEIPELIARSAALASICKVSADELCQLSGASHWQDARYYLRDLGCDTTIISLGADGALLITAEGEFHFPAPRVDVVDTTGAGDAFVGGLLFTLSRANCWDHALLAEAISNANACGAMAVTAKGAMTALPFPDQLNTFLSSHSLAQAMTVK

SEQ ID NO: 19255 - protein, 1016 aa, Salmonella enterica subsp. enterica serovar Typhi Ty2; identical to SEQ ID NO: 17594
  misc_feature (196)..(196): Xaa can be any naturally occurring amino acid

SEQ ID NO: 19256 - protein, 309 aa, Salmonella enterica subsp. enterica serovar Typhi Ty2
MALESGIAQLVEEFIAAGRPSSREQNIDDRRAGYIASTTLAGETETRVQVEDIELDAMTFRVVSPLNATGKLPCIIYYHGGCFVSGGFATHDNQLRQLAFYSRCRVIAAQYRLAPEHTFPAAHNDAETGANTIWKYAQKLGIDRENITLAGDSAGGHLALVTALRLKAARQWQPAQLILIYPMLDATARFASYTCNGLDYIITRDTLLSGYEMYMPRTDPLHPEASPLWREDFAGLPSTHIITAEFDPLRDEGEALYQRFQEQGVECTCQRYLGVIHGFFQLGGVSKTARDAIRDVAWRVVSPSTSKMT

SEQ ID NO: 19257 - protein, 298 aa, Salmonella enterica subsp. enterica serovar Typhi Ty2
MVRIACVGITVMDRIYYVEGLPTEGGKYVAKRYTEVGGGPAATAAVAAAKLGAQVDFIGRVGDDDTGNSLLAELESLGVNTRYTRRYTQAMSSQSAIMVDAKGERIIVNYPSPDLLPDADWLNDIDFSQWDVVLADVRWHDGAKQAFTLARQAGVMTVLDGDITPQDISELVALSDHAAFSEPGLARLTGMSEAIDALKKAQMLTNGHVYVTRGSEGCNWLEKAAVRHQPGFTVEVVDTTGAGDVFHGALAFGLASGYAIEEAVRFASGVAALKCTRPGGRAGIPDCEQTRSFLSLFV

SEQ ID NO: 19258 - protein, 298 aa, Salmonella enterica subsp. enterica serovar Typhi Ty2
MAVIAFIGLGQMGSPMASNLLKQGHQLSVFDINPDAVQRLVDKGAQPASSPAQTTIGAEFVITMLPNGDLVRSVLFGEQGVCETLSREALVIDMSTIHPLQTDKLIADMQSKGFSMMDVPVGRTSDNAITGTLLLLAGGTTEQVERATPVLMAMGNELVNTGGPGMGIRVKLINNYMSIALNALSAEAAVLCEALGLSFDVALKVMSGTAAGKGHFTTTWPNKVMKGDLSPAFMIDLAHKDLGIALDVANQLHVPMPLGAASREVYNLARAAGRGREDWSAILEQVRISAGLTANVKK

SEQ ID NO: 19259 - protein, 487 aa, Salmonella enterica subsp. enterica serovar Typhi Ty2
MRGRNRCRTNKLSEKNYHTTAPGVAFWYRITANFPSFLRKLIMSQQHTTQASGQGMLERVFKLREHGTTARTEVIAGFTTFLTMVYIVFVNPQILGVAGMDTSAVFVTTCLIAAFGSILMGLFANLPVALAPAMGLNAFFAFVVVQAMGLPWQVGMGAIFWGAVGLLLLTIFRVRYWMIANIPVSLRVGITSGIGLFIGMMGLKNAGVIVANPETLVSIGNLTSHSVLLGVLGFFIIAILASRNIHAAVLVSIIVTTLLGWIMGDVHYNGIVSAPPSVTSVVGHVDLAGSFNLGLAGVIFSFMLVNLFDSSGTLIGVTDKAGLADEKGKFPRMKQALFVDSISSVTGAFVGTSSVTAYIESSSGVSVGGRTGLTAVVVGILFLLVIFLSPLAGMVPPYAAAGALIYVGVLMTSSLARVNWQDLTESVPAFITAVMMPFSFSITEGIALGFISYCVMKIGTGRLRDLSPCVVIVALLFVLKIVFIDAH

SEQ ID NO: 19260 - protein, 442 aa, Salmonella enterica subsp. enterica serovar Typhi Ty2
MLSFLKAPANAPLITDKHEVDARYRYWRRYILITIWLGYALFYFTRKSFNAAAPEILASGILTRSDIGLLATLFYITYGVSKFVSGIVSDRSNARYFMGIGLIATGVVNILFGFSTSLWAFALLWALNAFFQGFGSPVCARLLTAWYSRTERGGWWALWNTAHNVGGALIPLVMAAVALHYGWRVGMMVAGLLAIGVGMVLCWRLRDRPQAIGLPPVGDWRHDALEVAQQQEGAGLSRKEILAKYVLSNPYIWLLSLCYVLVYVVRAAINDWGNLYMSETLGVDLVTANTAVSMFELGGFIGALVAGWGSDKLFNGNRGPMNLIFAAGILLSVGSLWLMPFASYVMQAACFFTTGFFVFGPQMLIGMAAAECSHKEAAGAATGFVGLFAYLGASLSGWPLAKVLEIWHWTGFFAVIAIAAGISALLLLPFLNAQAPRETHEA

SEQ ID NO: 19261 - protein, 463 aa, Salmonella enterica subsp. enterica serovar Typhi Ty2
MLAFLNQVRKPTLDLPLNVRRKMWFKSFMQSYLVVFIGYLTMYLIRKNFNIAQNDMISTYRLSMTELGMIGLGFSITYGVGKTLVSYYADGKNTKQFLPFMLILSAICMLGFSASMGAGSTSLFLMIAFYALSGFFQSTGGSCSYSTITKWTPRRKRGTFLGFWNISHNLGGAGAAGVALFGANYLFDGHVIGMFIFPSIIALIVGFIGLRFGSDSPESYGLGKAEELFGEEISEEDKETEENEMTKWQIFVEYVLKNKVIWLLCFSNIFLYVVRIGIDQWSTVYAFQELKLSKEVAIQGFTLFEVGALVGTLLWGWLSDLANGRRALVACVALALIIATLGVYQHASNQYVYLASLFALGFLVFGPQLLIGVAAVGFVPKKAIGAADGIKGTFDYLIGDSFAKLGLGMIADGTPVFGLTGWAGTFAALDAAAIGCICLMAMVAVMEERKIRREKKIQQVNIA

SEQ ID NO: 19262 - protein, 460 aa, Salmonella enterica subsp. enterica serovar Typhi Ty2
MRYRFPDNFWWGSACSALQTEGDSLNGGKSQTTWDVWFERQPDRFHQGIGPAETSTFYRHWKQDIALLKQLKHNSFRTSLSWARLIPDGVGEVNPQAVSFYNHVIDELLAQGITPFITLFHFDMPMVMQEKGGWENRDVVEAFGRYAQTCFTLFGDRVKHWFTFNEPIVPVEGGYLYDFHYPNVVDFKRAATVAYHTVLAHSTAVRAWRAGRYDGEIGVVLNLTPSYPRSQHPADVQAAHHADLLFNRSFLDPVLKGEYPAELVALLKTYDQLPACQPGDRQLIADGKIDLLGINYYQPRRVKCRDTAVNPQAPFMPEWLFDYYDMPGRKMNPYRGWEIYAPGIYDIITNLRDNYGNPRCFISENGMGVENEQRFVQAGQIHDDYRIDFISEHLKWLHKGISEGCHCLGYHMWTFIDNWSWLNGYKNRYGFVQLDLATQTRTVKKSGEWFAATAEHNGFD

SEQ ID NO: 19263 - protein, 507 aa, Salmonella enterica subsp. enterica serovar Typhi Ty2
MVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTAVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQEHTAHTNLPVPLIYVGEKNVKAVEGGKLSDIAPTMLSLMGMEIPQEMTGKPLFIVE

SEQ ID NO: 19264 - protein, 512 aa, Salmonella enterica subsp. enterica serovar Typhi Ty2
MTNNPPSTRIQPSEYGYPLKLKARYDNFIGGDWVAPADGEYYQNLTPVTGQPLCEVASSGKKDIDLALDAAHKAKDKWAHTSVQDRAAILFKIADRMEQNLELLATAETWDNGKPIRETSAADIPLAIDHFRYFASCIRAQEGGISEVDSETVAYHFHEPLGVVGQIIPWNFPLLMASWKMAPALAAGNCVVLKPARLTPLSVLLLMEVIGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSGTQMGAQVSHGQLETILNYIDIGKKEGADILTGGRRKELDGELKEGYYLEPTILFGKNNMRVFQEEIFGPVLAVTTFKTMEKALEIANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 19265 - protein, 309 aa, Salmonella enterica subsp. enterica serovar Typhi Ty2
MSKKIAVIGECMIELSQKGADVQRGFGGDTLNTSVYIARQVDSAALAVHYVTALGTDSFSQQMLEAWQHENVDTSLTQRMENRLPGLYYIETDDTGERTFYYWRNEAAAKFWLESEQSAAICETLATFDYLYLSGISLAILSPTSRDKLLSLLRECRANGGKVIFDNNYRPRLWTSREETQQVYQKMLECTDIAFLTLDDEDALWGKQPVEEVIARTHAAGVQEVVVKRGADSCLVSIQGEALIDVPAVKLPKEKVIDTTAAGDSFSAGYLAVRLTGGSATDAAKRGHLTASTVIQYRGAIIPHDAMPQ

SEQ ID NO: 19266 - protein, 405 aa, Salmonella enterica subsp. enterica serovar Typhi Ty2
MATEQTAITRATFDEVILPVYAPADFIPVKGKGSRVWDQQGKEYIDFAGGIAVTALGHCHPALVEALKSQGETLWHTSNVFTNEPALCLGRKLIDATFAERVLFMNSGTEANETAFKLARHYACVRHSPFKTKIIAFQNAFHGRSLFTVSVGGQPKYSDGFGPKPADIIHVPFNDLHAVKAVMDDHTCAVVVEPIQGEGGVQAATPEFLKGLRDLCDKHQALLVFDEVQCGMGRTGDLFAYMHYGVTPDILTSAKALGGGFPVSAMLTTQEIASAFHVGSHGSTYGGNPLACAVAGAAFDIINTPEVLQGIHTKRQQFVQHLQAIDEQFDIFSDIRGMGLLIGAELKPKYKGRARDFLYAGAEAGVMVLNAGADVMRFAPSLVVEEADINEGMQRFAQAVGKVVA

SEQ ID NO: 19267 - protein, 272 aa, Salmonella enterica subsp. enterica serovar Typhi Ty2
MKSLFKATLLATTMAVAMHVPITFAADAAKPAATADSKAAFKNDDQKAAYALGASLGRYMENSLKEQEKLGIKLDKDQLIAGVQDAFADKSKLSDQEIEQTLQTFEARVKSAAQAKMEKDAADNEAKGKTFRDAFAKEKGVKTSSTGLLYKVEKEGTGEAPKDSDTVVVNYKGTLIDGKEFDNSYTRGEPLSFRLDGVIPGWTEGLKNIKKSGKIKLVIPPALAYGKTGVPGIPANSTLVFDVELLDIKPAPKADAKPADAADAKAADAAKK

SEQ ID NO: 19268 - protein, 327 aa, Salmonella enterica subsp. enterica serovar Typhi Ty2
MATRIEFHKHGGPEVLQTVEFTPTEPAEHEIQVENKAIGINFIDTYIRSGLYPPPSLPAGLGTEAAGVVSKVGSGVEHIRVGDRVVYAQSTLGAYSSVHNVPADKAAILPDAISFEQAAASFLKGLTVFYLLRKTYEVKPDEPFLFHAAAGGVGLIACQWAKALGAKLIGTVGSAQKAQRALDAGAWQVINYREESIVERVKEITGGKKVRVVYDSVGKDTWEASLDCLQRRGLMVSFGNASGPVTGVNLGILNQKGSLYATRPSLQGYITTREELTEASNELFSLIASGVIKVDVAENQRYALKDARRAHEVLESRATQGSSLLIP

SEQ ID NO: 19269 - protein, 449 aa, Salmonella enterica subsp. enterica serovar Typhi Ty2
MSTPSARTGGSLDAWFKISQRGSTVRQEVVAGLTTFLAMVYSVIVVPGMLGKAGFPPAAVFVATCLVAGVGSIVMGLWANLPLAIGCAISLTAFTAFSLVLGQHISVPVALGAVFLMGVLFTIISATGIRSWILRNLPQGVAHGTGIGIGLFLLLIAANGVGLVIKNPLDGLPVALGDFDTFPVIMSLVGLAVILGLEKLKVPGGILLTIIGISIVGLLFDPNVHFSGIFAMPSLSDENGNSLIGSLDIMGALNPVVLPSVLALVMTAVFDATGTIRAVAGQANLLDRDGQIIDGGKALTTDSLSSVFSGLVGAAPAAVYIESAAGTAAGGKTGLTAITVGVLFLLILFLSPLSYLVPVYATAPALMYVGLLMLSNVAKIDFADFVDAMAGLVTAVFIVLTCNIVTGIMIGFATLVVGRLVSGEWRKLNIGTVVIAVALVAFYAGGWAI

SEQ ID NO: 19270 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 19271 - protein, 497 aa, Escherichia coli
LEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPARPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 19272 - protein, 441 aa, Neurospora crassa
MASSTSSNVVGVHYRVGKKIGEGSFGVIFEGTNLLNNQQVAIKFEPRKSDAPQLRDEYRTYKILVGCPGIPNVYYFGQEGLHNILVIDLLGPSLEDLFDHCNRRFSLKTVVMVAKQMLSRVQTIHEKNLIYRDIKPDNFLIGRQGTKTANVIHVVDFGMAKQYRDPKTKQHIPYRERKSLSGTARYMSINTHLGREQSRRDDLEALGHVFMYFLRGGLPWQGLKAATNKQKYEKIGEKKQTTAIKDLCEGFPEQFAQYLTYVRNLGFEDQPDYDYLRELFSQALKDAGGVEDGEYDWMKVNKSDKKGDWDRPGALHNPNARPGPSAMEIHNSRGPTTHHASDPRAQLTAARLNAPQPSPPAQPGQRAKEQPNANAQNNRAYKSQPTPTQSAGNGAQPYNMQQPPQRTMTHTATSNTNPPPSNQPQQQQGGIKGIWKALCCS

SEQ ID NO: 19273 - protein, 353 aa, Oryza sativa (indica cultivar-group)
ESLVRAGELSWEVGMERYEVIKDIGSGNFGVAKLVRDVRTKELFAVKFIERGQKIDENVQREIMNHRSLRHPNIVRFKEVVLTPTHLAIVMEYAAGGELFERICSAGRFSEDEARFFFQQLISGVSYCHSMQICHRDLKLENTLLDGSIAPRLKICDFGYSKSSLLHSQPKSTVGTPAYIAPEVLARKEYDGKVADVWSCGVTLYVMLVGAYPFEDPDEPRNFRKTITRILSVQYMVPDYVRVSMECRHLLSRIFVANPEQRITIPEIKNHPWFLKNLPIEMTDEYQMSVQMNDINTPSQGLEEIMAIIQEARKPGDGSKFSGQIPGLGSMELDDVDTDDIDVEDSGDFVCAL

SEQ ID NO: 19274 - protein, 362 aa, Bacillus coagulans
DPEGNSYMDMLSAYSAVNQGHRHPKIIEALKNQADKVTLTSRAFHNELLGPWTKRMAKLTKKDKVLPMNTGVEAVETAIKAARRWAYQVKGVTENQAEIIAADGNFHGRTLNAISLSNDPDATKNYGPFVPGINKVSYGDINAIEKAITENTAAIILEPIQGEAGIIIPPEGYLKKVRELCSERNILFIADEVQTGFARTGKMFACEWENVEPDIYVMGKALGGGVFPISAIAANNEIMDVFTPGSHGSTFGGNPLACAVSMAAIDVIEEENLVNKSLESGKYFADKLRAINFEGIKEVRARGLFIGMEFHQPVRAICEKLKDKGILCKETHVNTIRFAPPLLITKNEMDWAIQRIEEVLTN

SEQ ID NO: 19275 - protein, 448 aa, Brevibacillus agri
MSVPNDLQKNFSEVVSALKPKEAIDEANRCLYCYDAPCIKACPTSIDIPSFIRKIATGNLLGSARTIMESNPVGASCARVCPTEELCEGACVLNHASKPIMIGLLQRHATDWAIRNNAALFQKGDPNGKRVAIIGAGPAGLSAARELARLGYEVTIYEAKERAGGLNTYGIVSFRLPQEISLWEVEQVEALGVTIKTNTRIGVDIMPDELVANYDSVLLAVGMSSVPSLHIPGEELEGVLDAIALVEDTKTKPLTTDMVGKKVVVIGAGNTAIDAATCSKRLGADNVQILYRRTVQEMSCYQFEYEFAKQDGVEFRWLVAPTRVLGNKGRVTGLELIRMELGEPDAKGRKRPVPIPGSEFFIEVDFVVKAIGQNRHLSLIDQLGLQHQNGIVTVEDGTYRTSHPKVFAAGDVIFGGGKTDAMVVDAANHGKRAAYAIDKAIRDQKQLV

SEQ ID NO: 19276 - protein, 422 aa, Streptococcus thermophilus
MTVTIENIHAREIFDSRGNPTVEVDVRLTDGTLGRAAVPSGASTGDREAVELRDGGARLQGKGVSKAVANVNGEIYEALKGQSPFNQAKLDHLMIELDGTENKSCLGANAILGVSMAIFRAAANSEKIPLYRYFGGVDLELPQPFFNVINGGVHADSGIDVQEFLITPVKRDSFRDGLKKIANIYHTLKKILSDKGLKTPVGDEGGFAPKLGTTENAIAILYQPIDSAGYFPGEKIAIAIDSSSIEFYDDKKKFYRFEGKNLTSKELLTYYDNLVEKYPALISIEDGFSEHDWEGFAAQTKARGQKIQLVGDDIFVTNPTIFKEGIKKNVANAILIKLNQIGTVTETIETISLARKAGYKTMISHRSGETVDSYIADFSVAMHAGQIKSGSMARSERVEKYNQLLRIEEDLGKDVALAQFPG

SEQ ID NO: 19277 - protein, 298 aa, Rhizobium tropici
MKEAYAAISREKAKPLVLECIGIDQPRPDEILVRIVASGVCHTDMVVRDQGYDVPQPVVLGHEGSGVVEVVGADVKGLSPGDHVALSYAYCGKCEKCRGGTPYYCEDFFGRNFRGTRPDGSCPLHDSHGTQISGCFFEQSSFATYAIASERNAVKVSKDVPLELMGPLGCGLQTGAGAVLNCLKPQPGSSIAVFGAGAVGMAAVMAAKIAGCSTIIVIDLNDERLELAIELGATHIINARNGDSVKAIREIIPEGADFSLECTSSPKVFRQAVDCLGTPGTCGLVGSSALGTEGIVDI

SEQ ID NO: 19278 - protein, 168 aa, Nicotiana tabacum
MPRSRINGNFIDKTFSIVANILLRVIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAIQQGDSEIAEAWFDQAAEYWKQAIALTPGNYIEAHNWLKITRRFE

SEQ ID NO: 19279 - protein, 217 aa, Streptomyces coelicolor A3(2)
MRIVLVGPPGAGKGTQATRLAETLHIPHISTGDLFRANISQQTELGKLAKSYMNAGNLVPDEVTIAMAKDRMEQPDAEGGFLLDGFPRNVSQAEALDELLETEGMKLDAVLDLEAPEDEVVKRIAGRRVCRNEPKHVFHVTYTPPKKEGVCDVCGGELYQRDDDSEETVRKRLEVYHTQTEPIIDYYKSQGLVATIAATGPVDEVTRRALEAPSANQ

SEQ ID NO: 19280 - protein, 478 aa, Klebsiella pneumoniae
MTAPVQHPMYIDGQFVSGRGDGWIDVLNPATEALLSRIPDGTAEEARLAIDAAERAQPGWEALPAIERAGWLRKIAAGIRQRADEIAGLIVAEGGKIQQLAAVEVAFTADYLDYMAEWARRYEGEIVQSDRPGENILVFKRALGVTTGILPWNFPFFLIARKLAPALITGNTIVIKPSEFTPNNAIAFAEIVHQVGLPKGVFNLVLGRGETVGQELAGNPKVAMVSMTGSVAAGEKIMAAAAKNITKVCLELGGKAPAIVMDDADLELAVKAVVDSRVINTGQVCNCVERVYVQQGIYDRFVNRLGEAMKAVQFGDPATRDDIAMGPLINAAARDQVAGKVRSGGAGGAGGAGGQPLEGKGYFYPPTLLLDVRQEMDIIHEETFGPVLPVVAFSTLDEALATANDSDYGLTSSIYTRDLNVAMKAIKGLKFGETYINRENFEAMQGFHAGWRKSGIGGADGRHGLNEYLQTQVVYLQA

SEQ ID NO: 19281 - protein, 465 aa, Symplocos paniculata
VGFKAGVKDYKLTYYTPDYETKDTDILAAFRVTPQPGVPPEEAGAAVAAESSTGTWTTVWTDGLTSLDRYKGRCYGIEPVAGEENQFIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNAIIREASKWSPELAAACEIWKEIKFEFPAMDTL

SEQ ID NO: 19282 - protein, 466 aa, Degeneria vitiensis
VGFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYVKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEIWKEIKFEFQAMDTLD

SEQ ID NO: 19283 - protein, 178 aa, Mucor circinelloides
DGAGAGGTISGIAQKLKEKCPNIKIVGVDPVGSILAQPESLNTEAGSYQVEGIGYDFIPDVLKRNLIDVWMKSEDKPSFLMSRRLIREEGILCGGSSGTAMHAAVQAAKELKEGQRCVVILPDSVRNYMTKFLNDDWMRERGFTDEKFENESFENKAKKDYAGATVRDLKFWPLSPSM

SEQ ID NO: 19284 - protein, 504 aa, Physcomitrella patens
MSDPYGRRLLVDDFHVGPVLGTGGFSVVRAGVRKQDNLQVAIKTLKKFGYGRGDHGRPGAQMSQAEALVKNEIMVMMRIVDEVSPHPNVIHLIDVYEDDGAVHLVLELCRGGELFDRIVQHERYSERDAAKVVRQIASGLAALHQAQIVHRDLKPENCLYVNPLAEAPLKIMDFGLSYIHHNTNSIVGIFGSIDYMAPEQLSLSGIMPANDMWSLGVILYILLCGYPPFRARSSRDKQMQILTGSYSMEEESWRGISHEAKQLIRRLLSVDPFARPTARELLSHPWVSGDIANRDLLHKDVFMRLQHFNARRKFRATAYASIVRTKFLLRTRYLKELLGDRVLTDSELEALRVNFMRISSNGQTATLKEFEEVLRSINLHCFVPLAPRIFELFDYNHDGGIDLREVVCGFSLLRTSHLDDALQMCFKIYDRDDSGYISKGELARVLGALPEDYLPADISQVQMDDIFEHVDTDSDGRISYQEFRRALSLQDAVMNHFRMEGQVQ

SEQ ID NO: 19285 - protein, 337 aa, Thermus thermophilus HB27
MKTYALVMAGGRGERLWPLSREDRPKPFLPLFEGKTLLEATLERLAPLVPPERTLLAVRRDQEAVARPYAHGIRLLLEPLGRDTAGAVLLGVAEALKEGAERLLVLPADHYVGDDEAYREALATMLEAAEEGFVVALGLRPTRPETEYGYIRLGPREGAWYRGEGFVEKLSYTKALEYIRKGYVWNGGVFAFAPATMAELFRRHLPSHHEALERLLAGASLEEVYADLPKISIDYGVMEKAEKVRVVLGRFPWDDVGNWRALERVFSQDPHENVVLGEGRHVALDTFGCVVYADRGVVATLGVSGLVVAKVGDEVLVVPKDRAREVREVVKRLEAQE

SEQ ID NO: 19286 - protein, 386 aa, Glycine max
MAKPVSIEVWNPSGKYRVVSTKPMPGTRWINLLVQNDVRLEICTEKKTILSVEDIIALIGDKCDGVIGQLTEDWGEQLFSTLSKAGGKAFSNMAVGYNNVDVDAANKYGVAVGNTPGVLTETTAELAASLSLAAARRIVEADEFMRAGLYDGWLPHLFVGNLLKGQTVGVIGAGRIGSAYARMMVEGFKMNLIYYDLYQSTRLEKFITAYATFLKASGETPVTWKRAATMDEVLQEADIISLHPVLDKTTYHLVNKERLAKMKKEAILINCSRGPVIDEAALVEHLKQNPMFRVGLDVFEEEPYMKPGLAELKNAIVVPHIASASKWTREGMATLAALNVLGKIKGYPVWFDANRVEPFLNENAQPPAASPSIVNAKALGLPTSKL

SEQ ID NO: 19287 - protein, 452 aa, Arabidopsis thaliana
MNRPKVQRRVGKYEVGKTLGQGTFAKVRCAVNTETGERVALKILDKEKVLKHKMAEQIRREICTMKLINHPNVVRLYEVLASKTKIYIVLEFGTGGELFDKIVHDGRLKEENARKYFQQLINAVDYCHSRGVYHRDLKPENLLLDAQGNLKVSDFGLSALSRQVRGDGLLHTACGTPNYAAPEVLNDQGYDGATADLWSCGVILFVLLAGYLPFEDSNLMTLYKKIIAGEYHCPPWLSPGAKNLIVRILDPNPMTRITIPEVLGDAWFKKNYKPAVFEEKEEANLDDVDAVFKDSEEHHVTEKKEEQPTSMNAFELISMSRALDLGNLFEEEESIPFNLQGFKRETRFAAKGAANDLVQKIEEASKPLGFDIQKKNYKRYLCTQMRLENVTAGRKGNLRVATEIFQVSPSLHMIEVRKTKGDTLEFHKFYKKLSTSLNDVVWKSGESSGLSK

SEQ ID NO: 19288 - protein, 219 aa, Lactobacillus collinoides
MKIDQIFSPYQLNKRVTLRNRLVLAPLNIQSSLFDGSVSLNNLNFHKARAKYVGLDIIGSAYISDSANTAYGAISVADDSKIDGLKKLATVIHQGGSKAILQLVHAGRMTNSYASKGAPVLTPSEVKAAHGDVDLPKAMTKTDIETVIKQFETATIRAIKAGFDGVELHGANTFLFQQFMSPLSNLRTDEYGGSLENRIRFCAETAKRVLDTAHAHKPG

SEQ ID NO: 19289 - protein, 473 aa, Cucumis sativus
PQTETKASVGFKAGVKDYKLTYYTPEYETKDTDILAAFRVTPQPGVPPEEAGAAVAAESSTGTWTTVWTDGLTSLDRYKGRCYGIEPVAGEENQYIAYVAYPLDLFEEGSVTNMVTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAIFARELGAPIVMHDYLTGGFTANTSLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 19290 - protein, 133 aa, Bacteroides thetaiotaomicron VPI-5482
MGRKQEYKETNLEFLKELSSQEGVYALPCGIYYKVLETGTGTVFPNVRSIVTVHYKGSLINGRVFDNSYERNCPEAFRLCDVIDGWQLALQRMRAGDKWIIYIPYTMGYGTRASGPIPAFSTLVFEVELLGVA

SEQ ID NO: 19291 - protein, 448 aa, Bacteroides thetaiotaomicron VPI-5482
MLKHLINFYKVSSPGPCNGDVMSSSGKRRLKYLQWSTFLSATFGYGMYYVCRLSLNVVKKPIVDEGIFSETELGIIGSVLFFTYAVGKFTNGFLADRSNINRFMTTGLLVTALINLCLGFSHSFILFAVLWGVSGWFQSMGAASCVVGLSRWFTDKERGSYYGFWSASHNIGEALTFIIVASIVSVCGWRYGFFGAGMVGLLGALIVWRFFHDSPESKGFPPVNVPKEKKTMSASETTDFNKAQRQVLTMPAIWILALSSAFMYISRYAVNSWGVFYLEAQKGYSTLDASFIISISSVCGIIGTMFSGVISDKLFGGRRNVPALIFGLTNVLALCLFLLVPGVHFWLDAVAMILFGLGIGVLICFLGGLMAVDIAPRNASGAALGVVGIASYIGAGLQDVMSGVLIEGHKTIRSGVEVYDFTYINWFWIGSAILSVFFALWVWNAKQK

SEQ ID NO: 19292 - protein, 447 aa, Bacteroides thetaiotaomicron VPI-5482
MNFDIAIIGGGPAGYTAAERAGANGLRAVLFEKKAIGGVCLNEGCIPTKTLLYSAKILDSIKSASKYGISAESPSFDLTKIMSRKEKTVKMLTGGVKMTVNSYGVTIVEKEAFIEGEENGLIRIICDGERYEVKYLLVCTGSDTVIPPIPGLSEVSYWTSKEALEIKELPETLVVIGGGVIGMEFASFFNSMGVKVHVVEMMPEILGVMDKETSSMLRMEYAKRGVTFYLNTKVIEVKPDGVVIEKDGKASTIKTEKILLSVGRKANITNVGLDKLNIELHRNGVKVDEYLQTSHPGVYACGDITGYSLLAHTAIREAEVAINHILGVEDRMNYNSVPGVVYTNPEVAGVGKTEEELTKQGIPYRVTKLPMAYSGRFVAENEQVNGICKLILDEADHIIGCHMLGNPASELIVIAGIAIQKGYTVEEFQKNVFPHPTVGEIYHEVLS

SEQ ID NO: 19293 - protein, 468 aa, Bacteroides thetaiotaomicron VPI-5482
MKSTINFGYLIFLSVVAALGGFLFGYDTAVISGTIAQVTQLFQLDTLQQGWYVGCALIGSIVGVLFAGILSDKLGRKMTMIISATLFSTSALGCAISADFTQLVVYRIIGGVGIGVVSIVSPLYISEVAVAQYRGRLVSLYQLAVTVGFLGAYLINYQLLAYAESGNQLSMDWLNKIFVTEVWRGMLGMETLPAVLFFIIIFFIPESPRWLIVRGKEEKAVNILERIYNSVSEAASQLKETKSVLTSETKSEWAMLMKPGIFKAVIIGVCIAILGQFMGVNAVLYYGPSIFENAGLSGGDSLFYQVLVGLVNTLTTVLALVIIDRVGRKQLVYYGVSGMVVSLLLIGVYFLFGDSWGVSSLFLLVFFLFYVFCCAVSICAVVFVLLSEMYPTKVRGLAMSIAGFALWIGTYLIGQLTPWMLQNLTPAGTFFLFAVMCVPYMLIVWKLVPETTGKSLEEIERYWTRSEQ

SEQ ID NO: 19294 - protein, 256 aa, Bacteroides thetaiotaomicron VPI-5482
MNRINQLFNSNKKDILSIYFCAGNPTLDGTVNVIRTLEKHGVSMIEVGIPFSDPMADGIVIQNAATQALRNGMSLKILFEQLRNIRQEVSIPLVFMGYLNPIMQFGFENFCRKCVECGIDGVIIPDLPFRDYQDHYRIIAERYGIKVIMLITPETSEERVREIDAHTDGFIYMVSSAATTGAQQDFNEQKRAYFKKIEDMNLRNPLMVGFGISNKATFQAACEHASGAIIGSRFVTLLEEEKDPEKAILKLKDALK

SEQ ID NO: 19295 - protein, 485 aa, Bacteroides thetaiotaomicron VPI-5482
MDKTYKRHSFTKLWIATAMFIFCCFATSAFAQEAVDADTFMTTTETITEVKTTPEIAETATASAETTPDTIGELALGLNTVWMLLAAMLVFFMQPGFALVEAGFTRVKNTANILMKNFVDFMFGSLLYWFIGFGLMFGAGGLIGMPHFFDLSFLDSDLPREGFLVFQTVFCATAATIVSGAMAERTKFSMYLVYTIFISVLIYPISGHWTWGGGWLMNGEEGSFMMNLFGTTFHDFAGSTIVHSVGGWIALVGAAILGPRIGKYGKDGKSRAIPGHNLTVAALGVFILWFGWFGFNPGSQLAASTEADAMAISHVFLTTNLAACAGGFFALAMSWMKYGKPSLSLTLNGVLAGLVGITAGCDAVAPSGAVLIGAICGVVMIFAVDFIDKVLKIDDPVGASSVHGVCGFLGTVLTGLFSTSEGLFYGHGAGFLGAQLFGAVVVGVWAAGMGFIIFKVLDKIHGLRVPARVEEEGLDIYEHGESAYN

SEQ ID NO: 19296 - protein, 446 aa, Bacteroides thetaiotaomicron VPI-5482
MGDPKAFLNIPRQEAGYRPVSERITDYSQVEQTLNTNSRKLQASRCMDCGVPFCHWACPIGNKQPEWQDALFKGKWKEAYEVLSSTCDFPEFTGRICPALCEKSCVLKLSCDQPVTIRENEAAIVEAAFREGYIQVQHPQRNGKKVAVVGAGPAGLVVANQLNLKGYTVTLFDKDEAAGGLLRFGIPNFKLDKNVIDRRMKILAAEGIQFEMGVEIDVNHLPEGFDAYCICTGTPTARDLSIPGRELKGIHFALEMLAQQNRILEGQTFPKDKLVNAKGKKVLVIGGGDTGSDCIGTSVRQGATSVTQIEIMPKPPVGHNPSTPWPQWPVVFKTTSSHEEGCTRRWCLTSNQFLGKNGKVTGVEVEEVEWTPATDGGRPTMNLTGKKEVIEADMVLLAMGFLKPEQPKFAENVFLAGDAATGASLVVRAMAGGRKAAADIDHYLVK

SEQ ID NO: 19297 - protein, 350 aa, Bacteroides thetaiotaomicron VPI-5482
MSMDNHIVIMAGGIGSRFWPMSTPECPKQFIDVMGCGRTLIQLTADRFDGVCPRENVWVVTSEKYIDIVREQLPEIPESNILAEPCARNTAPCIAYACWKIKKKHPNANVVVTPSDALVINTGEFRRVVEKALRFTDNSSAIVTLGIKPTRPETGYGYIAAGDQIMTDKEIFTVDAFKEKPDRETADRYLAEGNYFWNAGIFVWNVRTITSVMRVYAPGIAQIFDRIFPDFYTEKENETIKKLFPTCEAISIDYAVMEKAQEIYVLPASFGWSDLGTWGALRGLLPQDKSGNATVGADVRLYESKNCIVHTSEEKRVVIQGLDGYIIAEKDNTLLICKLDEEQRIKEFSK

SEQ ID NO: 19298 - protein, 443 aa, Bacteroides thetaiotaomicron VPI-5482
MKTKYTYKQIWTIAYPILISLIMEQLIGMTDTAFLGRVGEIELGASAIAGVYYLAIFMMAFGFSVGAQILIARRNGEGNYKEIGPIFYQGIYFLVVVAAILFTLSIVFSPFILKNIISSPHIYDAAESYIHWRVYGFFFSFVGVMFRAFFVGTTQTKTLTLNSIVMVLSNVVFNYILIFGKFGFPQLGIAGAAIGSSLAELVSVIFFIIYTWKRIDCKKYALNILPKFQSRTLKRILNVSVWTMIQNFVSLSTWFMFFLFVEHLGERSLAIANIIRNVSGIPFMIAMAFAATCGSLVSNLIGAGEKDCVRGTINQHIRIGYVFVLPILIFFCLFPDLILRIYTDMPDLRDASIPSLWVLCAAYVVLVPANVYFQSVSGTGNTRTALAMELCVLTIYVAYATYFILYLKMDIAFAWTTESVYGIFIFLFCYWYMKKGNWQKKQI

SEQ ID NO: 19299 - protein, 500 aa, Bacteroides thetaiotaomicron VPI-5482
MNQELLMNPNCLVAALEKPAAEFTKADIISFIQKNNIRMVNFMYPAADGRLKTLNFVINNAAYLDAILTCGERVDGSSLFPFIEAGSSDLYVVPRFRTAFVDPFAEIPTLSMLCSFFNKDGEPLESSPEHTLHKACKAFTDVTGMEFQAMGELEYYVISPDTGMFQATDQRGYHESAPYAKFNDFRTQCMSYIAQTGGQIKYGHSEVGNFTLDGMIYEQNEIEFLPVHAEDAADQLMIAKWVIRNLGYRYGYNVTFAPKITAGKAGSGLHVHMRIVKDGQNQMLKDGVLSETARKAIAGMMELAPSITAFGNTNPTSYFRLVPHQEAPTNVCWGDRNRSVLVRVPLGWAAKTDMCTLANPLESESHFDTSQKQTVEMRSPDGSADLYQLLAGLAVACRHGFEIEQALDIAKRTYVNVNIHQKENEDKLKALAQLPDSCAASAECLQKQRAVFEQYNVFSPAMIDGIIRKLRSYEDKTLRADMEGKPEEMLELVHKYFHCG

SEQ ID NO: 19300 - protein, 484 aa, Bacteroides thetaiotaomicron VPI-5482
MNNTTNEGSKLYLYSITSVAILGGLLFGYDTAVISGAEKGLEAFFLSASDFQYNKVMHGITSSSALIGCVLGGALSGVFASRLGRRNSLRLAAVLFFLSALGSYYPEVLFFEYGKPNMDLLIAFNLYRVLGGIGVGLASAVCPMYIAEIAPSNIRGTLVSCNQFAIIFGMLVVYFVNYLIMGDHQNPIILKDAAGVLSVSAESDMWTVQEGWRYMFGSEAFPAAFFGLLLFFVPKTPRYLVLVQQEEKAYTILEKINGKKKAQEILNDIKATAQEKTEKLFTYGVTVIVIGILLSVFQQAIGINAVLYYAPRIFENAGAEGGGMMQTVIMGIVNIIFTLVAIFTVDRFGRKPLLIIGSIGMAVGAFAVAMCDSMAIKGVLPVLSIIVYAAFFMMSWGPICWVLISEIFPNTIRGKAVAIAVAFQWIFNYIVSSTFPALYDFSPMFAYSLYGIICVAAAIFVWRWVPETKGKTLEDMSKLWKKNK

SEQ ID NO: 19301 - protein, 383 aa, Bacteroides thetaiotaomicron VPI-5482
MTMRTNCFLLLTVLLGILPMSNTHANDSIPKSVILYTPYTKISVSPGASIDYSIDLINNTDKLVNANLSVSGLSSSWKHEMKSGGWNLSQLAVLPKEKKTFNLKVDVPLKVSRGSYHFVVSAGEAQLPLNVVVAQQGTYQTEFTTDQPNMQGNSKSTFTFNATLKNQTADQQLYALMAKAPRGWNVIFKPNYKQATSAQVEANSSQNVSIDITPPANVEAGSYKIPVRAATGNTSAELELEVVVTGSYQMELTTPRGLLSSDVTAGDTKRIELEIKNTGSSLLKDIQLSANKPVDWDVAFEPSKIEMLKAGETATVVAILKASKKALPGDYVTTMMAKTPEVNADAQFRIAVKTPMIWGWVGVLIILATIGVVYYLFRKYGRR

SEQ ID NO: 19302 - protein, 445 aa, Bacteroides thetaiotaomicron VPI-5482
MNLRITLLAFLCLCATAILRAERVDMLKAGAKANGKALNTKLINSTIDRLNRGGGGTLFFPAGTYLTGSIHLKSNITLELEAGATLLFSDNFDDYLPFVEVRHEGVMMKSFQPLIYAVDAENITIKGEGTLDGQGKKWWMEFFRVMIDLKDNGMRDINKYQPMWDAQNDTTAIYAETNKDYVSTLQRRFFRPPFIQPVRCKKVKIEGVKIVNSPFWTVNPEFCDNVTIKGITINNVPSPNTDGINPESCRNVHISDCHISVGDDCITIKSGRDAQARRLGVPCENITITNCTMLSGHGGVVIGSEMSGSVRKVTISNCVFDGTDRGIRIKSTRGRGGVVEDIRVSNIVMSNIKQEAVVLNLKYSQMPAEAKSERTPIFRNVHISGMTVTDVKTPIKIVGLEEAPISDIVLRDIHIQGARQKCIFEDCERITMDDVIINGEEMKLK

SEQ ID NO: 19303 - protein, 249 aa, Bacteroides thetaiotaomicron VPI-5482
MKRIVLLRHGESLWNKENRFTGWTDVDLSEKGVEEACKAGDALREAGFSFEAAYTSYLKRAVKTLNCVLDRLDKDWIPVEKTWRLNEKHYGMLQGLNKSETAVQYGEEQVHIWRRSYDVAPAPVGKDDPRNPGMDIRYAGVPDSELPRTESLKDTIGRVMPYWKCIIFPALMYKDSLLVVAHGNSLRGIIKHLKGISDTDISNLNLPTAVPYVFEFDDRLVLVKDYYLGNPEEIRKRAEAVAKQGMAKK

SEQ ID NO: 19304 - protein, 384 aa, Bacteroides thetaiotaomicron VPI-5482
MSRRRFLKMAALTGAAMCVGPTLNKVTAAERVWMGKQQVANNIPAGMAAVRTRRTLGHGNTAFTVSAMGYGCMGLNHNRSQYPSREKEIALVHEAVERGVTLFDTAESYGYHINEKLVGEALKGYTDRVFVSSKFGHKFVNGVQIKTEEDSTPANIRRVCENSLRNLGVETLGMFYQHRIDPNTPIEAVAETCSKLIKEGKILHWGMCEVNVDTIRRAHKICPVTAIQSEYHLMHRMVETNGVLELCEDLGIGFVPYSPLNRGFLGGMINEYTKFDVTNDNRQTLPRFQPEAIRANYRIVEVLNAFGRTRGITPAQIALAWLMNKKPFIVPIPGTTKLSHLEENLRACDIRFTAEEIEELETAVAAIPVVGSRYDALQESKIPK

SEQ ID NO: 19305 - protein, 491 aa, Bacteroides thetaiotaomicron VPI-5482
MANQNKTDIGLIGLAVMGENLALNMESKGWHVSVYNRTVPGVEEGVVDRFMNGRAKGKNIEGFTDIKAFVESIATPRKIMMMVRAGSPVDELMDQLFPLLSPGDILIDGGNSNYEDTNRRVKLAESKGFLFVGSGVSGGEEGALNGASIMPGGSEKAWPEVKPVLQSIAAKAPDGTPCCQWVGPAGSGHFVKMIHNGIEYGDMQLIAEAYWVMKNLIDLTNEEMADVFARWNEGKLRSYLIEITSNILRHKDKSGGYLIDKILDAAGQKGTGKWSVINAMELGMPLGLIATAVFERSLSAQKELRHLASKQFLCKHTLPIYNKAELVKEIFSALYASKLVSYAQGFAVLQRASDSFGWNLDLASIARMWRGGCIIRSIFLNDIAAAFEAADKPKHLLLAPYFREEIKSLLPGWKNLVAEAMKEELPVPAFSSALNYFYSLTSDNLPANLVQAQRDYFGAHTFERKDELRGQFFHENWTGHGGETKSGTYNV

SEQ ID NO: 19306 - protein, 463 aa, Bacteroides thetaiotaomicron VPI-5482
MNMQEDKSIIEVSHVSKFFGDKTALDDVTLNVKKGEFVTILGPSGCGKTTLLRLIAGFQTASEGEIRISGKEITQTPPHKRPVNTVFQKYALFPHLNVYDNIAFGLKLKKTPKQTIGKKVKAALKMVGMTDYEYRDVDSLSGGQQQRVAIARAIVNEPEVLLLDEPLAALDLKMRKDMQMELKEMHKSLGITFVYVTHDQEEALTLSDTIVVMSEGKIQQIGTPIDIYNEPINSFVADFIGESNILNGTMIHDKLVRFCGTEFECVDEGFGENTPVDVVIRPEDLYIFPVSEMAQLTGVVQTSIFKGVHYEMTVLCGGYEFLVQDYHHFEVGAEVGLLVKPFDIHIMKKERVCNTFEGKLQDATHVEFLGCTFECASVEGLESGTDVKVEVDFDKVILQDNEEDGTLTGEVKFILYKGDHYHLTVWSDWDENVFVDTNDVWDDGDRVGITIPPDAIRVIKITD

SEQ ID NO: 19307 - protein, 203 aa, Bacteroides thetaiotaomicron VPI-5482
MELDFDKMNGLVPAIIQDNETRKVLMLGFMNKEAYDKTVETGKVTFFSRTKNRLWTKGEESGNFLHVVSIKADCDNDTLLIQADPAGPVCHTGTDTCWGEKNEEPVMFLKALQDFIDKRHEEMPQGSYTTSLFESGINKIAQKVGEEAVETVIEATNGTNERLIYEGADLIYHMIVLLTSKGYRIEDLARELQERHSSTWKKH

SEQ ID NO: 19308 - protein, 457 aa, Bacteroides thetaiotaomicron VPI-5482
MKQYDAIIIGFGKAGKTLAAELSNRGWQVAVVEQSDEMYGGACPNVACIPTKTLIHESEISTLLYHNDFDKQSNMYRQAIARKNKLTSFLRENNYEKLSKRPNVTIYTGKGSLVSANTVKVALPEEEIELQGKEIFINTGSTPIIPSIEGIQQSRNVYTSTTLLELDILPKHLIIVGGGYIGLEFASMYAGFGSKVTLLEAGNRFMPRNDSDIAKSVREVMEKKGVEIRLNVRTQSIHDTHDGVTLTYSDTSDGTPYFVDGDAILIATGRKPMIEGLNLQAAGVEVDAHGAIVVNDQLHTNAPHIWAMGDVKGGAQFTYVSLDDFRIIRDQLFGDKKRDINDRDPLPYAVFIDPPLAHIGITEEEALRKGYSFKVSRLPATSVVRSRTLQQTDGMLKAIINSHSGKIMGCTMFCTDAPELINMVAMAMKTGQTSTFLRDFIFTHPSMSEGLNQLFDV

SEQ ID NO: 19309 - protein, 248 aa, Bacteroides thetaiotaomicron VPI-5482
MKKIVLLRHGESAWNKENRFTGWTDVDLTEKGVAEAEKAGVTLREYGFNFDKAYTSYLKRAVKTLNCVLDKMNLDWIPVEKSWRLNEKHYGDLQGLNKAETAEKYGEEQVLIWRRSYDIAPNPLSESDLRNPRFDYRYHEVSDAELPRTESLKDTIDRIMPYWESDIFPALKDAHTLLVVAHGNSLRGIIKHLKHISDEDIIKLNLPTAVPYVFEFDENLNVANDYFLGNPEEIRKLMEAVANQGKKK

SEQ ID NO: 19310 - protein, 419 aa, Bacteroides thetaiotaomicron VPI-5482
MQTIDKFNFAGKKAFVRVDFNVPLDENFNITDDTRMRAALPTLKKILADGGSIIIGSHLGRPKGVADKFSLKHIIKHLSELLGVEVQFANDCMGEEAAVKAAALQPGEVLLLENLRFYAEEEGKPRGLAEDATDEEKAAAKKAVKESQKEFTKKLASYADCYVNDAFGTAHRAHASTALIAKYFDTDNKMFGYLMEKEVKAVDKVLNDIQRPFTAIMGGSKVSSKIEIIENLLNKVDNLIIAGGMTYTFTKAMGGKIGISICEDDKLDLALDLIKKAKEKGVNLVLAVDAKIADAFSNDANTQFCAVDEIPDGWEGLDIGPKTEEIFANVIKESKTILWNGPTGVFEFENFTHGSRTVGEAIVEATKNGAFSLVGGGDSVACVNKFGLASGVSYVSTGGGALLEAIEGKVLPGIAAINE

SEQ ID NO: 19311 - protein, 408 aa, Bacteroides thetaiotaomicron VPI-5482
MSKIEIKDLYLVFGNEKQKALKMLKEGKTKSEILKATGCTVAVKDANLSINEGEIFVIMGLSGSGKSTLLRCINRLIRPTSGEVIINGTDIAKVSDKELLQIRRKELAMVFQNFGLLPHRSVLHNIAFGLELQGVKKGEREQKAMESMQLVGLKGYENQMVSELSGGMQQRVGLARALANNPEVLLMDEAFSALDPLIRVQMQDELLTLQSKMKKTIVFITHDLSEAIKLGDRIAIMKDGEIVQIGTSEEILTEPANAYVERFVENVDRSKIITASSVMVDKPIVARLKKEGPEVLIRKMRERNLTVLPVVDSNNLLVGEVRLNDLLKLRKEQIRSIESVVRHEVHSVLGDTVLEDILPLMTKTNSPIWVVNENREFEGVVPLSSLIIEVTGKDKEEINEIIQNAIEL

SEQ ID NO: 19312 - protein, 317 aa, Bacteroides thetaiotaomicron VPI-5482
MMAKIANKLTDLVGNTPLMELSGYSGKYGLNQNIIAKLEAFNPAGSVKDRVALSMIEDAEARGALKPGATIIEPTSGNTGVGLAMVATIKGYHLILTMPETMSLERRNLLKALGAQIVLTDGLGGMAASIAKAQELRDSIPGSVILQQFENPSNAAVHERTTGEEIWRDTDGEVAVFVAGVGTGGTICGVARALKKHNPDVHIVAVEPASSPILAGGQAASHRIQGIGANFIPKLYDASVVDEVIGVPDDEAIRAGRELAATEGLLAGISSGAAVYAARQLAQRPEFRNKKIVALLPDTGERYLSTELFAFDAYPLD

SEQ ID NO: 19313 - protein, 440 aa, Bacteroides thetaiotaomicron VPI-5482
MKYTYKQIWLINFPVMMSILMEQLINITDAVFLGHVGEIELGASALAGIYYLAIYMLGFGFSIGLQVMIARRNGEQHYKETGRTFFQGLYFLMVMAIMLCLLIHLVSPFILQQLITSDEIYQAVIRYLNWRSFGLLFSFPFLAFRAFLVGVTNTKLLSGAALTAVCINIPFNYLLIFKLDMGISGAAMASSIAEFGAFLILLLYMCKTVDKKKYGLSAVYDGRLLMKLLQLSVWSMLHAFISVAPWFLFFVAIEHLGKTELAISNITRSVSTLFFVIVNSFASTTGSLVSNLIGGGQGKELFPVCRKVLRLGYVVGLPLILTALWGNQWIIGFYTNNDYLVKLAFWPFIVMLLNYVFALPGYVYINAVTGTGKTRLAFVFQLVTILIYLIYLYLLSECFHASLTVYMTAEYLFVILLGIQSILYLKRKSKQNMYFCTFND

SEQ ID NO: 19314 - protein, 511 aa, Bacteroides thetaiotaomicron VPI-5482
MEEINKAYAMFQERDRIASLGGGVEKIEKQHESGKMTARERIEMLLDKGTFVELDKLMVHRCTNYGMDKNKIPGDGIVSGYGKIDGRQVFVYAYDFTVYGGSLSASNAKKIVKVQQLALKNGAPIIALNDSGGARIQEGIESLSGYADIFYQNTMASGVIPQISAILGPCAGGACYSPALTDFIFMVKEKSHMFVTGPDVVKTVIHEEVSKEELGGAMTHSSKSGVTHFMCNTEEELLMSIRELLSFLPQNNMDETKKQNCTDETNREDAVLDTIVPADPNVPYDMKDIIERVVDNGYFFEVMTNFAKNIIIGFARLAGRSVGIVANQPAYLAGVLDIDASDKASRFIRFCDCFNIPLITFEDVPGFLPGYTQENNGIIRHGAKIVYAFAEATVPKLTVITRKAYGGAYIVMNSKQTGADVNFAYPSAEIAVMGAEGAVNILFRKADAETKGKELEAYKEKFATPYQAAELGFIDEIIYPRQTRKRLIQALEMTENKMQTNPPKKHGNMPL

SEQ ID NO: 19315 - protein, 426 aa, Bacteroides thetaiotaomicron VPI-5482
MAKQFKPETLCVQAGWTPKKGEPRVLPIYQSTTFKYDTSEQMARLFDLEDSGYFYTRLQNPTNDAVAAKIAALEGGVAAMLTSSGQAANFYAIFNICQAGDHFVCSSAIYGGTFNLFGVTMKKLGIDVTFVNPDASEEEISAAFQPNTKALFGETISNPSLEVLDIEKFARIAHSHGVPLIVDNTFPTPINCRPFEWGADIIVHSTTKYMDGHATSVGGCIVDSGNFDWDAHADKFPGLCTPDESYHGLTYTKAFGKGAYITKATAQLMRDLGSIQSPQNSFLLNLGLETLHLRMPQHCRNAQKVAEYLSKNEKVAWVNYCGLPDNKYYALAQKYMPNGSCGVISFGLKGGRDVSIKFMDSLEFIAIVTHVADARSCVLHPASHTHRQLSDEQLMEAGVRPDLIRLSVGIENADDIIADIEQALNA

SEQ ID NO: 19316 - protein, 283 aa, Bacteroides thetaiotaomicron VPI-5482
MSEEKWAIITGADGGMGTEITRAVAEAGYHIIMACYRPSKAEPIRQRLVNETGNANMEVMAVDLSSMASTASFADRIVERHLPVSLLMNNAGTMETGLHITDDGFERTVSVNYLGPYLLTRKLLPALTCGARIVNMVSCTYAIGHLDFPDFFRQGRKGSFWRIPVYSNTKLALMLFTIELSERLREKGITVNAADPGIVSTDIITMHQWFDPLTDIFFRPFIRTPKKGASTAVGLLLDEAVAGVSGQLYASSHRKQLSEKYLCHVQQKQLWQETEQALERWLK

SEQ ID NO: 19317 - protein, 407 aa, Bacteroides thetaiotaomicron VPI-5482
MESKLFTPVTFGPLTLRNRTIRSAAFESMCPGNAPSQMLLDYHRSVAAGGVGMTTVAYAAVTQSGLSFDRQLWLRPEIISGLREVTGAIHTEGAAAGIQIGHCGNMSHKKICGTTPISASTGFNLYSPTFVRGMKREELPEMARAYGRAVHLAREAGFDAVEVHAGHGYLISQFLSPYTNHRKDDYGGLLQNRMRFMEMVMNEVMTAAGSDMAVIVKMNMRDGFKGGMETDESLQVAKRLLALGAHALVLSGGFVSKAPMYVMRGAMPIRSMAYYMDCWWLKYGVRMFGKWMIPTVPFREAYFLEDALKFRAALPEAPLIYVGGLVSREKIDEVLDAGFDAVQMARALLNEPEFVNRMRREEQARCNCGHSNYCIGRMYTIEMACHQHLKEKLPPCLQREIEKLEKQ

SEQ ID NO: 19318 - protein, 445 aa, Bacteroides thetaiotaomicron VPI-5482
MISLNIEKTFGFISKEKVSAYEAEVKAAQEMLEKGTGEGNDFLGWLHLPSSISKEHLADLNATAKVLRDNCEVVIVAGIGGSYLGARAVIEALSNSFTWLQDKKTAPVMIYAGHNISEDYLYELTEYLKDKKFGVINISKSGTTTETALAFRLLKKQCEDQRGKETAKKVIVAVTDAKKGAARVTADKEGYKTFIIPDNVGGRFSVLTPVGLLPIAVAGFDIDKLVAGAADMEKACGSDVPFAENPAAIYAATRNELYRQGKKIEILVNFCPKLHYVSEWWKQLYGESEGKDNKGIFPASVDFSTDLHSMGQWIQEGERSIFETVISLDKVDHKLEVPFDEANLDGLNFLAGKRVDEVNKMAELGTQLAHVDGGVPNMRIVLPELSEYNIGGLLYFFEKACGISGYLLGVNPFNQPGVEAYKKNMFALLNKPGYEEESKAIQAKL

SEQ ID NO: 19319 - protein, 428 aa, Bacteroides thetaiotaomicron VPI-5482
MERKNLHFETLQVHVGQEQADPATDARAVPIYQTTSYVFHNSAHAAARFGLQDPGNIYGRLTNSTQGVFEERVAVLEGGVAGLAVASGAAAITYAFENITRAGDHIVAAKTIYGGSYNLLAHTLPNYGVTTTFVDPSDLSNFEKAIQENTKAVFIETLGNPNSNIIDIEAVSEIAHRHKIPLIIDNTFGTPYLIRPIEHGADIVVHSATKFIGGHGSSLGGVIVDSGKFDWVASGKFPQLTEPDPSYHGVRFVDAAGPAAYVTRIRATLLRDTGATISPFNAFILLQGLETLSLRVERHVENALKVVNFLNNHPKVKKVNHPSLSDHPDHALYQRYFPNGAGSIFTFEVKGGQEEAHRFIDSLEIFSLLANVADVKSLVIHPASTTHSQLNAQELAEQEIYPGTVRLSIGTEHINDLIADLEQALAKI

SEQ ID NO: 19320 - protein, 455 aa, Bacteroides thetaiotaomicron VPI-5482
MAKEKTVYVCSNCGQESPKWVGKCPSCGEWNTYVEEIVRKETTNRRPVSGIETQKAKPVILSEIEADDEPRINMHDDELNRVLGGGLVPGSLVLIGGEPGIGKSTLVMQTVLRMPDKKILYVSGEESARQLKLRADRLSEVSSDCLIVCETSLEQIYVHIKNTSPDLVIIDSIQTISTENIESSPGSIAQVRECSASILRFAKETHTPVLLIGHINKEGSIAGPKVLEHIVDTVLQFEGDQHYMYRILRSIKNRFGSTAELGIYEMRQDGLRQVSNPSELLLSQDHEGMSGVAIASAIEGVRPFLIETQALVSSAVYGNPQRSATGFDIRRMNMLLAVLEKRVGFKLAQKDVFLNIAGGLKVNDPAIDLAVISAILSSNMDAAVEPEVCMAGEIGLSGEIRPVNRIEQRIGEAEKLGFKRFLLPKYNLQGIDTQKLKIELVPVRKVEEAFRALFG

SEQ ID NO: 19321 - protein, 321 aa, Bacteroides thetaiotaomicron VPI-5482
MDKKVTLAQLKEVVQEAYDQVKTNTGGKNADYIPYLANVNKDLFGISVCLLNGQTIHVGDTDYRFGIESVSKVHTAILALRQYGAKEILDKIGADATGLPFNSIIAILLENDHPSTPLVNAGAISACSMVQPIGDSAKKWDAIVENVTDLCGSAPQLIDELYKSESDTNFNNRSIAWLLKNYNRIYDDPDMALDLYTRQCSLGVTALQLSVAAGTIANGGVNPVTKKEVFDASLAPKITAMIAAVGFYEHTGDWMYTSGIPAKTGVGGGVMGVLPGQFGIAAFAPPLDGAGNSVKAQLAIQYVMNKLGLNVFSDNHLIVVD

SEQ ID NO: 19322 - protein, 360 aa, Bacteroides thetaiotaomicron VPI-5482
MTNMDNYCVIMGGGIGSRFWPFSRKTLPKQFLDFFGTGRSLLQQTFDRFQKVIPTENILIVTNAMYADLVKEQLPELDEKQILLEPARRNTAPCIAWAAYHIRALNPNANIVVAPSDHLILKEEEFRAAIIKGLEFVSHSEKLLTLGIKPNRPETGYGYIQIDEPTGDGFYKVKTFTEKPELELAKVFVESGEFYWNSGLFMWNVNTIIKAAEILLPELVSKLAPGKNIYATDKEKAFIEENFPACPNVSIDFGIMEKADNVYVSLGDFGWSDLGTWGSLYDLSERDREGNVTLKSHSLIYNGKDNMIVLPKGKLAVIDGLEGYLIAESDNVLLICRKDEEHSIRKYVNDAQMQLGDDFI

SEQ ID NO: 19323 - protein, 329 aa, Bacteroides thetaiotaomicron VPI-5482
MDKIIGLGNALIDVLATLKDDTLLDELELPKGSMQLIDDAKLQQINTKFSQMKTHLATGGSAGNAILGLACLGAGTGFIGKVGNDHYGDFFRKNLQKNNIEDNLLTSEQLPSGVASTFISQDGERTFGTYLGAAASLKAEDLTLEMFKGYAYLFIEGYLVQDHEMILHAIELAKEAGLQICLDMASYNIVENDLEFFSLLINKYVDIVFANEEEAKAFTGEEPEEALRVIAKKCSIAIVKVGANGSYIRKGTEEIKVSAIPVEKVLDTTGAGDYFAAGFLYGLTCGYSLEKCAKIGSILSGNVIQVIGTTISPERWDEIKLNINKVLAE

SEQ ID NO: 19324 - protein, 334 aa, Bacteroides thetaiotaomicron VPI-5482
MYIVNSYTLAIIFCFITMICWGSWGNTQKLASKNWRYELYYWDYTIGILLFALLLVFTLGSFGDSGRGFLEDIQQVEAAYIASALIGGAIFNASNILLSASVSIAGMAVAFPLGVGLALVLGVFINYFSSPKGDPFWLFTGVVLIVIAIICNGIAAGKNQKAGTNNSKKGIILAAIAGILMSFFYRFVAAAMDLNNFESPTTGMATPYTAFFIFAIGIFLSNFLFNTLVMKRPFVGLPVTYKEYFAGKASTHMVGILGGCIWGLGTALSYIAAGKAGAAISYALGQGAPMIAALWGVFIWKEFTGSSKATNRLLGVMFILFILGLTFIVISGGS

SEQ ID NO: 19325 - protein, 485 aa, Bacteroides thetaiotaomicron VPI-5482
MLLKQTKIVASISDRRCDVDFIKQLFEAGMNVVRMNTAHASREGFEALIANVRSVSNRIAILMDTKGPEVRTTANAEPIPYQIGDKVKIVGNPDQETTRECIAVSYPNFVNDLNIGGLVLIDDGDLELEVIDKTADYLLCEVKNDATLGSRKSVNVPGVRINLPSLTEKDRNNILYAIEKDIDFIAHSFVRNRQDVLDIREILDAHNSDIRIIAKIENQEGVDNIDEILEVADGVMVARGDLGIEVPQERIPGIQRVLIRKCILAKKPVIVATQMLHTMINNPRPTRAEVTDIANAIYYRTDALMLSGETAYGKYPVDAVKTMTKIAAQAEKDKLEENDIRIPLNENSNDVTAFLAKQAVKATSKLKIRAIITDSYSGRTARNLAAFRGKFPVLAICYKEKTMRHLALSYGVEAIYMPELANGQEYYFAALRRLLKEGRLQPTDMVGYLSSGKAGTQTSFLEINVVEDALKHAGETVLPNNNRYL

SEQ ID NO: 19326 - protein, 194 aa, Bacteroides thetaiotaomicron VPI-5482
MDKFSYAIGLGIGQNLLSMGAKGIAVDDFAQAIKDVLEGNQTAISHQEAREIVNKYFEELEAKMGAAAIEQGKAFLEENKKKPGVVTLPSGLQYEVINEGTGKKAKATDQVKCHYEGTLIDGTLFDSSIKRGEPAVFGVNQVIPGWVEALQLMPEGSKWKLYIPSDLAYGARGAGEMIPPHSTLVFEVELLEVL

SEQ ID NO: 19327 - protein, 291 aa, Bacteroides thetaiotaomicron VPI-5482
MKKVSIFMAIAAAASLASCTAQAPKANLKTDIDSLSYSIGMAQTQGLKGYLTGRLDVDTAYMAEFIKGLNEGANKTSKKDIAYMAGLQIGQQISNQMMKGINQELFAGDSTKTISKDNFMAGFIAGTLEKGGVMTMEAAQEYTRTAMETIKAKAMEEKYADNKAAGEKFLAENKTKEGVKTTESGLQYKVITEGKGEIPADTCKVKVNYKGTLIDGTEFDSSYKRNEPATFRANQVIKGWTEALTMMPVGSKWELYIPQELAYGSRESGQIKPFSTLIFEVELVGIEKDKK

SEQ ID NO: 19328 - protein, 315 aa, Bacteroides thetaiotaomicron VPI-5482
MEKIARKLTDLVGNTPLLELSNYNKSNGLKARLIVKIESFNPAGSVKDRVALAMIEDAEMKGVLTPGATIIEPTSGNTGVGLAFVAAAKGYKLILTMPDTMSVERRNLLKALGAELVLTPGADGMKGAIAKAEELKAATPGSVILQQFENPANPAMHLRTTGLEIWRDTEGKVDIFVAGVGTGGTISGVGEALKMRDPSVKAVAVEPADSPVLSGGKPGPHKIQGIGAGFVPKTYNASVVDEIIQVQNDDAIRTSRALAEEEGLLVGISSGAAVYAATELAKRPENEGKMIVALLPDTGERYLSTILYAFEEYPL

SEQ ID NO: 19329 - protein, 1106 aa, Bacteroides thetaiotaomicron VPI-5482
MVQRPQDKKFLVKMLDESSQIRDRRILAKRIKTLLDQYGVPEFLNKRDSFLFKMYQAFGHHFDFIAIPIIKKRLRMNTSQVIINEARPQLTKHLAIRAKEKIGQNVNLLGEVVLGNGEADHRYHHYLKALESPDINYISVKISGIYAQTHALNYEESFPELISRMSALYQKAIDFPYTDEEGVRRSKFINLDMEEYKDTHFTLRLFKTVLSLPQFKNYSAGIVVQAYLPDAYDFQTELIEFAKARVAEGGAPIKMRLVKGCNLEMETVISSLRGWPNPIRPSKEEVDANYLHLLERALMPENARVLHLGVASHNLFSIAYAYLLAQKYGTAEYMTFEMLEGMANHLWRAQSMLGNRVILYTPVVKNEHFLNAVSYLVRRMDENTAPDNFLTHSFNLRPNTKEWDFLAKQFEDAYAMKDQLSHVSPRTQNRNLPYTPVPPADVLKNEPDTDFDLPQNQEWVRSIFSKWKKDGTEQPEIIPLQIGAETVVCESRYPYTDRCQDDEVCICEMSQADSAQVEKIIEIAEADPAGWRKTTLEERHRIMYEAANRLADMRGDLIGCMCAVTGKTVIEGDVEVSEAVDYARFYTTAMKKFAALDDVEMKPKGTILVISPWNFPCAIPVGGIVAGLAGGNTVILKPATVAAPVAWMFAKAFWDAGVPKEALQVIITRREALKVLTTAPAIKHIILTGGTDTAQNIAKANPTTPLSAETGGKNVIILTASGDRDHAIMNIVTSAFGNAGQKCSACSLLLVERSVYEDENFRSKLKDAATSLKTGSVWNAGNIVGPMITNKNDKLLQAFNLEPGESWLVPPRFIDRREYILAPTVKWGVKPESFSFRTELFGPLLSVACIENLEEGIRLVNGLDYGLTSGLQSLDEKEQKLWKNSVMAGNLYINRGITGAIVNRQPFGGMKLSAFGGGIKAGGPNYCTCFLEITDKPDSRTDYRQSYAKAYQEEFSKPRDVNRLYGEQNLFRYLPLKNMILRLFPKDTDEEATMIAHAARICRTPLTISFGPTDDRSSRLAGLGCTLRKESLEDFLKELPEYERVRTCSPDIPDVMYERAAETNKYIATAPPVKQGRIELIHYIKEQSIAFEYHRYGSISEVPPCE

SEQ ID NO: 19330 - protein, 447 aa, Bacteroides thetaiotaomicron VPI-5482
MKYQVIIIGGGPAGYTAAEAAGKAGLSVLLIEKNNLGGVCLNEGCIPTKTLLYSAKTYDSARHSSKYAVNVSEVSFDLPKIIARKSKVVRKLVLGVKAKLTSNNVAMVTGEAQIIDKNTVRCGEETYNAENLILCTGSETFIPPITGVETVNYWTHRDALDSKELPASLAIVGGGVIGMEFASFFNSLGVQVTVIEMMDEILGGMDKELSALLRAEYAKRGIKFLLSTKVVALSQTEEGAVVSYENAEGKGSVIAEKLLMSVGRRPVTKGFGLENLNLDKTGRGAIKVNEKMQTSLSGVYVCGDLTGFSLLAHTAVREAEVAVHSILGKEDAMSYRAIPGVVYTNPEIAGVGETEESASAKGITYKVVKLPMAYSGRFVAENEGVNGVCKVLLDEQERIIGAHVLGNPASEIITLAGTAIELGLTAAAWKKVVFPHPTVGEIFREAL

SEQ ID NO: 19331 - protein, 1040 aa, Bacteroides thetaiotaomicron VPI-5482
MTIRLNKVTRDLNVGIATVVEFLQKKGYTVEANPNTKISEEQYAVLVKEFSTDKNLRLESERFIQERQNKERNKASVSIEGFEKQQEKPKSEDVIKTVVPEDARPKFKPVGKIDLDKFSGRRTDKVEKAPEKKVEPVVEQPVVEQPVAEKTVVEKPVVESEVKKEEPKVEKVEVIAPKPAPVEQPVVAPKPAVETKPVEVEKVVVEEVKKEEPKVVETAPVKAEERKVERTAEVTATVTTPTEENASKENEVFKIRQPELGAKINVIGQIDLAALNQSTRPKKKSKEEKRREREEKEKVRQDQKKLMKEAIIKEIRKEDSKQAKPGVKDNNADAARKKRNRINKEKVDVNNVATSNFAAPRPNTQTGKGGGNHPRPQGQGQGQGNNNNNNKKNNNKDRFKKPVIKQEVSEEDVAKQVKETLARLTTKGKNKTSKYRKEKREMASNRMQELEDQEMAESKVLKLTEFVTANELATMMDVSVNQVIATCMSIGMMVSINQRLDAETINLVAEEFGFKTEYVSAEVAQAIVEEEDAPEDLQPRAPIVTVMGHVDHGKTSLLDYIRKANVIAGEAGGITQHIGAYNVQLEDGRRITFLDTPGHEAFTAMRARGAKVTDIAIIIVAADDNVMPQTKEAINHAMAAGVPIVFAINKVDKPTANPDKIKEELAAMNYLVEEWGGKYQSQDISAKKGMGVEDLMEKVLLEAEMLDLKANPNRNATGSIIESSLDKGRGYVATVLVSNGTLKVGDIVLAGTSYGRVKAMFNERNQRVKEAGPAEPALILGLNGAPAAGDTFHVVESDQEAREITNKREQLAREQGLRTQKILTLDELGRRIALGNFQELNIIVKGDVDGSVEALSDSLIKLSTEQIQVNVIHKGVGAISESDVSLAAASDAIIVGFQVRPSGAAAKMAEQEGVDIRKYSVIYDAIEEVKAAMEGMLAPELKEQITATIEIREVFNITKVGLVAGAVVKTGKVKRSDKARLIRDGIVIFTGNINALKRFKDDVKEVGTNFECGISLVNCNDMKVGDMIETFEEIEVKQTL

SEQ ID NO: 19332 - protein, 504 aa, Bacteroides thetaiotaomicron VPI-5482
MSKKALLMILDGWGLGDQKKDDVIFNTPTPYWDYLMNNYPHSQLQASGENVGLPDGQMGNSEVGHLNIGAGRVVYQDLVKINRACADNSILQNPEIVSAFSYAKENGKSVHFMGLTSNGGVHSSMVHLFKLCDISKEYGIDNTFIHCFMDGRDTDPKSGKGFIEELSAHCEKSAGKIASIIGRYYAMDRDKRWERVKEAYDLLVNGQGKKATDMVQAMQESYDEGVTDEFIKPIVNANCDGTIKEGDVVIFFNYRNDRAKELTVVLTQQDMPEAGMHTIPGLQYYCMTPYDASFKGVHILFDKENVANTLGEYIASKGLNQLHIAETEKYAHVTFFFNGGRETPFDNEDRILVPSPKVATYDLKPEMSAYEVKDKLVDAINENKYDFIVVNFANGDMVGHTGIYEAIEKAVVAVDACVKDVIEAAKAQDYEAIIIADHGNADRALNEDGTPNTAHSLNPVPCVYVTGNKAAKVEDGRLADVAPTILKIMGLEAPADMNGQILIK

SEQ ID NO: 19333 - protein, 349 aa, Bacteroides thetaiotaomicron VPI-5482
MVQFFQEIQEQPQALLQTANFYKSVEGKSVLSQISELWCSGKYRNILLTGMGSSYFIANATASLLNSYKIPAYALNAGELLHYQISLISPESLIICISQSGESYEVIKLIEKLSSNITVLSICNEKDSSLVKFSRYSLLCKAGKEEKTSTKTFITCYQVAYLLAMKLCNQEIDSTQWHKLSKIIENMVNGNTPWMSKAIELIDGSTFVQLIGRGPVFAAASQSALMFMEAAHTPASALLGGEFRHGPLEMVKKGFIAILFAHSQSETYEQSLSLVKDILKYEGKVIFITDSNLVFENDNLCAITIPSTNAELFTIPCIVPVQLLINTWATKCGIIPGEFTHGAKITSIE

SEQ ID NO: 19334 - protein, 468 aa, Bacteroides thetaiotaomicron VPI-5482
MKTTINLGYIIFLSVVAALGGFLFGYDTAVISGTIAQVTHLFQLDTLQQGWYVGCALIGSIVGVLFSGILSDSIGRKRTMILSAILFSTSAIGCAFCIDFNQLVVYRIIGGIGIGVVSIVSPLYISEVSVAQFRGRMVSLYQLAVTVGFLGAYLVNYQLLAYSESGNHLPIAWLEKIVVTEVWRGMLGMETLPAIIFFIIIFFIPESPRWLIVKGQERKATYILEKIYNSFKEADFQLNETKSVLVSETRSEWSILLKPGILKAVIIGVCIAILGQFMGVNAVLYYGPSIFENAGLSGGDSLFYQVLVGLVNTLTTILALLIIDKVGRKKLIYYGVSGMVVSLILIGSYFLFGNAWNISSLFLLAFFLCYVFCCAISICAVIFVLLSEMYPTKIRGLAMSIAGFALWIGTYLIGQLTPWMLQNLTPAGTFFLFAIMCVPYMLIVWKLVPETTGKSLEEIERYWTRSER

SEQ ID NO: 19335 - protein, 310 aa, Bacteroides thetaiotaomicron VPI-5482
MQYHEIGKTGMKVSSLSFGASSLGGVFHDLKEKEGIQAVFTAIEAGMNFIDVSPYYGHYKAETVLGKALKDIPRDRYYLSTKVGRYGKDGVNTWDYSAKRATESVYESMERLNIDFIDLINVHDIEFADLNQVVNETLPALVELREKGVVGHVGITDLQLENLKWVIDRSPSGTIESVLSFCHYCLCDDKLADFLDYFESKEIGVINASPLSMGLLSERGVPVWHPAPKPLVDACRKAMEHCKAKNYPIEKLAMQFSVSNPKIATTLFSTTNPENVKKNIGFIEEPVDWELVREVREIIGEQQRVSWANS

SEQ ID NO: 19336 - protein, 373 aa, Bacteroides thetaiotaomicron VPI-5482
MKLFDVYPLYDINIVKGQGCKVWDENGTEYLDLYGGHAVISIGHAHPHYVEMISNQVATLGFYSNSVINKLQQQVAERLGKISGYEDYSLFLINSGAEANENALKLASFYNGRTKVISFSKAFHGRTSLAVEATNNPTIIAPINNNGHVTYLPLNDIEAMKQELAKGDVCAVIIEGIQGVGGIKIPTTEFMQELRKVCTETGTILILDEIQSGYGRSGKFFAHQYNHIQPDIITVAKGIGNGFPMAGVLISPMFKPVYGQLGTTFGGNHLACSAALAVMDVIEQDNLVENAKAVGDYLLEELKKFPQIKEVRGRGLMIGLEFEEPIKELRSRLIYDEHVFTGASGTNVLRLLPPLCLSMEEADEFLARFKRVL

SEQ ID NO: 19337 - protein, 452 aa, Bacteroides thetaiotaomicron VPI-5482
MRNIYSIYKEHYKALISLGLPIVIGQIGVIVLGFADTLMIGHHSTIELGAASFVNNVFNLVIIFSTGFSYGLTPIVGGLYGTHQYASAGQALRNSLLANLLVAFLLTIGMTVLYFNVGNLGQPEELIPLIKPYYLVLLASLVFVMLFNGFKQFTDGITDTKTAMWILLGGNVLNIIGNYILIYGKLGLPEMGLLGAGISTLFSRIMMVVVFIIVFMRSPRFLRFKLGFYRLGWSKAIFGRLNSLGWPIAFQMGMETASFSLSAVMIGWLGTIALASHQVMLAISQFTFMMYYGMGAAVAVRVSNFNGQGDILNVRRSAYAGFHLMMALGVVLSSIVFLCRNYLGGWFTDSTEVAAMVTSLILPFLVYQFGDGLQITFANALRGISDVKLMMLIAFIAYFLISLPVGYFCGFVLEWGIIGVWMAFPFGLTSAGLMLWWRFHHKTKLPPSIQNS

SEQ ID NO: 19338 - protein, 507 aa, Bacteroides thetaiotaomicron VPI-5482
MSESKRIKTALVSVYHKEGLDEIITKLYEEGVEFLSTGGTRQFIESLGYPCKAVEDLTTYPSILGGRVKTLHPKIFGGILCRRDLEQDIQQIEKYEIPEIDLVIVDLYPFEATVASGASEADIIEKIDIGGISLIRAAAKNYNDVIIVASQAQYKPLLDMLMEHGATSSLEERRWMAKEAFAVSSHYDSAIFNYFDAGEGSAFRCSVNNQKQLRYGENPHQKGYFYGNLDAMFDQIHGKEISYNNLLDINAAVDLIDEYEDLTFAILKHNNACGLASRPTVLEAWTDALAGDPVSAFGGVLITNGVIDKAAAEEINKIFFEVIIAPDYDVDALEILGQKKNRIILVRKEAKLPKKQFRALLNGVLVQDKDMNIETVADLRTVTDKAPTPEEVEDLLFANKIVKNSKSNAIVLAKGKQLLASGVGQTSRVDALKQAIEKAKSFGFDLNGAVMASDAFFPFPDCVEIADKEGITAVIQPGGSVKDDLTFAYCNEHGMAMVTTGIRHFKH

SEQ ID NO: 19339 - protein, 255 aa, Bacteroides thetaiotaomicron VPI-5482
MEESKMVLRTEDLVKKYGKRTVVSHVSIDVKQGEIVGLLGPNGAGKTTSFYMTVGLITPNEGRIFLDDLEITKFPVYKRAQTGIGYLAQEASVFRQMSVEDNIASVLEMTNKPKDYQKDKLESLIAEFRLQKVRKNKGNQLSGGERRRTEIARCLAIDPKFIMLDEPFAGVDPIAVEDIQQIVWKLKDKNIGILITDHNVQETLSITDRAYLLFEGKILFQGTPEELAENKIVREKYLSNSFVLRRKDFQLNKDE

SEQ ID NO: 19340 - protein, 256 aa, Bacteroides thetaiotaomicron VPI-5482
MIDIRGLYKSFEDKTVLSNINASFENGKTNLIIGQSGSGKTVLMKCIVGLLTPEKGEVLYDGRNLVLMGKKEKKMLRKEMGMIFQSAALFDSMSVLDNVMFPLNMFSNDTLRDRTKRAMFCLERVNLTEAKDKFPGEISGGMQKRVAIARAIALNPQYLFCDEPNSGLDPKTSLVIDDLIHDITQEYNMTTIINTHDMNSVLGIGEKVIYIYEGHKEWEGTKDDIFTSTNERLNNFIFASDLLRKVKDMEVQNMEG

SEQ ID NO: 19341 - protein, 492 aa, Bacteroides thetaiotaomicron VPI-5482
MSFIADKIVMDGLTYDDVLLIPAYSEVLPRTVDLSTKFSRNIELKIPFVTAAMDTVTEAKMAIAIAREGGIGVIHKNMSIEEQARQVAIVKRAENGMIYDPVTIKRGSTVSDALGIMAEYKIGGIPVVDDEGYLVGIVTNRDLRFERDMTKHIDLVMTPKERLVTTNQSTDLESAAQILQKHKIEKLPIVGMDGKLIGLVTYKDITKAKDKPMACKDAKGRLRVAAGVGVTADTLDRMQALVDAGADAIVIDTAHGHSMYVIEKLKEAKKRFPNIDIVVGNIATGEAAKALAEAGADAVKVGIGPGSICTTRVVAGVGVPQLSAVYDVAKALKGTGVPLIADGGLRYSGDVVKALAAGGYCVMIGSLVAGTEESPGDTIIFNGRKFKSYRGMGSLEAMENGSKDRYFQSGTADVKKLVPEGIAARVPYKGTLYEVVYQLSGGLRAGMGYCGAANIEKLHDAKFTRITNAGVMESHPHDVTITSESPNYSRPE

SEQ ID NO: 19342 - protein, 252 aa, Bacteroides thetaiotaomicron VPI-5482
MRKNIVAGNWKMNKTLQEGIALAKELNEALANEKPNCDVIICTPFIHLASVTPLVDAAKIGVGAENCADKASGAYTGEVSAEMVASTGAKYVILGHSERRAYYGETVAILEEKVKLALANGLTPIFCIGEVLEEREANKQNEVVAAQMESVFSLSAEDFSKIILAYEPVWAIGTGKTASPEQAQEIHAFIRSIVADKYGKEIADNTSILYGGSCKPSNAKELFSNPDVDGGLIGGAALKVSDFKGIIDAFNA

SEQ ID NO: 19343 - protein, 393 aa, Bacteroides thetaiotaomicron VPI-5482
MQKESQTYKIAPAERLASVSEYYFSKKLKEVAQMNAEGKDVISLGIGSPDMPPSKVTIETLCNNAHDPNGHGYQPYVGIPELRKGFAAWYQRWYGVELNPNTEIQPLIGSKEGILHVTLAFVNPGEQVLVPNPGYPTYTSLSKILGAEVISYDLKEEDGWMPDFEALEKMDLNRVKLMWTNYPNMPTGANATPELYERLVDFARRKNIVIVNDNPYSFILNEKPISILSVPGAKECCIEFNSMSKSHNMPGWRIGMLASNAEFVQWILKVKSNIDSGMFRAMQLAAATALEAEADWYEGNNHNYRGRRHLAGEIMKTLGCTYDENQVGMFLWGKIPASCKDVEELTEKVLHQARVFITPGFIFGSNGARFIRISLCCKDAKLAEALERIKKLS

SEQ ID NO: 19344 - protein, 282 aa, Bacteroides thetaiotaomicron VPI-5482
MKKIAIQGTLGSYHDIAAHKYFEGEEIELICCANFEDVFTSIRKDSQVIGMLAIENTIAGSLLHNNELLRQSGTQIIGEYKLRISHSFVCLPEESWEDLTEVNSHPIALMQCRDFLNQHPQLKVVEGEDTARSAEIIKKENLKGHAAICSKTAAERYGMKVLQEGIETNKHNFTRFLVVADPWQVDELRQHHAKATNKASMVFTLPHTEGSLSQVLSILSFYNINLTKIQSLPIIGREWEYQFYVDVSFNDYLRYKQSIAAITPLTKELKILGEYAEGKSNV

SEQ ID NO: 19345 - protein, 216 aa, Bacteroides thetaiotaomicron VPI-5482
MKPIISPSILSADFGYLARDIEMINRSEAEWVHIDIMDGVFVPNISFGFPVLKYVAKLTDKPLDVHLMIVNPEKFIPEVKALGAHTMNVHYEACTHLHRVIQQIKEAGMQPAVTINPATPVALLQDIIQDVYMVLIMSVNPGFGGQKFIEHSVEKVRELRALIERAGSKALIEVDGGVNLETGARLVEAGADVLVAGNAVFGAPDPEEMIRQLHKL

SEQ ID NO: 19346 - protein, 180 aa, Bacteroides thetaiotaomicron VPI-5482
MKSFILMVITMVCAISLEAQNKSFYDFNVTTIDGKEFPLSSLKGKKVLVVNVASKCGLTPQYAKLQELYDKYKDKNFVIIGFPANNFMGQEPGSNEEIAQFCSLKYDVTFPMMAKISVKGKNMSPLYQWLTEKKLNGKEDAPVQWNFQKFMIDENGNWVGFVAPKESPLSEKIVTWIEQE

SEQ ID NO: 19347 - protein, 503 aa, Bacteroides thetaiotaomicron VPI-5482
MKIFPSSSIKKLDAYTIEHEPIASIDLMERAAQALTKAITNRWNPETPVTIFAGPGNNGGDALAVARMMAEKGYKIEVYLFNTKGELSPDCQTNKELVEMMEEVTFHEISTQFVPPTLTPEHLVIDGLFGSGLNKPLSGGFAAVVKYINASPAMVVSIDIPSGLMGEENTFNVKSNIIRADVTFSLQLPKLAFLFAENTEFVGEWELLDIQLSEEGIEETETNYEMLEIEEIRSLIKPRQQFAHKGNFGHALLIAGSKGMAGASVLAARACLRSGVGLLTVHAPLCNNDILQTSAPEAMVETDVSETCFAVPTDTDDYQAVGIGPGLGRNEETEAALIEQLEHCQTPTVLDADALNILANHRHTLTHLPKGSILTPHPKELERLVGKCQDSYERLMKACELAHTAKVHIILKGAYSAIITPEGKCYFNQTGNPGMATGGSGDVLTGVILALLAQGYPAEDAAKIGTYIHGLAGDIAQKKQGMIGLIASDIVTCLPTAWRLVSE

SEQ ID NO: 19348 - protein, 178 aa, Bacteroides thetaiotaomicron VPI-5482
MDTIQIKDKQFTVSIKEQDIQKEVIRVANEINRDLAGKNPLFLSVLNGSFMFTADLLKHITIPCEISFVKLASYQGVTSTGVIKEVIGLNEDIAGRTVVIVEDIVDTGLTMQRLLDTLGTRNPEAIHIASLLVKPEKLKVNLNIEYVAMEIPNDFIVGYGLDYDGFGRNYPDIYTVVD

SEQ ID NO: 19349 - protein, 460 aa, Bacteroides thetaiotaomicron VPI-5482
MKSYNKKFVYSICLVSAMGGLLFGYDWVVIGGAKPFYELYFGIADSPTMQGLAMSVALLGCLIGAMVAGMMADRYGRKPLLLISAFIFLSSAYATGAFSVFSWFLAARFLGGIGIGIASGLSPMYIAEVAPTSIRGKLVSLNQLTIVLGILGAQIANWLIAEPIPADFTPADICASWNGQMGWRWMFWGAAFPAAVFLLLACFIPESPRWLAMKGKREKAWSVLSRIGGNRYAEQELQMVEQTSASKSEGGLKLLFSRPFRKVLVLGVIVAVFQQWCGTNVIFNYAQEIFQSAGYSLGDVLFNIVVTGVANVIFTFVAIYTVERLGRRALMLLGAGGLAGIYLVLGTCYFFQVSGFFMVVLVVLAIACYAMSLGPITWVLLAEIFPNRVRGVAMATCTFALWVGSFTLTYTFPLLNTALGSYGTFWIYSAICVFGFLFFLRALPETKGKSLETLEKDLIK

SEQ ID NO: 19350 - protein, 426 aa, Bacteroides thetaiotaomicron VPI-5482
MKIEKIVAREILDSRGNPTVEVDVVLESGIMGRASVPSGASTGEHEALELRDGDKQRYGGKGVQKAVDNVNKIIAPKLIGMSSLNQRGIDYAMLALDGTKTKSNLGANAILGVSLAVAKAAASYLDLPLYRYIGGTNTYVMPVPMMNIINGGSHSDAPIAFQEFMIRPVGAPSFREGLRMGAEVFHALKKVLKDRGLSTAVGDEGGFAPNLEGTEDALNSIIAAIKAAGYEPGKDVMIGMDCASSEFYHDGIYDYTKFEGAKGKKRTAEEQIDYLEELINKFPIDSIEDGMSENDWEGWKKLTERIGDRCQLVGDDLFVTNVDFLAMGIEKGCANSILIKVNQIGSLTETLNAIEMAHRHGYTTVTSHRSGETEDATIADIAVATNSGQIKTGSLSRSDRMAKYNQLLRIEEELGDLAVYGYKRIK

SEQ ID NO: 19351 - protein, 222 aa, Bacteroides thetaiotaomicron VPI-5482
MIGTMVLVLMGCGSAVFAGSMAGTVGAGVGTVGVALAFGLSVVAMAYAIGGISGCHINPAITLGVFLSGRMNGKDAGMYMLFQVIGAIIGSAILYALVTTGGHDGPTATGSNGFGDGEMLQAFIAEVVFTFIFVLVVLGSTDPKKGAGAFAGLAIGLSLVLVHIVCIPITGTSVNPARSIGPALFQGGEALSQLWLFIVAPFVGAAVSALVWNYFGDKNEKK

SEQ ID NO: 19352 - protein, 452 aa, Bacteroides thetaiotaomicron VPI-5482
MGFKLLDFYKISPPVSGGETDSERSVRFKRIRWATFLSATTGYGIYYVCRLSMNVIRKPIVEDGVFTETQLGIIGSCLFFVYAVGKLTNGFLADRSNVKRFMSTGLLCSALINLCLGFTNSFFAFVLLWGLNGWFQSMGAASGVVSLTRWYSSKERGTFYGFWSASHNLGEALTFISIALLVSWMGWRYGMIGAGVIGLLGFLMMLAFMRDTPQSQGFLLDRRGTSDAHSVSGKQTEEFNKAQKAVLKNPAIWILALSSAFMYISRYAVNSWGVFYLEAQKGYSTLDASFIISISSVCGIVGTVFSGIISDKFFAGSRNVPALIFGLMNVSALCLFLLVPGVHFWVDALAMVLFGLGIGVLICFLGGLMAVDIAPCNASGAALGVVGIASYIGAGLQDVMSGILIEGQKTVQNGVEVYDFTYINWFWIGAALLSVVFALLVWNAGEKRSEIN

SEQ ID NO: 19353 - protein, 496 aa, Trifolium repens
MATSNKNMLLNYVPVYVMLPLGVINVNNVFEDPDGLKEQLVQLRAAGVDGVMVDVWWGIIEQKGPKEYDWSAYKSLFQLVQECGLKLQAIMSFHQCGGNVGDVVTIPIPQWVLDIGESDPDIFYTNRSGTRDKEYLTVGVDNKPIFHGRTAIEIYSDYMKSFRENMSEFLKSELIIDIEVGLGPAGELRYPSYPQNQGWVFPGIGEFQCYDKYLKADFKAAAAKAGHSEWELPDDAGTYNDIPESTEFFKTNGTYLTEKGKFFLTWYSNQLLNHGDQILDEANKAFLGCKVKLAIKVSGIHWWYKAQNHAAELTAGYYNLDDRDGYRPIAKMVSRHHGILNFTCLEMRDSEQSSDAQSAPQELVQQVLSGGWRENIEVAGENALSRYDATAYNQIILNARPQGVNKDGPPKLRMYGVTYLRLSDDLLQESNFEIFKKFVVKMHADQSHCDDPQEYNHAIPPLKRSGPNIPVDDLLEATKPILPFPWDSETDMKVDG

SEQ ID NO: 19354 - protein, 211 aa, Pinus radiata
MDSRPATVLVIIVSAIMASATAKDVNPQHSGTSIAEFIKSSCQVSRYPQLCVSSLSPYAGSLKPTLCDLVKAAMNVSLVNARTVSVWAAGLKGRSAEMSERERAALNDCIQNFDDTVDEIQKSLKELEQLQRSNFNPQMNDMQTFMSAALTDQGSCLNGFEDVKAAAGKISAMVKVRVQNESELISNALALLNALALNAFANTGVDDGIHA

SEQ ID NO: 19355 - protein, 508 aa, Oryza sativa (japonica cultivar-group)
  misc_feature (16)..(16): Xaa can be any naturally occurring amino acid
  misc_feature (35)..(35): Xaa can be any naturally occurring amino acid
  misc_feature (52)..(52): Xaa can be any naturally occurring amino acid
AAAEKRRRYGGGCGDXGVRGDPGRGKCTGTTPTGXWRVSASGKSVAIVNPTXRLTQYRVQACTQEEVNKVMETAKVAQKAWARTPLWKRAELLHKAAAILKEHKTPIAECLVKEIAKPAKDAISEVVRSGDLVSYTAEEGVRILGEGKLLVSDSFPGNERNKYCLSSKVPLGVVLAIPPFNYPVNLAVSKIGPALIAGNALVLKPPTQGAVAALHMVHCFHLAGFPKGLINCVTGKGSEIGDFLTMHPGVNCISFTGGDTGIAISKKAGMVPLQMELGGKDACVVLEDADLDLVAANIVKGGFSYSGQRCTAVKVVLIMESVADIVVEKVKAKLAKLTVGPPEADSDITPVVTESSANFIEGLVMDAKEKGATFCQEYRREGNLIWPLLLDHVRPDMRIAWEEPFGPVLPVIRINSVEEGIHHCNASNFGLQGCVFTKDINKAIMISDAMETGTVQINSAPARGPDHFPFQGLKDSGIGSQGITNSINMMTKVKSTVINLPSPSYTMG

SEQ ID NO: 19356 - protein, 382 aa, Oryza sativa (japonica cultivar-group)
MKEGGGDGGFVRADQIDLKSLDEQLERHLSRAWTMEERKEEAAADQRGSKPPALAAAHYSQNRRQRREEWEIDPAKLVVRGVIARGTFGTVHRGVYDGHDVAVKLLDWGEDGHRSEQDIAALRAAFSQEVSVWHKLDHPNVTKFIGAIMGARDLDIQTESGHLAMPSNICCVVVEYLAGGSLKGFLIKNRRKKLAFKVVVQIALDLARGLSYLHSKKIVHRDVKTENMLLARQELVKIADFGVARLEASNPSDMTRGKPGTLGYMAPEVLNGSPYNRKCDVYSFGICLWEIYCCDMPYPDLSFSEVTSAVVRQNLRPEMPRCCPSSLANVMKRCWDANPDKRPEMAEVVSMLEAIDTSKGGGMIPVDQRQGCLSCFRQYRGP

SEQ ID NO: 19357 - protein, 253 aa, Oryza sativa (japonica cultivar-group)
MGFLEDFQASVEALPAMLQRNYSLMRELDKSLQGVQTGNEQRCQQEIEDIKHGLESGSITYDPAKLKFSDEAIEEQKHCVRIADEKVALASQTYDLVDAHIQQLDQFMRKLEELRQEKEAATTAAAAAAAAAASVATGTPVAATVTASAGTSTADNTPKGGRSSERGRGGRKKTAKVPTEQPAPAIDLELPVDPNEPTYCLCNQVSYGEMVACDNNDCKIEWYHFGCVGVKEHPKGKWYCPSCIGFQKKRKGK

SEQ ID NO: 19358 - protein, 346 aa, Oryza sativa (japonica cultivar-group)
KDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVHILPFYSHC

SEQ ID NO: 19359 - protein, 244 aa, Oryza sativa (japonica cultivar-group)
SPSTSRGSAGGRGGGDHQRLVVPSSASSMPKGRCSEGESESDSEASDVSGSDGEDHSWISWYCSLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKPSQRYVPRVFGFKLHKP

SEQ ID NO: 19360 - protein, 288 aa, Oryza sativa (japonica cultivar-group)
DLDHNTITGVEPSYQRFTCLKSLSLRHVSISALDLSLLVAACPKIESLALDFLEVVTSDPQSTMELTSHTLKSLFAKSVGVDKIILDTDNLEVLNLNALNLDLFELIGKGTLKHLKIDDVSVTHMDIGESTDHLEVVDVSNFTIVRPKLYSMISRASNLRMLRFWGVVFDDEDEIVDSETIAVSFPLLRHLSLSYELRDGLLHYSLQGSSPLDNVSVLELGWTVISEHFGPWVFGMIERCPNLKKLVIHGVLSEAKTREERQMLASFTSFIVCLMRKYVHVDVQFEYE

SEQ ID NO: 19361 - protein, 169 aa, Oryza sativa (japonica cultivar-group)
MQGEVDQPMQMVLRVKHPSSLGGGGGGGEEEAGEASSRSALSVFKAKEEQIERKKMEVREKVFAQLGRVEEESKRLAFIRQELEGMADPTRKEVEVIRKRIDVVNRQLKPLGKTCVKKEKEYKEILEAYNEKNKEKALLVNRLIELVSESERMRMKKLEELNKTVDSLY

SEQ ID NO: 19362 - protein, 380 aa, Lotus corniculatus
MSSTAGQVIKCRAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMISDNQSRFSIKGKPIYHFVGTSTFSEYTVLHAGCVAKINPAAPLDKVCILSCGICTGFGATVNVAKPKPGSSVAIFGLGAVGLAAAEGARVSGASRIIGVDLVSSRFEGAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPNVVEMYMRGELELEKFITHTVSFSEINKAFDYMLKGESIRCIIRMEE

SEQ ID NO: 19363 - protein, 456 aa, Enterococcus faecalis V583
MAKKAKVQFECQSCGYVSPKYLGRCPNCGQWNSMVEEVIQDTSDRRARVSLTGKKTQPQRLSEVIPKKEPRVKTELVELNRVLGGGVVPGSLVLIGGDPGIGKSTLLLQVSQQLAATGGTVLYVSGEESAEQIKLRAERLGTVNETFYLYAETDMHEISRAIEKLEPDYVIIDSIQTMTQPDVTSVAGSVSQVRETTAELLKLAKTNGIAIFIVGHVTKEGSIAGPRMLEHMVDTVLYFEGDKHHTFRILRAVKNRFGSTNEIGIFEMQTHGLVEVMNPSQVFLEERLEGATGSSIVVAMEGSRPILVEIQALVTPTMFGNAKRTTTGLDFNRVSLIMAVLEKRAGLLLQNQDAYLKAAGGVKINEPAIDLALAISIASSYKEKGTSSSECFIGEIGLTGEIRRVNSIEQRVREAQKLGFTKVYVPKNNLGGWEAPEGIEIIGVSTIGETLRKVFK

SEQ ID NO: 19364 - protein, 132 aa, Enterococcus faecalis V583
MRDYKQLNGLALAYVGDAIYEIYIRDYLVSLGQTKPNVLHRMATHYVSAKAQASLMQAMLAGEMLTEEEEVMYKRGRNAKSHTFAKNADVTTYRVATGFESLMGYLHLTQQKERLEELINWCIKKVGETNEK

SEQ ID NO: 19365 - protein, 228 aa, Enterococcus faecalis V583
MPKLVFSRHGLSEWNALNQFTGWADVDLAPEGVEEAKEGGRKIKEAGIEFDVAYTSVLTRAIKTCNYLLEYSDQLWVPQIKSWRLNERHYGKLQGLNKKETAEKYGDEQVHIWRRSYDTLPPLMEATDEGSAANDRRYAMLDQRDIPGGENLKVTLERALPFWQDEIAPALKDNKTVLVAAHGNSLRALAKHIEGISDEDIMDLEIPTGKPLVYELNDDLTVKEKYYL

SEQ ID NO: 19366 - protein, 216 aa, Enterococcus faecalis V583
MNLILMGLPGAGKGTQAEKIIDTYGIPHISTGDMFRAAMKNETALGLEAKSYIDKGELVPDEVTNGIVKERLAEPDTDKGFLLDGFPRTLDQAKALDTMLKELNKKIDAVIDIHVEEDVLIERLAGRFICRTCGATYHKLFNPPKVEGTCDRCGGHEFYQREDDKPETVKNRLAVNIESSAPILAFYKEQGLMHTIDGNREIDTVFSDVKKIIDEN

SEQ ID NO: 19367 - protein, 246 aa, Enterococcus faecalis V583
MSAIIEIEHLRKSFGENEVLKDINMNVNKGEVVTIIGSSGSGKSTLLRCINLLEKPTDGKIIYNGKNVLERGYSLPKYRTHLGMVFQSFNLFNNMNVLENCTSGQMTVLKRNKEEAKKIALENLEKVGMARFIDAKPAQLSGGQKQRVAIARALSMDPDVLLFDEPTSALDPEMVGEVLKTMKNLAHTGLTMVIVTHEMEFARDVSDRVIFMDKGVIAEEGTAEDIFVHPKEARTKEFLHRILTKN

SEQ ID NO: 19368 - protein, 496 aa, Enterococcus faecalis V583
MSKKEINQVVASSYQLYINGEWTTGSGNKMIASYNPSNGEKLAEFVDATNADVDRAVEAAQEAFQTWKDVDVVTRSNLLLKIADLIEENQEHLAMVETLDNGKPLRETQSIDVPASADHFRYFASVIRGEEGSVKEFDKDTLSIVVKEPIGVVGQIIPWNFPLLMGAWKLAPALAAGNTVVIHPSSSTSLSLLELFKIFDQVLPKGVVNLITGRGSDSGNYMLAHPGFDKLAFTGSTEVGYTVAKAAADRLIPATLELGGKSANIIFEDANWERALEGVQLGILFNQGQVCCAGSRVFVQSGIYDQFVEALKEKFEQVNVGFPWEKDVEMGAQINEHQLEEILKYVEIGVKEGATLITGGQRLTENGLDKGAFLAPTLLANGTNAMCVAQEEIFGPVATVIKFETEEEVIRLANDSEYGLGGAVFSQDINVALRVARGVRTGRMWVNTYNQLPAGAPFGGYKKSGIGRETHKSMLDAYTQMKNIYIVTKEEADGLY

SEQ ID NO: 19369 - protein, 181 aa, Enterococcus faecalis V583
MIEKDIEKVLISKEEILAKSAELGKQLTEEYQGKNPLVVGILKGAVPFMADLTREINTYLELDFMDVSSYGNATVSSGEVKIVKDLDTNVEGRHILIVEDIIDSGRTLAYLVDLFRYRKAASVKIVTLLDKPEGRVVDIKADYVGFDVPNEFVVGYGLDYAETYRNLPYIGVLKPEVYESN

SEQ ID NO: 19370 - protein, 476 aa, Enterococcus faecalis V583
MAFRKDFLWGGATAANQCEGGYNEGGRGLANVDLAPTGPDRFPVITGEKKMFNFDEEHFYPAQEAIDMYHRYKEDIALFGEMGFKTYRLSIAWSRIFPMGDETEPNEEGLKFYEDLFKECHKYGIEPLVTITHFDCPMHLVEEYGAWRSRKLVGFYENLCRVIFNRYKGLVKYWLTFNEINMILHAPFMGAGLYFEEGENKEQVKYQAAHHELLASAIATKIAHEVDPENQVGCMLAAGSNYAYTCKPEDVFAARQADRENYFFIDVQSRGEYPAYALKEMARKGIQIEMEEGDEELLKEHTVDFISFSYYSSRVTSTDPEINEQTAGNIFASVKNPYLKASEWGWQIDPLGLRITMNDLYDRYQKPLFIVENGLGAVDTPDENGDVVDDYRIDYLAAHIQAMKDAVEQDGVDLLGYTTWGCIDLVSAGTGEMKKRYGFIYVDRDNEGNGTLKRSKKKSFDWYKKVIATNGEDLSN

SEQ ID NO: 19371 - protein, 488 aa, Enterococcus faecalis V583
MGFPENFLWGGATAANQYEGGYLSGGKGLSTLDAITGGSQTEPRRITYLTKEGQKASCTRDQALPEGAIGYIDEELYYPSHVATDFYHHYEEDIALFAEMGFKCFRLSIAWSRICPNGTKEINEEGLAFYDKVFDALLRHGIEPVVTINHFDIPMYLADEYDGWKNREVIDFFVFFCETIFTRYQDKVKYWMTFNEINFLRSWTQIGIHNNDKQSKYQAAHHLFVASAKAVELGHSINPDFQIGMMVAYIPSYPLSCKPEDVIAAVQFNREQEFYMDVQAKGYYPAHKLKEFEREGMTIQMESDDLAIIQKGTVDYIGFSYYMSTVSTAYPEEVKYVGGNQMPAVKNPYLQESEWGWAVDPLGLRISLCQLSDRYNMPLFVVENGFGAVDTLQEDGSIVDDYRIDYFKQHIEAMRTAIEEDGVNLIGYTPWGCIDLVSAGTGEMKKRYGFIYVDMDDQGQGTLKRTKKKSFNWYKQVIASNGENLTTE

SEQ ID NO: 19372 - protein, 305 aa, Enterococcus faecalis V583
MIVQSILDTIGATPLFEFTSEQYPMPEGTKIYAKLEYLNPGGSVKDRLGVHLLKEAMKTGKINQATTIIEPTAGNTGIGLGLAASQLGLKTIFVVPEKFSQEKQQLMQALGAKIVPSPTEQGIVGAITSAQDLAKEIPNSYVPLQFENPDNPAAYYEGLGPEIVQDLGGKITSFVAGLGSGGTFAGVGRYLKEQNSKTQLWGVEPEGSILNGGPAHGHEIEGIGVEFVPPFLKQIPVDGFYTISDEDGFFWVKQLAKKSALLVGSSSGAAFAAALREARRLPAGSTIVTIFPDGSDRYLSKNIYS

SEQ ID NO: 19373 - protein, 476 aa, Enterococcus faecalis V583
MSILKNDFLWGGAVAAHQLEGGWDQGGKGVSVADVMTAGAHGVPRKITAGVLPDEHYPNHEAIDFYHRYQEDIQLFKELGLNCFRTSIAWTRIFPNGDEETPNEEGLRFYDALFDECLKNGIEPVVTLSHFEMPYHLVTKYGGFRNRQVIDFFVKFAEVCFTRYQKKVKYWMTFNEINNQANYEEDFAPFTNSGIAYQEGEDREAIMYQAAHYELVASARAVKIGHAINPDFQIGCMIAMVPIYPYSCNPEDMMMSVSAMQKRYWFTDVHVRGHYPSAIQCYLKRKNISLDVTEEDLTDLANGCVDYIGFSYYMSFAVKGAEKAPTFDYNEAKDLVRNPYVATSDWGWQIDPMGLRYAMNWFNDRYELPLFIVENGFGAIDELEPDGTINDTYRIAYLREHIEMMKEAVAYDGIDLMGYTPWGFIDLVSASTGEMKKRYGFIYVDKDNDGHGTLERRKKKSFAWYQQVIATNGEEL

SEQ ID NO: 19374 - protein, 485 aa, Enterococcus faecalis V583
MTWLNKQVQKRPDHPAFYFQDESWTFLEVQQEVSHWVATYQQVLAPEEKRVALFSKNSKELYFSILALWELGKELLFLNTHLTLAELTFQLKDAQVKTIIGAPETQALLEEISFVDVQPMIKKQHSLSHQEFQQPSDLESVASIMYTSGTTGQPKGVLQRFKNHLASARGTQENMGITAEDCWLCAVPLFHISGLSIVVRQLVLGCSIRLYDKFDEQQVTQDLQEGRGTVISVVATMLQQLLSVYPEAGYSASFKGMLLGGGPIAPDKLAQCEEKGIPVIQSYGMTETCSQVVALKFEDAALKIGSAGQPLKDMQIKIVDELGQEQPEKQVGEILLKGPNVVSGYLNQRQPEKWTADGWFKTGDMGYLDAQSYLYLVSRLSELIISGGENIYPTEVEQVLQAITGIKAAAVVGEPDAQWGAVPVAYVISDQEITLAQIQDQCSRKLAKYKRPKRIYFCHSFPQTASGKIAKHRFMTEEREAFLIR

SEQ ID NO: 19375 - protein, 356 aa, Enterococcus faecalis V583
MNNLFIFVCFCFMWLMIFGVILYYVGLVNHRYIHHTLILGLVTIISGTLCWLFVGYSLSFFGNIQYSIFYSPLASSEIVSILIQLLFCLYSVIMIIGSVLERGNWKYIVLFVPLWIVFVYAPICFSLWGHGNWLGKMGVLDYSGGLVVHTTAGIGSLVLAITSPIRLKNSLIFKSQEMIAFVGMLFITLGWFGFNMAPSGKIGEEAIQVWLNTLISILGGSISWTFTQWILIKKVSIYSIMNGIIGGLVGSTCSVGYVSPAFSLLISVIVCTLCPIVIHIMHLSIANFDDAADSFGMNAVGGIAGSILTGVMAEKGDFFLQLFGTFLISIWSLSLSLLIHYLLKKIVNDCYSQCIK

SEQ ID NO: 19376 - protein, 245 aa, Enterococcus faecalis V583
MTEKILVEHLVKKYGDNTVLNDINVSINEGDVVCVIGPSGSGKSTFLRCLNQLEEASSGDIIIDGANLTDKNTDINQVRQHIGMVFQHFNLFPHLSILENIVLAPTDLGRLSKDEAEKKALELLERVGLADKKDAYPDSLSGGQKQRVAIARALAMNPDIMLFDEPTSALDPEMVGDVLGVMKDLAKQGMTMVIVTHEMGFAKEVANRVMFIDGGNFLEDGSPEQVFENPQNPRTKDFLDKVLNI

SEQ ID NO: 19377 - protein, 222 aa, Enterococcus faecalis V583
MANVLEMKNIYKKYGEKHTEVIALKELSFAVQPGEFVAVIGPSGSGKSTFLTIAAGLQAPTSGEVIVGGQSLNKLTKKQRLAQRFQKIGFILQSSNLVPFLTVEDQFHLIEKVDKSRKNSELKEQLLETLGLKELRNSYPRDLSGGERQRVAIACALYHEPDVILADEPTASLDTEKAFDVVKLLAKEAKEKDKGIIMVTHDERLLKYCDRVVRIRDGELTE

SEQ ID NO: 19378 - protein, 303 aa, Enterococcus faecalis V583
MKQLQFGTSDETVSSVILGCMRLNGAENPQQVIETAYDHGITFFDHADIYGGGDCETIFGKALKESTIRREDIFIQTKCGIRQGFFDFSKAHILEAVEGSLQRLGVDSVDALLLHRPDTLVEPEEVAEAFHLLEKQGKVRYFGVSNQTPGQIELLKTAVKQPLLANQLQFGIKHTGMVDQGLQTNMEISGSIDYDHGILDYSRLKQMTIQAWSPYQYGYFEGVFIGNEKFPELNQKLSELAEKYQTTPTGLASSWILRHPANMQVIAGSMNLGRIEEIAKAADIVISREDWYDIYRAAGNVLP

SEQ ID NO: 19379 - protein, 240 aa, Enterococcus faecalis V583
MINIKNLQKTFGKNEVLKGIDLEIEAGEVVVIIGPSGSGKSTFLRCLNLLETPTGGSVEFEGKNLLDKNTNIDQLRQKMGMVFQNFNLFPHKNVLENLTISPVKVKKEAASEATEHALSLLEQVGLSDKKENYPSQLSGGQQQRVAIARALAMRPDVMLFDEPTSALDPEMVGEVLSVMKNLAIEGMTMVVVTHEMGFAKEVADRVIFMDAGIIQEEGTPEEIFDAPQNPRTQDFLRKVL

SEQ ID NO: 19380 - protein, 463 aa, Enterococcus faecalis V583
MSIFRKKEITVPVNDSGGMKKNLKTMDLIFLGIGAVVGTGIFVVTGVAAERYAGPGLVLSFLVAAAAIILSGLCYAEFASRIPVIGGPYAYMYVVFGEIVAWMTGWMIICEFFLAVSSVASGWSGYVHGFLDSLGFSLPQALSGAYNPTNGTYIDLIAMLVVVAVTFWVSLEAKTALRLNNLMVFVKFGIILLFVLVGIFYVKPTNWQPFIPYGFSGVFSGAALVFFAFLGFDAVSMAAEEVKNPKKDIPKGIIGSIIISTLLYIVVTLVLTGIVPFTDLGVKDPVAFAMRFINHGAIATIISVGAILTLLTVTIAMMYSLARVIYAISKDGLLPQFMSKIDEKRHTPKNATYVAGFLAMVFAGIVPMEMLAELTNIVTLFYLMFLALGIIKLRTMKGEPQAGEFKVPLVPVLPLISIVVCAALMFQLSLATWQVFGVAVVIGLAIYFFYGRHHSIVRFETKE

SEQ ID NO: 19381 - protein, 464 aa, Enterococcus faecalis V583
MKYQFPENFWWGSAASGPQTEGVFEGDGKGQNIWDFWYQEAPEKFFQQVGPDKTSQFYKKYQEDIQLMKETGHNSFRTSIQWSRLIPDPTTGKVNQTAVDFYNQVIDDLLEHGIEPFMNLYHFDMPMVLQEKGGWESREVVDLYVDFAKTCFELFGDRVKKWFTHNEPIVPVEGGYLYGWHYPDKVNLKEGIQVLYHEALASAKAIAVYHSMNLSGEIGIILNLTPTYPRDEHNEADVNAAKFVDGFFNRSFLDPAVKGHFPEDMVAWAKANDLLPETTPEDLAIIAENTVDLLGVNYYQPRRAKAKETPVETRPEGLLPEDFYDVYDMPGKKMNPYRGWEIYEKGIYDTLMNLKENYGNIRCYISENGMGVEGEERFVNEQGVIEDDYRIEFVQDHLKWVHQAIQEGSNVQGYHMWTCMDNWSWLNAYKNRYGFIAVDLDDDAKRTIKKSGRWFKEMTANNGF

SEQ ID NO: 19382 - protein, 468 aa, Enterococcus faecalis V583
MNTFFKLKENKTTVSTEIMAGVTTFFAMSYILFVNPSILSETGMPFQAVFLATIIASIIGTLIMGLFANVPYAQAPGMGLNAFFTFTVVFGMGYTWQQALAMVFICGLINILITVTKIRKMIIKAIPESLQHAIGGGIGIFVAYVGLKNAGLLSFTVQAEPQNGVVNGSSIVPALGNFDNPAIILAVIGLVLTTILVVTNVRGAILIGIVVTTLVAIPMGVVDTASVDWHANSLGNSFKELGTTFGAAFGAEGLQSLFSDSSKIPQVLMTIIAFSLSDTFDTIGTFIGTGRRTGIFSKEDELALEDSKGFSTKMDKALFADAIATSIGAIFGTSNTTTYVESAAGIGAGGRTGLTSVVVAILFALSSLFSPLIAIVPAQATAPALILVGIMMLASFKDINWTDLEDAIPAFFASIFMGLCYSISYGIAAGFIFYAVVKVVKGKAKEVSPIIWVIDALFILNFVILAIL

SEQ ID NO: 19383 - protein, 473 aa, Enterococcus faecalis V583
MTKQQFGVVGMAVMGKNLALNIESRGYTVALYNRTGSKTTEVVEEHPDKNFQATYSIEEFVNAIEKPRRIMLMVKAGPATDATIQELLPHLDKGDILIDGGNTFFKDTMRRNEELANSGINFIGTGVSGGEEGALKGPSIMPGGQKEAYELVAPILEKISAKAEDGEPCVTYIGPNGAGHYVKMVHNGIEYGDMQLIAESYDLMKQILGLSVDEMAEIFKEWNEGELDSYLIEITADILTRKDDEGTDQPIVDVILDAAGNKGTGKWTSQSALDLGVPLPLITESVFARFISAYKEERVKASGILSKPAAFNFAGDKKELIEKIREALYFSKLMSYAQGFAQLRAASEEYGWDLPFGEIAKIWRAGCIIRAQFLQKITDAYEKNPALENLLLDEYFVEITKKYQQAVREVVAIAVQAGVPVPTFSSAIAYYDSYRSDRLPANLIQAQRDYFGAHTYERTDKEGIYHYSWYNEE

SEQ ID NO: 19384 - protein, 269 aa, Enterococcus faecalis V583
MISLDLSNKTMENKELLSIKSVYKEFEIEGHSEHLKVLENIDLTVKTNEFLSIIGQSGTGKSTLLRSIAGLLRTTRGEITFEDKIINEPDANIGMVFQHFALFPWLTVEKNISFGLENRKEISREQINKRVSNLIEMIGLTGFEKAYPRELSGGMKQRVGFARALAIEPSLLLLDEPFSALDIITASQLSNDLLEIWLNNQIATKSIVMITHDVQQAVQLSDRVVLMDANPGRIAKIYSIDIPRNQRSPKTTIDIVEQITEEMVRRIHL

SEQ ID NO: 19385 - protein, 450 aa, Enterococcus faecalis V583
MSETQQTTLKKQLSSRHITMLALGGAIGAGLFKGSGEAIGIAGPSVLIAFLIGGAVLFIVMSGLGKLVLDGGDTHHGLSGLVRPFLGAHSADFIDWVYYSMWTINIIAEAVAAASFLQLWFPNIPAWFFVFILAILTTLINLYSVRLFAETEYWLAFAKISVIILLIIFGVYLVGQQMLGSGVFPTLQSITDHGGFAPHGMKGIVNSLLVVIYSYGGSELIAITVSEADDPKKAIPKAIRGVMGRIISFYIIPLFLLLIIFPWNTLAGTTVSPFVMVFEKMNIPFAADIVNFVIILALFSSINSGVYASSRLLYFRLKDKKGPMSKLGVLNKHQVPQRSVFFCASVLYLGVILSYFVGDELFGYLAGSLSYTVLLIWILISAAAFVLSLKRGSLFEKSINLLALIILGLIFIGILFTNSLGVTLLTGLLYFVIFFSYRKKNDSFLLSDES

SEQ ID NO: 19386 - protein, 243 aa, Enterococcus faecalis V583
MISLEHVNKYFGEHHVLKDITLNVEQGEKIVIIGPSGSGKSTLIRCMNQLEKVNDGSVVIDNIDITKPKAPIQKVRQKVAMVFQNFNLYAHKTIIDNLTLAPIKVMGVSKDEAVRTGMEYLERVGLADKASAYPSQLSGGQQQRVAIARALNMHPEIILFDEPTSALDPEMIQEVLDVMVDLSKQNITMVCVTHEMGFARQVADRVIFMDQGQIIEQGTPEHFFTSTENPRAKEFLSKIIHNG

SEQ ID NO: 19387 - protein, 221 aa, Enterococcus faecalis V583
MKKAIAECLGTFILVFFGTGTAVLGNGMEGIGTTGIALAFGLTIVAAAYSIGTISGAHLNPAVSIGMWLNKRMTTMELIYYVVGQIVGGLIASFALLSILKGAGKSIENLGQNGVGELSVAGALTVEIILTFIFVLVVMTVTSAKKGNASLAGIVIGLTLTMIHLVGIPLTGTSVNPARSIAPAVFAGGSALSELWIFIVAPLIGGLLAALVAKFVLDTEE

SEQ ID NO: 19388 - protein, 447 aa, Enterococcus faecalis V583
MKVIVLGSSHGGYEAVEELLNLHPDAEIQWYEKGDFISFLSCGMQLYLEGKVKDVNSVRYMTGEKMESRGVNVFSNTEITAIQPKEHQVTVKDLVSGEERVENYDKLIISPGAVPFELDIPGKDLDNIYLMRGRQWAIKLKQKTVDPEVNNVVVIGSGYIGIEAAEAFAKAGKKVTVIDILDRPLGVYLDKEFTDVLTEEMEANNITIATGETVERYEGDGRVQKIVTDKNAYDADLVVVAVGVRPNTAWLKGTLELHPNGLIKTDEYMRTSEPDVFAVGDATLIKYNPADTEVNIALATNARKQGRFAVKNLEEPVKPFPGVQGSSGLAVFDYKFASTGINEVMAQKLGKETKAVTVVEDYLMDFNPDKQKAWFKLVYDPETTQILGAQLMSKADLTANINAISLAIQAKMTIEDLAYADFFFQPAFDKPWNIINTAALEAVKQER

SEQ ID NO: 19389 - protein, 346 aa, Enterococcus faecalis V583
MTFVDLKDIRVSYDGKQDILKDLNISMEKGELVSLLGPSGCGKTTTLRVIAGLIKPNDGQFFVDQEELTKVPVHKRNFGMVFQSYALFPHLTIAENVAFGLKLRKENKQTMDQKVTEMLKVCGLESLGDRYPKQLSGGQRQRVALARALIIEPKLLLLDEPLSNLDAKLRVAMRIEIKRIQQQLGITTVFVTHDQEECFSISDKVAIMNNGVIEQYDSPETIYRLPRTKFVAEFIGFENFFSVEKMEAGHYRTQTNQIVKTTNPEPNVTTTVATIRPEDIEIVSEAATNTVAGTVAVRTFLGKSYQYEVETALGTLLVNGTSEQLYETNETIHLAFPAEKLVILEK

SEQ ID NO: 19390 - protein, 477 aa, Enterococcus faecalis V583
MEHHQLKAFPQDFLWGSASAAYQVEGAWNEDGKGASVWDEFVRLPGKTFKETTGDLAVDHYHRFKEDVALMKQQGLKAYRFSIAWTRILPEGRGRVNQAGLKFYSDLIDELLAAGIEPMVTLYHWDLPAVLQKEYGGWESRKIIDDFVAYAKILFDAFRGKVRYWISLNEQNVFTSLGYQLAVHPPGVTDNKRMYEANHIANLANAAVINAFHELEMPGKIGPSFAYTPVYAVDAHPANVLAAENAEDLLSHFWLDVYLWGEYPIAALNYLQEQGVAPTIKEGDLALLRSAKPDFLGINYYRTDTVAANPLDGVGIGKMNTTGEKGSETESGVPGLFKKVNNPYVERTNWDWAIDPQGLRIALRRLASRYQVPILITENGLGEYDTLTEDKQIHDTYRIDYLRSHIQAIQEAITDGVSVIGYCTWSYTDLLSWLNGYQKRYGFVYVDQDETQKGSLERIPKDSYYWYQKVIETNGLI

SEQ ID NO: 19391 - protein, 389 aa, Enterococcus faecalis V583
MATKRDYYEVLGLAKGASDDEIKKAYRKLSKKYHPDINKEADAEEKFKEVSEAYEVLSDPQKKAAYDQYGHAGTDPNYGGGAGGFGGFGGGGFSSSGFGGFEDIFDSFFGGGGGRSVDPNAPRQGADLQYTIQLKFEEAIFGVEKEIKYNREDTCATCGGNGAKPGTHPETCHKCHGSGTINVERQTPLGRMMSRQTCDVCHGTGKEIKEPCPTCHGTGHEKKAHTVKVNVPAGVEDGQQMRLANQGEAGTNGGPYGDLYVVFRVEDSDIFDRDGAEIYYDLPVSFVQAALGDEVTVPTVHGDVKLKIPAGTQTGTNFRLRGKGAPRLRGGGNGDQHVKVKLITPKNLNEEQKDALRAFAKAGGQNVTEQQEEGFFDKMKDAFGGKKKK

SEQ ID NO: 19392 - protein, 468 aa, Enterococcus faecalis V583
MVVGDFAIELDTVVIGAGPGGYVAAIRAAEMGQKVAIIEREYIGGVCLNVGCIPSKALIAAGHHYQEAQDSSTFGVTAKGVELDFAKTQDWKDNTVVKSLTGGVGMLLKKHKVEIIEGEAFFVDENTLRVIHPDSAQTYSFNNAIVATGSRPIEIPGFKFGGRVLDSTGGLNLKEVPKKFVIIGGGVIGAELGGAYANLGSEVTILEGSPSILPTYEKDMVKVVTDHFKKKNVTIVTSAMAKEAVDNGDSVTVKYEVNGKEESVEADYVMVTVGRRPNTDDLGLEQAGVEIGERGLIPVDNQGRTNVKNIFAIGDIVPGAALAHKASYEAKIAAEAISGKKVAVDYKAMPAVAFTDPELASVGMTVAEAKEAGIEAKGYKFPFAGNGRAISLDKTEGFMRLVTTVEDNVIIGAQIAGVGASDMISELALAIESGMNAEDIALTIHPHPSLGEITMDTAELALGLPIHI

SEQ ID NO: 19393 - protein, 449 aa, Enterococcus faecalis V583
MSHIQLDYSKLAPFVADHELEYMQTQVTAVDKALREGTGAGNDFTGWIDLPENYDKEEFARIKKAAAKIQSDSEVLVVIGIGGSYLGARAAIEFLTHSFNNLLSKEERKAPQIFFAGNSISSTYLADLINVIGDRDFSVNVISKSGTTTEPAIAFRVFKELLINKYGKEEANKRIYATTDRAKGAVKVEADAEGWETFVIPDDVGGRFTVLTPVGLLPIAVSGADIDRLMEGANDARKEYGATSDLKENQAYQYAALRNILYRKGKTTEMLINYEPGMHYFSEWWKQLYGESEGKDGKGIFPAAADFSTDLHSMGQYVQEGMRNLFETVVKIENPRHSISIPEQNEDLDGLGYLQGKEIDFVNTKAFEGTLLAHTDGGVPNMIVKVPTMDAYSLGYVMYFFEIAVGISGYLNGVNPFDQPGVEAYKRNMFALLGKPGFEELAKDLNARL

SEQ ID NO: 19394 - protein, 259 aa, Enterococcus faecalis V583
MIKIIVAGFKGRMGSTATQMVLETADFELVGVYDPHEAQETVSFNDETAIPVFQRLEEVLAVKPDVWIDFTVPEAAYPNTRFALEHGMAPVVGTTGFTEEQINELTNLSREKAIGGLIAPNFAIGAVLMMQFAQKAAQYFPDVEIIELHHDNKLDAPSGTAIKTAEMIQEVRPAKKQGNPQEVESIPGARGADFEGLRIHSVRLPGLVAHQQVQFGSVGEGLTIRHDSYDRRSFMTGVALACRQVVQRTELLYGLEQML

SEQ ID NO: 19395 - protein, 282 aa, Enterococcus faecalis V583
MKVGYLGPIGSFTYSATLAAFPEATLMPYASIPACLKAIEQQEVAWSIIPIENTIEGTVNASIDYLYHQAQLPVQAELVLPIQQQLMVAKENQAIWQQSQKILSHPQALAQSQMFLEKNFPEAILEATPSTAYAAKYIAEHPELPFAAIAPKLSAEMYDLTIVEKNIQDLSVNQTRFWVLGSENLAISFPLSEKKITLAITMPSNVPGSLHKVLSVFSWRGINLSKIESRPLKTKLGEYFFLMDLVKDQPEKLIEAALTELELIGAEIKILGDYPIYVLSTL

SEQ ID NO: 19396 - protein, 310 aa, Enterococcus faecalis V583
MTKGYVKSVTELIGQSPVVKLKRMVPEGAADVFVKLEFFNPGGSVKDRIALSMIQQAEADGRLKPGQTIIEPTSGNTGIGLAMVGAALGYPVKIVMPDTMSIERRKLMQAYGADLLLTPGAEGMKGAIAKATALAEEHGYFMPLQFNNPANPMVHEQKTGKEIVDVFGKRGLDAFVSGVGTGGTVTGVGHELKRIFPDIEIVAVEPTESPVLEGGEPGPHKIQGIGAGFVPEVLDTTVYQKVAAVSSEDALETARLMGPKEGILVGISAGAAIKAAIDLAVELGAGKRVLALVPDNGERYLSTALYEFPE
